United States Patent 10,407,724 (METHODS AND COMPOSITIONS FOR SCREENING AND TREATING DEVELOPMENTAL DISORDERS) - sequence listing, part 63

SEQ ID NO: 1728 - DNA, 160107 bp, Homo sapiens
cttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttgaaaaacatttttggattgtttcattctttgcttgtcatttatctgttgattagaccactaaagtgaaggattcaagctaaatacatcaacctttctatttaggctttatcagctatatgtaaattcaattctatcaaaattttctgagtgcctcctcagtgtgtctctctgatggttcctgcccggtatggctggcatgaagaagatcctgtaaaaaagagaattcatttatttattcacttagtttgttcatgcatttgtttaataaatattgagatgtaccatgtgcctggcattgtggtaggtattgggaacacaggagtgagcaaaacaaaagtcttgctctactgcagttaagggccagggagaggcagaaaaagtaaataagtaaaatctatagtgaatttggtggtatgtacaagcggaggggaaggggttacggttttagatggactggctctttcagaagctgacacttgtacagacctgaaagatgtgaggaagtgagctatgcatctgtcgggaaaccattctgaaggatacagcaggtgcagactccagtgggatggttggtgtattctgggagcagccagacggcccatgtggctggagaagggtgagtgtgaggagtctaacaggagaggcagagaggaattggggtagcaccggaggctgcctcttaggccacagtaaggacttcacttttgactctgggagccagtgtaggagttttgagcagtggtctgatttaagctttaacgaatcacccaggcagtgggaatcaactgaaaggggaaccagtgagaagcttttgtaatcatccggacaaaatgaaggtgggccagactagggtggcagcagcagagcttgtgacaagttggattctggacatattttgaagataagagttaataggatttgctgatggattggataaaggttgtgagagagacaagaaaagaatgatgcaaggttttagcctgagcaactggaagaagagagttgccgtcagctgagatgaagacaatgaaagcagctttgcggacgcggtaagtttgagatgcccgttaacgagacatccaggtggggatgctgagtaggcgggatgcaaggctctggagttcatgggaaagctccaccaggaggtagaaatctgagagtcatcagtgaattgatggtatttaaaatcagaggagtagatgaaatcagcagtgaagtgggtgtagatagaaaagacagggggccccaagactgagtccagggcagtctggagatcagtgggatgagggataagcccaggagactaaaaaggaccagcagagactaagagttgcaaattagtgtggtaagtacagtgaatgcagcaggcatgggccccttaacgtcttcttgtctgtagtccttgatcagtctgctcattcacccacctatctatcctgtactccttgagcatctgcatgccaagcactgttttaagcagcagaggaagcaataagtaaatacatttgagttgttgagagatcatggggacaacagatgataagaaaacaggacagtatcagcagttgtcttatctgaaaaatgaggatccgttcctccctccagattgttgtaggatttaatgagataaagctcctgaagcacttatctcattgcctgcactaagagaccgctcaggggacattctgcaatgccatttgagctccctcctctttgcctggcaacagccccagctgccatctctgcctccagttgtgcccttctgcatgatctttccagagcactcatctgaatcacattaaacttctctgtttaaactttgtgtttacacttctgtttaaaccctggacctgctccaagttctcttctgtagctttgtgtacactgttttctctatgctgtcctctcaccgattttcttttccccgctaactccctatgtttcacaaattctttaagatgaccctcaagagctgaagggctgccctgccctctcctagcattctcttttctctgtcatggcttttgttgttttggaattgcttgcttattgaggtccccagtaaatcgtaagctccttgaaagccaggactgtatagagtctaacatgagcctagcattgcaatgagggcctcagtaaacacttgttggatgactggaattcatctcctgagttccatgggatgaatttgcccacgtgttcataacacagtctatgttcttcctttccataaggatatcatgaggctgtcaaatgaagatgtagcatatcaccagcattttatcttgccgttttagtttggcctttttctgtgaaacatcattaggggaaagtaaaactttacttggacaaaagaggtttgctaccaaattatataaaatgaataaacatatccctggagtgtttaagtcagcaagtatggccatctattattccacagacattttatattataatttactcactgaactttaacgaaggagaaaatgattttctaataattcttagtctttgaagattgtcactggaatacattccttgctcataaccactccccttgggaccgtggatatactatacagttattaaaatgcctgaattagaaaatctgctgctcttgggctatgagtttaactatagaagaattactgtatatgctcacacgagaggggcagaagaagggggtcacatttgagacgtagcagagaccaggcctttgaagtcctctggcatcaacaatgacttgctcctgagtcaaatgatgtgagaaaaccagaatttgggaaattttcatttcaattaagattcaggaaaatgagtcactggtgttctttgtaaattcatttatgaggtcaggcccccagaactgggaatgctccttatcacatagaaatgaatagaaaaatctgcctctgtaatttccatcacccagggctagaatatgtaactagagagggtggtcgaggcctgagtttgggtctgggggttcagagcaaccgatcaaactggaaaactgagcaggtgagtggagactcctgctgttctgaggagcacacgttcgcattcattcaaatgtttatcgccgctccactcgaggcactgcccaactctcatttatcttcacagaagttgagtggatctgcagactgcagcttcagtttttagatagaggaagaactaaaccccagcagctaatcggtgacaaagccagggctagaatccaaatctgctattctttatagatagaaaggccaagactcttaggcttgtaagtcacctgtcagtcacaactggaagtagaatactcctgggttcagtggcagatgacatcagcctaggggtcataaggcttggtttcactagctggggaaagtcatccaatagcttacgtgatggttttggagatgttcttatattcaccttcaattagcagtgagcccttcactaagcccttcatcttgggcttattgccctacttgctgtcaattaacctctggagacacaccaagtcttttagaaggaaggaagggagctactattttttgagggccttttatgtgccaagcccacaggctgggcattttccatacgttatttaactgaatcataacagtgctgcaaggtgttatctctttcataggtgtgcaaacagatgcagagaggttaggtttccagggccccacagccaagtggtggagctgggtttctggtccacggccttctgtctccactgggtgacactccctgtaccttctcattgaagcccctgggctagagggtccaagagcatcacttcagttctgcatttcattcgttactcacttgcatcaggacagatgcatcactactaagctctcggagaaggcatcagatgctgtctgctcccaaggagcttctacttttggtagtctgcttaacttgtatctgtgcctgtagagattgctctttgaaaaaagcagcaggaacattctgatagaagccaatggatgggacaggtggggggaatgcgttggatttgccagcacctggccactgcccaacctgctctcaattctcagatgattcaggtattgagcaaggaaggtagcagagctactgttgccttccctttggggaagcctgtttctactttgaaactcttaagggattcatttcaaattagtggcaggccttggttagtggatctgtgtgctgtcttctgccatcttgattgcatctccccccttctccttttcctttcatttgaaaaaagatgcagcccctcagagcctcactttcctgatttgtcaaatagggaacctaatgtacaaggcttttgtggggcttagaaaaaacatgtcaagaatctgatatagatctcaataaacagcataatacttatctttcgtcccagttacaaacccccattcctgtactgcccaaatctccatgattcacaaattgcgaccctgctgcttctgctccatggcagacacctagctccaggcaccctcctctaccacctccttctccttatggccattggcttttaggagacagacattgcttacttagcaggaaagctgtcacctgctttcttttgaactatcccgaacttgattctctttgggcgacgcatacacccatcaagtggtaaagaagactgggaatgaggggagaaaagaccctgggcttgttgctggggccagtagcttgggagtgtggtggtatgtgtgtggctttggctgtcaagtggatctaagttcaaccctggctacactgactttccagctgtgtgacttcagcaaatgggttaatctcctcaaggattcacttcctagggaggctttaaatgtccccgggtgattccagtgtgcagtggaggttgagagccagcgccctctactctcacccttgatgcccaaccaactcattgccagtctcctcctttagcacagcccatgatgctgcgatgtctgccaatgcagcatgcccctttgtgcctgctctgcccataacattctcaggagcttgctggacagcacagatgtttggtgtgcatattaacccagctgtggggatctttcctgctcaggtttggtggctaatttatagagcagctctgtcaggatgatcaccaatccctcttacaggcactgctttctctgttcaagtgtctcacatgtgtgtgcttgtgtttgccttttagctattactgtgatgattcccaatgtagtagacactgccagtgaccaccgcaatatccaatctcccccttttcctcactaacaacccctgcattgttgggggctgcagtgtgctcagctaaaactaacaattgcagccacattttccatcctcctacataggggtggccaataagctgtatgcagaagttgtggggtggagcttccaggaaagctcttaaaagtctgccttattcagctggacaatgcttccatcctatggtccttaccatcttttctaatgcctggaatatgtgtgtgctggaggatgctccagcagccattttgtgacaatgaggcaatcttgaggctaaaagccacttccaaaggatggcagagtagaaatatagaaggatcttgagatttcaatgatatcataaagctacaattccagctctgtactgcctatctctgaagttcatgttacatgagggaaaattcaacccctgcctcgtttaagacattgttattgctggtctttgctactagttctttagttcaattcctaactgatacttcccaaaacaaacctggtgaataacagcaattcaacaaatgtcaccgacccctgaatctctgcctcctccacccactcaccccagctacaaacactctttctttctcctgatgagtaaccgggcatctagctgtaaggttgctgaagctttgtggaatctcagaaagtcataaagctactgaacaagttcacaaacaagtgatgcatagaccacacccagcccacagatgagttctgtgtggctcacacttattttttaaaactgggtttgctgccaacacttcaaaacccaacgattttgcgtgaaaatccagatttcttagaaaatctgtggacccagggtcttcctttctgcctggcaacaatcagctggaactcagcagtggttgcccctgagatgaggcacagccccatccccctcactcatgtcacctgtatggcttggaaggcatgtgagtttgcaacctgctcaaacccacaccccagaaacggcccgctaaaatgggatttcagaatccacttgtacctttcttctttctcagtctcccctgactcaacacagcacactggcattgtttttttcctctcagacaactcagcatgcacttttgagaatcagagagaaatccgcctctcaaatgtcagaaaacagctgatgctgcctcttacttgggggccttttgacttcccacgtgtcttactgccacttgagagggagggctgcaggcaggcaggctccctggggagcagctgttgggatgcttgattgaggccctgagacagccagaggacaattaaattgggtattgaatatgaattgctttgaatggtttttattaccacattgtgagctgactttggttgtaaaatctgactccatctcttgctcttactgtggtgatgagacagaacttcaagatgtcttaaatagcagggcttggaacatgcatattagctcatctgtactcgtgaagtctgtcatctgatacccgcgctcctccactgtctgaaccaagttaggagccctgattaaacctccgcggctgcagtcgccaccttccgccggggtgaccccattggagatgacaaatgaaggatgtcttatttcagcctgatgtgtaagtcttcacagcactggtcgttaactactcttggaaagttaaatgcccatgcagctttttttttttttttccccaaacaaacataggtctctgaggttttggagagaaaaacaaaaactgttttaataataatttgtagctatgctttttgatgagttgcacactgagtgcaatatgttggctgcagaatgaccatctttgcagaagcaactctaaggaaagtgatgccacgctaagcacagagtgagttctcaataagtagaccgacttgagcggaagacagaaacagttaagtggagttggcatttccctggttggcaccaaggtctcagggttatttcgaccacaaaattaagttccagctcctagctactaacagagtcacaatatgcagcatggtgatggtcaaaaggcctgagcaagttcaaagcgccgtctctgccggctttggaaccggtttctgtgggaagcaggactctgttgctggggcaggcagatgcttgtgtccatttgcctagaggcagtaaatgtggggctggctggctggctgttggggagctaggactggaatatggggtgggccagtgggccttgctgcatgtagactctgtgctggctgtgttggctagttagttacccaactttatttcaaaaaatgtgtttcgaaccttcagatcgactagcctatctaaaaagagaacttagaaagttattttttttaaaaaaagtcttcttcctacggatttcctgaacatggccattatattctaattctcttgaggctagatcacttatcaaattttcatttcttttcagaagtaattaggagtgatgctaccttgaatccaggtgtgaatttttattgatttttgaggatttggccacgtgttcctttatccaagcctgtcttctgctccatcttatccaaacaaacattgaaccagcaatattcccaagtattccaacttgagaaaaatcttgtgtgtcttgagaaaaatcatttccatgacttattaatgaactaactagggataattttcatagggttcgttaactcagatttatcatagaatacaatttaataagaaacaattaaatggagtaattgaattcaagtccttttttgagtaatgatgttagcattcaatgaccccccctgcccatggttattgaagttatcaatgtatcaattttccccttgaagaaaatcagctgcaaatctcttcgtcaatgcatgggccgcctctcatctgccccctgcaggcctagcccttccttttcccgtccctgctctggtctatggggctgctgtgtgtatagaaaaaaatgaaaggactgatgaccatgtagataatgtttttccaaacataccatcgaggctgtgctacaaaagtgatccagtttggtggtcctttctcttttagagatgcctgttttgacaattcctccttacagtctgctttaatatttaaaagaaggcagtgggggctttaggttaaaattaaagtttcagaggcctgtgtatctttctcagactggttgaacttggaactgtgcaacttttctcaacaattttgccaattaaaaaagtccctttagctgtagatgctgagaaggctgggcctttggttctgctcctaaatgggagtggggaaggtgctcacagaacgatgccaagcaccactgctgtacaacttctgttttatttttgtgtgctttttttataggatataaataatgacaaaaattacaaaatttataactggaagcccaagcttatttacacatatgcttctgtttcagcaaagctcctattaactttgctcctatacaattgcctcctggtaccatattttagtgttatttaactctcattttgctacatacatatcaacagtgaataggcaaaatatatacaaggaactgttcagttcaagtaatttaatattgtattaaaattcttcaacactgaactaaaaccgtatacatttgttagtttgaaataaaatgtagttattcttcaaaactcaccaactgatgaatgtaactgatcatctcagttaggtttaaaataatgtcagttaataaaaaaacattaagacaattccacaatttatcaatatcgctataatgaacttcaaaatgattcacaatatgattgttagaacaatatacattaaaatgttatttttttctataatgatattggtactgtttatataatttgattctacataaatatacattatggtatcatacaaatactccacagagacattaaaaaattaaaataccttaaagaaatgtaagtaaattttatttaatcaaatagtaagcaaactttttttttgtttgtctcaagaaaagttttattactttggaatttcttcttttttttttttgtatttattttttctagaaaaagaaatttttgcaatagaattttattaacacctttctcaaacaaggtttccatgacagaaatcttgacagcaggagcactagatttttttttttttaacatgttctttaaaacactgtgaagattaaaaaacaatcttggcaggctgatggctgcgtcagcacttccgggcctcctgctctagggagcatcaccagtattttgccaccactgagccagtcctcttggtagtagcagtagaaatttaattatttgaaatgaaaccagaaacatccctcgcaactaacctagttttcttatcaatgcattaatgaaacattcttttaataaaaatatttaatacaagacacattttgctgtgcataataaattcctctgctttgaatcattctttccttttgaaccaatcatttggttgaaaggttttctttctctgacataggtgattacatataaaatccacaaatatagaaatggggaaacagaatctcctggcaatcatatcacgggagttgtttttgtccttttgcattaaacgatactcaatgatagaatgattttacagatgctttggaggtgggaggggtagtgctgctctgatttcacctttaaaactgctgacagtgaaagcatacttttaggcagtattagagatcccctttacttttttttttttttttttttttttaaagaaaaggtattattttccccaaatgaagcaaagcaagtactggggcggagtcatcagaaataccttgggaggtggtggggaggggagtcgggagcatcagggaaaacccatctcaactcacgcctctcaggggttgcgactggaaagtcttgcgttttccatcactggtgcagaaagaacttccccaggaatggccagtggcctttcgcccgtaacaaggccgcacgctcagagcagtcttcctcctgggctgggtggacgcggaggcgcgaaggaaagcctgctccgggaccgcttggcgagcaaggcaccgcgaggacaggaggacggcgagtatcagaaaatcgtggtttcatacttggtattaatgcccctcttggcttcttggcccggctccacaatccacggtagattggccagagtcttttgctcagatgggtcgatctgctttaaaacagaaaggctgatgcctgttatacggtcgccgcgcgggtgcgcgcatgcacgcggacgccgctggcgaacccacgcgaggcccctcgccccaggcgcggggcggcgatgctggtctaggcggctcgcgggctcgctctttggacacacatttaccgcataccgactctctgcagggcaccctgagggtgacggtgaataaggcacagcccttgcccttgtgagcacacagacggggagcagacagaggcggatttcagtgctgagaggtgagatacgaggggaagagagggcaccatgtgggcacacacaccttgggagccaggggggcttcctggaggaggtgaatcaggcatgccactccccggctctcactctccagtggtttccatcacagtcagtcagaacaaaacccgaactcctcaccgtgacctccagtacccctgcccacctgatttttctgctgcagccacacagcttccttgctcttcctgcccgccaagcccacgcccagggcctctgcgctcatcatctgctctgcccgagttcccttctccagacacctgcatgcctcatgctctaatgccattcaggtctctgctcaaatgccacttccactggcacctgtattcctagaagcctttcctgtttactcctacaaaaagcaccccaacttttctgctctcctcttctgccttattcctgacaatacttattgccgctatgcgtcatcacatatttatttgttcatcctccactgccacgtatgctcatggaggcaggattttgtctgttttcatcactgccattttctccaaaacgcagaaaagctcctggcaaccccgtaaataataggcacacaataaatacttgttgaataaatggtatcaaaagaatgaggtaatatttaaatggacagccgaaggaccagcaagtatttgcctgaagacaggaggagggggcatttgaagtagatgaaacagcacatgcagcagtcccagaataatctatacaacagaatgaaacacagcctcatcttccactatatacagaaatcaactcaaaatggattaaagacttagagggaagacctgagacgatgaaagaactggaagaaaacattggggaaacactacaggacattggtctggataaagattttttgggtaaaatctcaaaagcacaggcaacgaaagcagaaagagacaaatggaattacatcaagtgaaaaagcttctgcacagcgaaggaaacaatcaacaaagcgaaaagacaacctacagaatgggagaaaatatttgcaaagtatccatctgacaagggattaacaaccagaataaataagggactcaaataactcaatagcaaaaaacaaaaataaaaaacaaaaacaaaaacaaaaccaactcaatctgattaagtaacaggcaatagaactgaacaggcatttctaaaaagacgacatacaaacggccaacaggtataggtaaaaatgctcaacatcactaatcatcagggacatgcaaatgacaatcacaatgtgatacgatctcacccccgctactattgaatggctagtatcaaaaagacaaaaactaatggatgctgatgaggctacagagaaagggaaacacttctacactgttggtaggaatctaaattaggaaaggcactatggagaatagcatggagggtcctcaaaaaactaaaaattgagctaccatatgttccagcaaccccactactgcgtatatatacaaaagaaaagaaatcagtatatcaaagagatatctgcactcccatgtttattgcagaattattcacagcagccaagacatggaatcaaactaagtgtccatcaatggacgaatgggtaaagaaaatgtggtatatatacacaacggaatactattcagccataaaaagaatgagatcctgtcatttgcagcaacatgaatgaactgaaggtcattatgttgagtgaaataagccagacacagaaagacaaatattgtatgttctcatatgtggaggctataaaaagtggatctcatggagattgagtagaatggtggttaccagaggctggaaagtgaagaagggagagtagggatgaagagagattggttaataggtacaaaaatatggttaaatagaaggagtaagttctagtatttgatagcacagtagggtgactgtagttaacaacaatttattgtatatttcaaaataactagaagaattgtaatttctcaatacaaaagaaaaatatttgaggagatggatatctcaattactgatatgatcattacatattgtatacatgtgtcaaaatatcacatagcaataaaaaacagtcccagaggtaagggaaaatggtcgttgaggggttggggtcagtttgcagggtggggagcgggaaggcagacagctaagggtgaggaggtgagcagggacccagtcaggctaagccttgagacaaatcctaaaatggtttcgtccctgtgcgtacaaatacaacgggacactcctggggcggggccgggctgtccgctctcaggaacggccctcaggtggatctacaccatggctgcctcttcctttggtgtttccaggtctgcctgccctgtcctagctgcctgctcttctcagagcctgaggttgtgggaaggcctctcccatttctctggcaccatgagctttgcagctgccttctaccgtgccttgactgtatctccataaagctgtggggaggacctcacgtgttcttagggatcactgaatatttcttaccaagaaatgcctggggctgaaggaactagaatactaatgcctgtcgagggggactgatcttgaagcacataaataacatcagtattattcactgtatattttcctatttcccttgaaggcatctggatgaatattctatgagctcttatgccacccaaccctttgtgctcttctggaagaagcctgtggggaccagggtaaggtcagatagaggcacctgctgtgaacagatttattcagcccacatgagaatgaatacaatagtctaagagataatctctaaaacattctgcaaattcctggacacttagcagcctaatcaatctcaaagatatgcttgtgaaatccatccacaggccctcattttgtcatccacagatattcactgaacacctgctatgggcctggttccggtggtgacaacacaggtggggtccctgtgtgcatgaaacttacatttttttttttgagacggagtcctgctctgtcgcccaggctggagtgcagtggctcaatctctgctcgctgcaagctccgcctcccgggtgcaagccattctcctgcctcagcctccctagtagctgggactacaggcacccaccaccacgcccagctaacttttttttttttttgtatttttagtagagacggggtttcaccgtgttagccaggagaatctcgatctcctgacctcgtgatctgcccgcttcggactcccaaagtgctgggattacaggcgtgagccaccgtgcccggcccaaaacttagatttttgtggaggaagatagacaataagccatcagtaaaaaaccctcaattaataaatgctacacagaattaaaagcagatgacatgcttgaaggtgactgggtatctatgtcagattgggtggttaggacatccgcctcttcaagtagccgagacctgaatgacaagatgaagtcagccatgcagaaaccgggggaggatattccaggtgtggggagcaggtggcataaaggcctcaggtaggagtgagcattacatagtcaaggaatgggaagagctgagcatcacagaggactgtggtgggaaactgcattctgggtacttggggcagagggtgccatgactgatctctgctgtgtggggaggggagtctcaaggagctatactgcataggcctggggcgaggtggcagtggccccgactggaagagagatggaggaagtggggaagagtggacaggattgagatatattttaggggtagggtggatgggatttgctcatgggctggatacagaggtaaggggaagacagggatccaggctgacttgtagactttgggcttgagttgcatggtgagtggctgtggggtggggaagttggtgagagaagagctttgaggggaaaatcaggaattgtgtcctggacatgctaagtttcagatgtctgtgaagcatcaaggtggaaatgtgaaagaagctggccacgtgagtctggaattggggggtgcccagggctggagatacagaactgggagccagtgtgttgggttgggtcagtgctgaatgggaggaccaggggctcagagcgtggcatcggaagaaagacttcagaggagatacagctcctggggatggctggtaatgagtgatggacacaggagcgaatggccggggctggagggaaagatcccgaaagtaaactgtcagggaactgtgagaccagatgctggaggggtcaatcctgtggatgttgatggtgccaagaagggtgacaggggtaggcccccaaaagaagactgaaaacaagaactgcatgttcacaaagggaggtgcctccctgcaaatgttaaaaatgcctgctgctgttccccatgacagtggaggtgggggctggtgagaaggaggagagacagttccagatggaaggattcgggggcgtgagagcaatgcattctgggggagtcccagggtttctaggatgcaatacggcagccggggcagaaaccagatgggaggctggttgggaatcttccagcttttgaatattgctactaccagaggaggccgctttgaagtcatgcaagcctgttgggacaggatgtctgcagagcctgtgggagggaaggggaagaaattcctggaggaaggcagatgctgagaaggaggggctgcaccttctgaacaggcaccatgccgcaggaagcctcagctgcgggagacaaagcacgcaggccatggcgcaggccttgcatatagcagggcagcctgtgcatccagcttcctctagctggggaccgaggacatcatcactgtgtacctctgcaaacctctctggaggccaggggcttgtaggaggctttgccctctgatgggatggcagctgaagccccagggaacactgctcccaagctttcctgaatctttaggtaagattcaccaagaacagcagtacctgctgctgagacccttcatagggttgctgcaggtgactgagaaagtggatttctctggaggctccaggttgagggagatggtgcccaagacttggtgggaaccaggcagaggtgatgatggacacatgccaggaggaggccaagggaaaggatgaagaagaggccctgggttctaatggcacccacaccacacaagggcctggttagcagccccttttcctcctgttcaaggttttttagaacatctgtatcgtttctacttaccacggacttgcgaatgctaacgcggggcttggggatgggtttggagggtttgttttcaaagctttctggaagtgtggaggagtgtcccccttttcttgcttgtagtgctagctggtaagcgacttcgaatgcctgtcccagggttaggatgatttcataggctaaattctgcaagaaaaatgagaaagcatttgctactggcacactgcaaattagaatgggtcgaatggctgaggaacactgagggaggtgaactagggaggaacttgaactacttcaccagaggcagcagcgattcggtggaaatctacaaagaacaggacactccgggtccaacttagggtttacaccaggctttagtcatttgtgaaaagaaaaatcttgggacctcaaatcactaagacaaacgaaaaagtcagctgggaactgtgttgggcaaacctgccttgcattctattcctaaataagatagctacaaagataaaaaagctacatacctccctcacaatttgcccaaaaggaaatttcctgtggacaaaagacagagctcaaagtcatgcctctgctcatgtgagataaatgcatatcagattgcttcccctgtcctgttgtttccctaagccagactaaggcataagtgactattcctgtaaattgtgtattcagtgaaaggctgatcttcagaaactcaaaataattcaactgtttgtctcttatctacctatggcctggaagcccccttcccatttctagttgtcctgcctttccagaccaaaccaacgtacttcttacacatactgattgatgtctcatgcctccctaaaatgtataaagccaagctgtgccctgaccaccttgggcacatggtctcaggacctcccaaggctgtgtcacgggtgcattttttttcttttttttttttagatggagtctcactcttgtcacccaggctggagtgcagtggcacaatcttggctcactgcaacctccacctcccgggttcaagcgattctcttgcctcagcctcccgagtagctgggactacaggcacgtgccaccacgcccagctgatttttgtatttttagtagagacggggtttcactatgttggccaggctggtctcatattcctgacctcatgatccacccgcctcagcctcccaaagtgctgggattgcaggagtgagccaccacgcctggtccacgggtgcatctttaagcttggcaaaataaattgactgagacttgtctcagatatttttggtttacacactgatagggcactcttgcttacagatccccagttagccccaggaggagcaggccccacagcccagtggccccaggagcccacaccattcaaagctctccctgtgggcagttggtttgtccccaaggccttggaaggtaaggggttactactggtatttctgctgagtcctgggagcacttcaaccttgcctgtgaggatgatcccacacactccacaggaggtgttcctgagaagtttgggtctttttacctcaaacatctgtgattcagtgaacatctacgaaacacaatcaaaatctaatttaggcctagaggagaggcattagtcatgctggtgtggcggctcacagtcgcagcagtgagcacgcaaacagtgctccaacagagccaattccccagctatttcttgaggcttttgctctccctgtgggtccactctatattttatcatgaaatcagcaagagacaggtgattctgtcaggctagatgccacgccaagcagcgcctgggagaaaagttcttttcttccgaccttcaatcagtccttttctcaagatgatttctagctttcttctcttctccaaatgtgtatctttgatttctgccttttcttccaagcacagcttccccttgtcttctctcactgagaaaccatcacattgtctgacccaaaagaggcagggtggccaccacaccctgaggtcacagagcatcagagaagcagatgcatactggtcacagagagtgttctgaaggtcactgtagcagctgagagcaggcatggtctgccccaagctttcttttttcttttttttttgagacagagttttgctctttttgcccaggctggagtgcaatggcacaatctcggctcactgccacctccacctcttgggttcaagtaattctcctgcctcagcctcccaagtagctgagattacaggcatgcaccaccatgcccagctaattttgtatttttagtagagatggggtttctccatgttggtcaggctgagcttgaactccccacatcaggggatccacccacctcggcctccaaagtgctgggattataggtgtaagccaccgtgcctgaccatccaagttttcattctgatgaatgtccctagaatgtccactcacggtttctcaaaaatcacagaaatgtcattctgctgatgctgatattgcaactaagctggccctctctgttcctgcccatctccaccctcatcaagcgctctgggagcccgattcccacactgctgctggggagatgtgtttgcgattgttcgcatttgaagatgatggagaggaagatgcaggatggtgccttctgaggccatgggaaagaggcccaagggttctagaccaaccagattccagatccatgccagatcaattgtgatggtctcagaaccaagtggggaaaatgcctctgagcttgagagtcggtttgagagaggatgtgtctgtctcctttaagtgagttgctaggaaatactgaccctacaagacagacatctgcctgctggagatactgcaccttgcacagcaagctgagcacttccttgcaacgaacactgagcccatgtttgcctccagagatgagtcagcctagtaaattagtaacgcaccagcaaatgatagtggaggaggtctgggagacagctctgaccatcactgcacaaagagggctgagctctttccactgcctacacttggcactcacgtcactgtcagctttgcctcttagtgtttgcgtgggtcccctctgaaaggcaggcagggcttccgacttctgtagtctcacaatgaagacacaggctcttggtcttgttcatgctactgtggaagatggctgattcccatctgttggggacatgtaccagatattcctgttctgggtgggaaactagactaagatgaaggtgtgagattcagtgattctgtaacatgtggtctttatctgctgtaacagtggaacttaatgagtgtgaattcctttaccattaacctaaaaacaagttactgaaagcgagatctacttaaagctccaggatcttcaaaggaaagtaaaaagaccttcatttgagcaagtgaggtttttcacatgattatgggaagcctaaaggttttgggagagaatgtgttagaagtcctgccctttcatttttaattagttcctggtattaggaaactgctcaaataagacacacagaccagactgttggattaagttttcctgcctaatggcttcttctggttccgcttacattttccttgacttcttgctttggttttattttagaatgctttgtcaagtttcttttgtgattatgtatagtacaggattggacactgttacctttcctctcttgtctgcagccctcctgtttgtggtactgatgctggatgccaggagggcccatgggcaccgagacacaccttccaagtgctgtgttgcccatcccgacacaccagggccctttcggggaaacagatgctcatcccatgggacctcaggacacatgtgtgaatggggaaagaacccccatttttttgtaggttcaattctcctgcctctcctattaacatccctaccatctgaaacgggaggagagttgctatcatgtacgaggagactctaccgggatgaggttgaaaattatattgtaacatcagaaggcttaggtgagaagcccatcttgcaaacctcaatgatgctggctggctctgaagagcccatggtgacacccagaaaatctgaaagcccaactgtctctgccttcaacatattatccctgcaactgtggggaggccaacgcctggtactgggtctggcacattccaggtgcagaagaaatgcttgcttgcttgctgaatgaatgaatgaatatccacaggactaactggagtaatcgtaacatttctagttaatactcagtctagctaccattaagggagaacttaataggtgtgagagatgtgccaagcattatctttgtttcatttaagtcttaccaaatcacatgcagtagcatattatcctcattttatagatgaggcagtggaggctcagaggggtgaaataactttccagacatcacagagacagaaagttacagaacttgacatgacccaatatctgtgctcaaaatcccccactcttggcccaacccatgtgtctacccagcttgtctctaagatgactgccatcaactctcccctcccgtgcacaccatggtgttcccctgttgagaagtcgaatctgctctttgaatctggactggttttactgacttgcttgacccataggatatagcagaagcaacatgctgaatttgtgaggttgaatcatgaggagtcttgcagtttcctcctgggcctctaggaacattactctgggggaattagtcatgtaaaaagtctcaccatcctggctggatgcggtgactcacgcctgtaattccagcactttgggaggctgatattgtttagctgtgtccccacccaaatctcatcttgaattctagctcccataattcccacgtgttgtgagagggacctggtgggaggtaattgaatcatgggggtgggtctttcccatgctgttcttgtgatagtgaataagtctcacaagatctgatagttttataaatgggagttcccctgtacatgctctcttgcctactgccacataagatgtgcctttgcttcttctttgtcttctgccataggcctccccagccatgtggaactgtgagtccattaaacctctttcctttataaattacccagtctcgggtatgtctttattagcagtattagaacagactaatatagaggctgaggtgggtggatcacttgaggtcaggagttcaagaccagtctggccattagtgaaaccccatccctactaaaaatacaaaaaaaaaaaaaaaaaaaattagccaggctttgtggcaggcacctgtaatcccagctacttgggaggctgaggcaggagaattgcttgaacctgggaggcagaggttgcagtgaaccgaggttgtgtgactgcactccagcctgggtgacagagcgagactccatctatctttttttttttttttttgagatggagtcttgcccttgttgcccaggctggagtacaatggcgcgatcttggctcactgcaacctgtgcctcctggcttcaagggattctcctgcctcagcctcccgagtggctgggattacaggcgcccaccaccacgcctggctacttttttgtatttttagtaaagacaagatttcaccatgttggccaggctggtcttgaactcctgtcctcaggtgatccatccgcctcggcctcccaaagtgctgggattacaggcatgagccaccgcacccagctgagactcaatcttaaaaaaaaaaggaaaaaaaaaaaagttcttgctatcctgagatcatcatgctatgagaatgcctgagctagccacaaggagaggctgcctggacaggaacaacggtttcagccaggccagcccaggctcaagatttgggagtgaaggggtctcaaagacattggagctccagcagacatcgcttggagaagactcaagacccagacagatggctccagtcgggctgccccagcatctccagccattgcaggcactctggctgaggccccagatgttgttgagcaggactgccacgcccagcccagatccctgacttacagaattgtgaacataataaatggatgttgttttatattttggggtggtttattacgcagcaagagataactggaacaccatgcgatgctgcagaaggctggttggaccctcattcagacaacaggaagatgacccatgagcccaggagctgtgatgaatgctgcttagccaggaggccaatcctggagccacccggtcccctggctgccctggctgtggggaagctcactgatcacagtgagcactaaggtgtcccatcccatctgctggctcaaaccactgtgctgcagtgaagtcagcaaaatcatgctctcatctccagttactacctcccttgggcataaattcaaactcatttagttttacttttattacctcacgtctctcgaatgctgtaacctggcctgtctccgaccttggctcttcctgtctcatataagctcattggaagatacttgctttggtctttctagcataagtcttttgagacacatttattacggcgattggtctggagtattgtctaccttacagagaccaccagtgaaagagagctgcatgtgtgtgcatgtgtgcacgtgtgtgtgtgtgtgtgtgtgcacacggggtgcaggtgtgagggttgattactgaaaacagcatactctgagccttggttttctcatcttaaaatggggataataccatacgcagtaccccctaactggattgttctgataatggctaataatattatttaaccaaatggcaataccggctagcatttattatttactatgtggccatgcaccatgctaagtgcttcaacatgggctctttaattcaatcctaaccgtatctgtatgccgtaggtctattacttccattttgcacatgagataattacgctcagaaaggttaaataacttgctcatgaagtcagcacccagacaaactgggatttgaatccagttgttctttctgagaggctatactcttcttgaccattacaccttaaaactatacataagataaaataaaaaaaattctgtaatctgttttaaaaagtttaaaaaacatgtgagccaattgagcttccaagtgactgacccatcttggctgtggtgaggtcacctactggcccattgcctgggtctcatgcccagtctggctgagaggcagcctccaggccgggggtgtacttcgtgactccacagagaccatcaacacaggaattcttcatctttggcttccccaagggtgaggtaaaagatacgaggcaactcccatcctcagtagtggctatttaggaagaagggtagggagtcccagtccaatggggaaaaacctcctggaaagcacaggaattcccctcttcccttcccttctcttctcttcttccccagggatttttcttttttcttttcttttcttttccttccttttttttttttttttttgagatagggtctcactctcttacctaggctggagtgcagtggtgtgatctcagcttactgccatctccacctcccgggttcaagtgattctcctgcctcagcctcctgagtggctgggattataggcgtgcacgcctggctaatttttttttttttttttatggcagagatggggtttcactgtgttggccaggctggtctcgagctcctggcctcaagtgatcctcctgcctgggcctcccaaagtgctagaattataggcatgaaccactgtgcccggcctgggattttgatctgcgaattaagaactgctacattagaggagcttaaggaaccactgtatcataaagataaatcctaaggcaatcaagggatgcaaactcacttttcttgtgcaagctgaagatatgcaggtcagcttatatttactgtggtttcttcaaggcaatcatggatattgaacatcaccacagatatttaccaagctccttccaagtgttaagggctgtgtccctggtgccagtcccatgcctagcctatagacaatgtccaggaagtgatcactgaatgacatgggggagtaaaagtgtccatcaagactctcattacatccagaggaggctcatggagagacaaagagatcttcctcgctgtcctcccgcatccttgtccccgaggctatacgcagcatattcatcggtctagtatgagaaaaattgcatcatagatggtgggcaatctgtcccctagaaaaagctctagccaccaaggtaattaatttattttaactggtacatcactaagatttttgtttcttagtttgaaaatctcttaggcacaagggttcactgatacatgtgcaaaaatattcattaaagtgtttaaatttttcattattagaggactgattaagtagaatactaggtagccatttaacatgaaaactggaggcgggtggattgcctgagctcaggagttcaagaccaccccgggcaacatggtgaaacgctgtctctactaaaatacaaaaaattagctgggcgtggtggtgcacatctgtaatcccagctactcggggggctgaggcaggagactcgcttgagcccaggaggtgaagattgcaatgagccgaggtcgcaccactgcattccagcctgggtgacagagtgagactccgtctaaaaataaataaataaaataaataaatcaataatgggttaaaagactacgtaaaaatatatgtatacatatacacatagataggatctgtatatatgcatagaaaatagcaatatggatcaaatgtgaatagtagttatcactgcgtattgagactggatgatttctatttttgtattttggaactttatttaaatgaggattaatgatgtttacagtcataaaataatctttccattttgataattaaaaacaagagaaagtcttttgcgtttaaaatagtcttattcttgctttttttttttgagacagggtcttgctctgttgtccaggctggagtgcagtggcacagtcatggctcacagaaagcttgacctcccaggctcacatgatcctctcacctcagcctctggagtagctgggaccacaggtaatgtgtcatcacacctggctgatttttgtatgttttttagagacagggtttcaacatgttgcccaggatggatcttattctttctgcatcaccttggggttctgagggtctcttcattctctggctgagagggctgggaactactttccagcaaaatctggaacctctctgcaggtgctgtcatggctcacctctatgtgccaggaagctgcccattcatttggcaaagaatcttgtttaggctcttcagttttcatactggatgccaattctaacatcttctcagtgagactttgaagtatcaagctcttcctttaagctgcaaccctaatacttctactccaagtgcggaattgaccctttaatggtccaacttctgccaagcccaagtgaaaaatgttgttacgtggatattaacttatagacatgcagtcaatccgctcttgtagctgtgcaaagtttgatctctgcacgaagtcaaactgcctatgaacttgaactgtattttatttcctttcataatgatgataaagcagtggcagcagcaactacacatgatattgcctactacatcctagggacgaggctaagtgccttctgtggattgtctaccccttacaacaccttacagaggaggaatgaccatcctcattttacgtgtgagaaactaaggatcagcgaaattgacaacttggccaagttcatacagcagagccaggattcaagtgcagatctgacttcagattagccagtgtttcatgccactgggctatcctaccttcattgctctcatgaatgtgctggtcttctgtgcctatttcattgaggcaccctctagaacaccatcttgtgttttggagattcactgtacaaatgttggtgaagacattattacacagtatcccctcatgggggcctaggacagaaagttccttcatacttaagtcttattaaaatactattttcggaagggaaggggtatacttttctttcaaagaaatatgcagcataaaattactgcatttccctttttgccttgacctccaggaagctcagagctaaaagctcagagctagagagagcccagctcccatacctttccacaactccatggtctgtatattgatgctacaacttttcccttgatatggagcttccttttagcctatattttccctaattcagatttgtgtgtatgtatatatatattttcagactactatacctattcatgtaggctgtcttcaatccgttatggaatgaggcatggtagaaacactgtccatttgttcacttagatatttattccaggacttactttgttgaatgcattgctgcccaaatggctgacaaggtatgtcaggcataaagcttcatctcatctggcgaatatgacgaaggagtaaggaatctgaggaggaggccatccagggaggaaaggccctcctgacccaggctgggaggctgctctttctgagtggaccattttgacctgccttgcagtgctttgcattaccattagaaacacaatggccacattttcatgactggaatggaatgaacaaatgtattcattccatagcatcagagagctgcaggcccagacaggggtcagcagaagctcacccacaccatgaagagggcacagatgcagacacgttcaagggaagggctgtgtctgtatgtgggagtccagggcagaaaagcttgggtgtcataaagtaccttgagatgtctgattgaaaagtgtctatcagtgaatagaggccataaacagagtccctggatcacctgcataggccagctccaccatgggctacctacctacagcacctattgccactgagaagtgggtgtggtccaggtgacctattggtccctttccaccctgggagtttcaggattctctgattagaaggggctatcttttacccagtcaactacagattcagtttagagatgcacgcacagttgatgctgtgctaaacagtggcatgttacccagaggccagactgcagggctccataacccaccagctagagctcagagaggcagtcaccaccaacgggctgcccttcatctcagaaaacaccttcattccagcaatcacccctaaatgctattccaaatggccaagcatttcatctattacaaaatggatttgttcttggcaatacatgcgtttgccatctcccacctttgcctggtgagttactgcttatccttgaagactcacctcgggcatcatatctccagaagccttctttgaatctcctttcctgtcctcccaaccctggctaagttaggtgcccctcctctgcggtgccacaataccttgggcacagccctacttaccacgtggtatttattatgattttctccttatagggctgattcccccagttgactgagctccttgagggctctggtctcactgggctttgcatctctagggcttagaataggtcaggtgctcaagaaatgtttgttggctaaacacaaaaaggaagttgcctggtaggtccctaagataagggaacttgcaccttaaggttaagaaaagggggaatatggatggccagagccaattccttccttctgtcttctctcccacaggcagacctgaagaacaaaagctagacaagtgcagataatgccacagggggcctgaagacacaagaaggtttttttcaatctgggttctcagtggggtctccagaaagaagcgacatttctttttaggctatattttgcttgtacttgtttttttaagacctggggtaagcctggtctacaacttgcttcacccacgtccggaggcaaaaataacttcgagaatattctgggcatattcacagacttcattgacatctctttagctctacctatagttagttctctcaagtaccagccagaaattagtcttcatagattgtacagaaataaatagtgcccaatcatagccttcagcatttagaaacaaatattagcaattctgctaagatgtctatctggggcaagatgacaaatcaactggccaaaatgcaggtagcttctttagggctaattttggctaactaaaagagccacgagattcctttatctccctaattataacaggggcagatgtagaaaattttgaaaatactaagaataaaggaaaaaataaaattcagctgtgaaattccactgttgggatatggctactgctaacatcttggtgcattttctttttatatttgtatatacacccaaatactttcatttcctatatgaatatttaaatatgaatttaaaaactagaatactttatgagtctaaaatcataacatattttatgtgcagtctcataagttccttttttgcgcaacattatctcatagttggtcttcgcatgccattacacgttcttcaaaaaccagatttttaaagggggtgagcgttccactgtatctgctgaggtttaactttatgcctcaccccaagtataggaggttgggccttactttgttaaaccacaacttgctttcttatattaatagcattccaggttccctgtggatgtcatgcactgcagcccaacacactggtcacctgtcttcatggaaccacagcctaaggtggctggccagcagccctgtcacacccatccagagggactggcctgcctgggaggaagaaacatgcaatctttatcctgtaacttggccagggtttgtgcaaaggtggtacaggaggaagaaatgccagatttcaacctctcccctgctcctcaaaagaaaaagctccagtggaagctgtagggaactcttcactaactttttgtttttttcaagacagggtctcactgtgttacccaggctggagtgcagtggcacgatctcagctcactgcaaccttcgcctcctgggttcaagcaattctccagcctcagtctcctgagtagctgggattacaggtgcctgccaccgtgcctggctaattttttgcatttttagtagagatagggtttcaccatgttggccaggctggtcacaaactcccaacctcaagtgatccgcccgcctcagcctcctaaagtgctgggattacaggcgtgagccaccgcgcctggcttcttcactaacttgtgaggcattggacatgggtcactcaccagattcaaaccttttaaatttgaacccttgttgtttaaatctttctcaaatggatatgcctgtttccttggtttagtcagcacagcaaatataaatggcttttcctttacttattgcagatgcctacctgataccctgagttcactattctaaattgaattaatgagttgccgtgcctccaaaccgaccacgtgttcactcacacagactaagtgttcagcttccaacctgcgcgtccctcctcttggagagcccaccctgctggctgctggtgcagtgcccgggtggcatggatctgattctgttgtaactatttgcttgtgtcccttcatctcctgctggaccatgagctcctggagagcagggatgtgtgtctaatgcatggcaggcactctatcaatacaggaatgcattttatgtggaatctgacttttttcctcagatgtggaagcacgcagcaacaaacatatgtcgtgaatcaaaaaccgggacataaagcctcacacagggtctgacaagaatataagcatcactattaactgcttctgctattctctgtgtcctcggcagctaagagttattgaataccatgtgctggaaatgcgtatgtgtcaccttgtttaatccttgcaatcaccataggaggtgtcctattataatctctattttacagattaggaaactgaagactagaggcattcttttttattttttgagtcagagtcttgctcagtcacccaggctggagtgcagtggcaccatcttggctcactgcaacctctgcctcctggttcaagtgattctcatgcctcagcctcccaagtagctgggattacaggtgtgtaccaccacgcctggctaatttttgtatttttagtagagatggggtttcaccatgctggtctggccagtcttgaactcctgagctcaggagatccacctgcctcagcatcccaaagtgctgagattacaggtgtaagccactgcacctggcctttatttttctgagacagagtctcatcctgtcacccaggctagagtgcagtggtgcgatctctgctcactgtactcactgtaacctccgcctcccaggttcgagtgattctcctgtctcagccttaggttcaagcagttctcctgcctcagcctcccaagtagctgggattacaggtgtgcaccaccatgccaggctaatttttgtatctttagtagagacagggttttaccatgttggccaggctagtctgggactcttgaccttaggtgatccgcctgccttggtttcccaaatgctgggattacaggcatgagccatcgtgcctggcccatggcattctcgcccaaactatgaagctaagagtgcagatctgggattcaaaaccagactgattctaaaggccaccccctgatcatgacacttgactgccagttatttagaagtggggggtgcaacaaatacatgcataaatgctgcaaagcaatctgtgaaaacaatttcagaatgtctggtttctaacttcacaaaaaatgggattaatttaaggcactgaaaactttgtctccccacccccaaaatagggatgagaagatctctgaatatccaaccacctttgtctttgtggcctggttagttctcagtgatttatgccaatggagaggagatctggataaatgaaacccagcactgttaatttatctattcttttttgggaggtggtggtgttagtgtagaaggaccattggaatgcgatgctgtcttttttattccatcagggccatttgctcctcttaggagctgcgtccttcctgcagctgacttgctggtgagtttcagctggctggacagggccagggaacggcttctcttttacctgtaggttgccactttgtatgcagaagagtaaccagggaaagtgttcgagttcaatttttaagggctctatgcattgtgacattttcttatattgccatttcttttcacagtatcacagtcaaataggttgaagtctattttcaggtggagaaaatgagaaacagaatgagagagatcacccgcctccatgatattaattcaattgtcagaggtgaactaacatcaataatagcaagagttcttttgcatctttaagttctcactttgtgggacaatctctgcaacataagccataaatatttttcttcagggacctcaaactactccatggaagtaatctcggcatttaaaaaagcactcaagaatttaaatttttctttcctttttttttgagacagagtcttgttctgttgcctaggctggagtgcagtggtgcaatcacagctcagtgtctcctaggcccaagagatcctcccacctcagcctcccgagtagctggcactacatgtgtgtgccaccatgcctggctattatttattaatttttttttttttttttgcagacatggggttgccctatgttgcccaggctggtcttgaactcctggagtcaagtgatcctcctgcctcagcctcccaaagtgctggggattacaggcatgagctactgtgcccagccaggaatttaaattttattaaactgatgagaaaaccaacaagcaaactcatagcagagccaaagttggaagtggtgtaggtatcactgatcacgaccacgtggttgatgctagtgtttttcttgccccacactttggctggctttgtgcatatggatgggagagtactacagaaggtgatcacacagtcggatgaccatgttttcctgcgttttgtcacttctgtttctccagcttagatcctcacatggcccacattcagccaagaaagcacagggaagagggagctccgtctcccacacgtcccacccaccctgcaccacgtcttcaacattctctacgcactcctgagaccgtctcagcctcgccatgtgctgcacaccgaggagcacaggatttgggagttgcaagtgaaaaatgagcatggttaaaaatatcaaagactgcaaacatattcttttcagaggagtgagaattagcaagggtctggcagcaaagccatggcttttaatgctattaaaaaggaagaacaccttttaacatttaaaactattgaatgaggctcttctcagatatttgatacaaatctgatactcccatggagaatgcatcaaaatctttctatgttgacttacatcaactctctattactgagaaatctagagtaactaagcaaataaaatacagaagacaacagttttgaaattaccttggttgtctctctctctcacctatagtggccttttgaggacgatcacttcagcctcgggatctggtggccactgaaatacccattccctctctggcagtcccatttgtgtagaattctctccactcatttaagagcagaggagagaaaagctgagtccatttttaactctcacaactcctagtctcataacacatccttcttttctgctcaccctacagttccctcttccccaagttctcactgcccagaaggtggagtttggggaagcttttgttctacagtgggtgagatgtgtttcaggcctagcaagttagggatatgattagaaatcagctatgacaacaacgagagcatagactccagaatacagagcaggcttggtgcttgcttgtgtgtatatattggcttttttcttgacaaccctaattctgttttgctctagtctttttattttcatctccccatcatttaaaactgaaaatatcacaagctgaatttatggtagattccaagcaacaaaagcaggcttagagatcatcaaatgtaacattttccaaaatgtgttctgcagaaggccacccctgtggggtgctctctaaaaaaaaaaaaaaaaaaaaaaaaaaggccgggcacggtggctcatgcctgtaatcccagcactttgggaggccgaggcgggcggatcacaaggtcgggagatcgggaccatcttggctaacatggtgaaacccggtctctactaaaaatacaaaaaattagccgggcgtgctggcgggtgcctgtagtcccagctgctcaggaggctgaggcaggagaatggcgtgaacccgggaggcggagcttgcagtgagcagagatcgtgccactgcactccagcttgggcgacagagcgagactccatctcaaaaaaaaaaaaaaaaaaatggctaccatggccaaataagcttaagaagccccgcacactccacccccgcctcacatctgagcacattcagggccctgcagagtcccatagtacgtaaactatgttaagctcacatcctagcttctgtagggggggctccaggcctcctttctcggactacaatttctatgagaaaatgctctgaacttcaaatctaactgtccataaactggaaacttcctagacatcactgaattttcttgatgatatcagataaaaacatgggatatgtgataacagtacataaaaacatgtgacccataaaaggtctttaaggtccaaaaagcagtaacttcacaattaaaaatgtatacatacttatttagctaaaaggttaaatgtgtatttgaggtattatagggtcttctttactttttttttttttttttttttttttttttgccatttggggcagcccaggggactgattcatatcaaaagaattttaagccttcaagactggactggtattgaactgccctacataaggatacaaaatccatgctcaaagaagctttttttagtgcaagtgaagcttgttgcatctcagaattgctcaaagtcccaggtcaagggtggtggcctttgttactaattttgaggtttgacaaactgttcacctggagaagattaaaatggaggatctgtgtaagatgaaagtcctttggagctggtatgagaatcctaagctagtaatgtttacattaaatcaaacatctggatgaaaagataaatgttaaggcaattctctacatgtttttctaagtgtatcagggatataacgttcatcataaaactaaacagttgactatttcttcccccaacatttcacctcagtattctggtgatatatatatatcacacacacgtatagctaataaactcaagggggcagatagtccacagaaaccagttttagtttcatgtggaaaaatactttagatactctgatgaaggcaaattatatattaccttaaaaaccaattttattgaaagaaatgctgcaatacttaggaaaaaggtggcgttcatcctgaaaagtatcagaatattcatgttgatgttcaatgcaaacacggtctagaggcagcaagctctgtggagtcaatgttttctttctgctatttctattttaatgtttatttattgctttcactttttcaatcctttcgtaatggcagtaggaaaactttggaagataaatacacatctgacaaacctatcttatgtcttttagcagaaaaagggtcaggctgttaactgacgtcagcaggcagggagagggaggaggtgaaggaacaaatgctgaacacctgttatttatgaagcactctacatatgttctttcatttcactcctggtgaaaacctgcaaggtagaaactcttgtctctgttctctagctatgaaaattaggactgggaaaagtccagcaacttctctaagaccagagagtagagagatagctgatttgggatgtgaactttggtattccgttctttctatgacatcaatccaacccctatagagaaaggtatttcacataaaccaaaatagatgtgaacaggatgaaatttgactgtataaagaaacaatcaaattttacaagaattgcaagttatgtttaaggcaccagaaacctaacactgcacatccttgtaaaccctgaatgaaatggctttaatcaacactttaatcccgtgcaaacaaacgcttcctgagatatttagagcagtctcgcagggctttgctttgcagtctttactgttaccacagactacttttatatcactctcctcaagcctccccaaatggaagggtttgtttttttttttaaaggcccatgatcattctttcccattttcaatctttctttaaaaaccaaaaggggtgaggaacatgtagcatgatacaaatgctctgagcatgaactgcctgactcacggaccttaagctggtatagattttggattacagttggccttggcctataggtgttcatcagaactggaaaacattgcttcaggcagtcttctacccatgacattgaactgggggctggcctctcacgaatatatgaatacgtgattcctgattctttaaatatgtatatttcaaacccagtgagcagagcagaatcatcaaacttaagtggcattttcaaattcttctgattataaattattaatatactatatcagagatatcctcaagcaatttgtaccaccttgagggcatatcaatcttaaagaaacatttgttatttcctttaattgtttccattttccaagtttgtaatatatgagctagtcttttaggtttaatgacaagtatggctataaatggaagtggtgtaatcccataaggatgtcattacaagaccaactttttttttgagtgacggtttcactctgtagtccaggctggaatgcagtggcacgatcatagctcagtgaagcctcagtgtcctgggctcaagggattctctcatcagcctcctgagcaactgggactacaggtgtacaccaccatgtctggctaatttttttttttttttttaatagggacaaagtctcactatgttgcacaggctggtcttgaactcctgaactcaagtggtcctctcaacttggcatcccaaagtactgggattataggtatgagctgtgcctggccaagagtaactttttttaaaaattgagacagggtctcactctgtcacctgggctagatggcagtggtgtgatcacagcttactgcagcctcgacctcccaggctcaggtaatcctcccacctcaccctctcaggtagctgggactacaggcatgtgctatcacacccagctaatttttgtttgtttgtttttgtagagatggggtttcatcatgtttctcaggctcatcttcaactcctgagctcaagtgatctgcccacctcggcctccaaaagtgctgggatttcaggtgtgagccactgagcccagccaagactaatttctgaatgagcatatgggccaaatcttggagttcccaattaccacctgtaggtatctgatctgactcctattcaatatagaagactgcagatttgtatgaggcaaacacacctattatgccctagtacttagaaatggctactagagaaactgacagacatagtgagggacaaggaggctgtaagacctttactatgttttggtgccagagaaacaaagggatttctcaagtctgaaagtgaaattagtaaatgagtaatggcagttgagatactaggtagggctggcattctaagttgaatggaagaatgaaaatatcgaaaaatctccaaacagcctagtctgccaaaatgtacttggtgttatgagtggaactgtgacccacccaaaattcatatgttgaaggcttaacatgcagtaccttaaaatgtggctgtatttgaagatagtgccctgaaagtggtgattcagttaaaatgaggtcattggggtgggccctgatgcaatctgactggtgtccttacaagaagaggaaatttggacccagacatctaagcacagaggaaaggcgatgtgaggacacagcaagtacgcagctgtattagtcagttctcacgctgctaataaagacgtacccaagactaggtaatttataaaggaaaggggtttaattggctcacagttccacatggctggggaggcctcacaatcatagcaaaaggtgaatgaagagcaaagccatgtcttacatggcggcaggcaagagagagcttgtgcaggggaactcccatttataaaaccatcagatcttgcgacacttactcactatcatgagaatagcacaggaaagacccacccccacgattcaattacctcccactgggttcctcccatgacacatgggaattatgggagctacaattcaaggtgagatttgggtagggacacagccaaaccatatcagccgccatctacaaggcagggagagaggcctcagaagaaaccaaacctgccgacacattggtcttacacttctggcccccagaagctgtgagaaaatgaatttctgccatttaagcctctcggtctgtggtactttgttatggcagccctagcaaacaaatacacttggtatgtatcttaataccgggtaaacaagccaagctagtgtgttaattataagttgggctttcaatacagtccaggcccattctgcaaagtctttaatctgttgaaagggggtgggtactcaccacatcaaaggcagtaaacacatgacagtagtggtgattagacttcaaatcttttgtgatataggcaaatgttgagaggtcttctgggtcctgggcagcacaggagatattacgaatttcatgctcagcaattatgttctggaagaaatgacataaatgatcattgttttcctctgcgaaccagcatatatgacaaccaagacaagtaacccaggaagcagttgctttccttctttctggagtgttctagactagcaacactcaaagtggtccactatattatttgtgggtaaatgaataccagatatggaagaaatattttcatttaattaaaaacaacctaacacagtcatatcctggagctgcagttctcaccagttgctgtgcatagaagcagtctgggtggcggccactttttttttgtttgtttgagacaagagtctcactctgttgctcaggctgaagtgcagtggtgcaatctcggctcactgcagcctcccgctcccaggttcaagcaattctcctgcctcagcctcccgaatagctgggactacaggtgcatgccaccaggcctggctaatttttgtatttttagtagagacggggtttacaccatgttggccaggctggtcttgaactcctgacctcaggtgatctgcccacctcggcctcccaaagtgctgggattacaggcgtgagtcaccgcgtccggcctccactttaaaaaataatagtaattactaagcatttgactgtttccattccccatgtccacctgtagctgtgcagcactgctttctgctaattctgtatggaggggagcatctgtcgctttctctgtatgagaagagatctgacccaatgaggctcttcaaatccctcgccatcatgcttgcacgttgttcttgtgtcctgctcctcctccctcagagcaagggcaggtactgaaggaagcaggcaggtggaagcctcaaggtgctttctccgtggaaactaaggtgcaggggcctgataagagaaacaccatactgcaagattcaggccttggatgccttgcttgatctgggccctgtggctatattaacaacactttcctaactacatccactgtgtataattaggaggtggtgctgttgctaccattatttacaggtgaagcaactggtactcaaagaatttaagtgccttatgcagagcaggtgctggggtggaactgaaatttggggttgtctgactgtggagctcaggctctttgaaatgcattgcaatgcccttcaacgtctccacctccctcttactggcttaacaagaattgagttatttcttctctagcatctctttgtgccttcttccctggtgggagaaaggtttaagtaccattgtcctgaagcacaaaataaccacgaagcagcttggctgcaaaccctgctagaaacttcttttgatacatagatgtgtttaaaaagaaaaaaagaaaaaaattcacataatcttgcaatcattttcttatcttataatatcccatttatgtttttttgcagttgtcacagatctaaaaccctcgatgctttagttactctaattactttttaattgcgctgtcttaaataacctgttggcaatacagtgttccgtgtacagccatcaatgcctaaaaatgcttacaaaatgtccttccctgccagcacccccagcaagtacttcatgtccctcactttaccaagctgagtggttcggaggcaattacagaattaactcacaaaagaaaattaaattaagacatttttcaccgtggccttttgtgttgacattaatgcagtgctctgtcaaaaaataactcaaattgcaattggaatcccataaacaagtaacattctattgcaagataagtttcagactagaaggtgatgatcctcttctggcatccagatagcattccttcaagtagaaaaccaaattagggatgggtgagtcttaaaataatgttaaaatgagaaaaaggtgcaatgtgagatggtgtgggaacctctgccattatcttgattgggggcagccaatgccctgggaagcctgggtggatttggtctcacttgtccaggaggcactgtcacaggaaataggtgcttcaacttttactaagttggcattttgtgttcttgagatcttttgcaagatctcaaggtagatgcacttcttgggaaatgaaaagtgctctgtgatttttattgcactgaactctctgaatcttgccaactcatgggatgccactcttgacaatttccaatggtgcacggcagcactgtggcctgggggaaagttgcaaaggaggaaaagtatatctttggtactctctcctcctgtgtctttgctgacccctgaattttctggagccctcttcttctctttctctctctctctcttttttttgagatagggtcttgctctgttgcccaggctggagtgcagtggcaccatctcagctcactgcaacttctcaggctcaagcaatcctcccacctcagcctcctgagtagctgggactacaggcatgcaccaccagcctggcttattttctgtattttttttttttggtagagaaggggctttgccatgtttcccaggttggtctccaactcttgggctcaagcaatccacttgcttcagcctcccagagtgctgggattacaggtgtgagccactgtgcctggcccagccctcctgttctctattccccaggagcccaggactgtcttttagctgcccagggaggcctgacctctgtgatactccatgttccaaaatcagccttctccccgactgtggaaacttctactactctgttcccattgtctaagctataaggaaagctcatgctagttaaaatattctatattcaggtaggaataactcatcattgtggtcatcctaactggcgcttaaaagatgctcttgaatttgtattgatagcctgcggaggcaggtatttttgaacagacctttgtgatatattgccaatgctagaatggggtaaggtcctgggatgtcactactgaaatactgccatcactctgcattgtctacctgtgcagaatggtgaagccagttctctatgtgcaggacgaatcaaaggtcaaggatactacagttgtagactgtatggagactagatggtagacttcctccttggagaagaagccaaagaggaacacattctttccaccttgtgtcatgcatttatgagtggcttttccacaaattaaaaagtgatgtcatgaagaggtacaggtgatgcacctcagttgaaaactggactcctcacatgttgatcagtctccatttctaagcacattttaagaaggccagagctttaaaaggctcaagagaagaactggggaggggctcctcctgcctcttcttggggatagaaattctggcagcatagcacccttcaatagggagagatggttttgcctgtctgttgtttgccatcatggtgagaaacagctgaagaggtgtcttgctggtaggggtaggacaggattctcgggtccagctaactcatatggtggttctgagaagggcgcgtggtgatgaagtgatgcagcttagaaatctgcctctcgccactgcattcaatctgagccccgacaggtgggacctttctcttgcatctcctcatcagccgggcttttcctgagtgaggagactgcagtgttccctccagggcggggccaacagtatagacctagagctaactggtgatgccctgtggggcacgtgatgctgagaacagcacatgtgcttaacatggccttaatttgtctccaagcttcttaggagtatttgctataaaaaaaaacaatgggaggcccactgcagtgactcatgtctgtaattccagtgctttgggaagctgaggcagaaatattgcttgaagcaaggagtttaagaccagcctaggcaatatagcgagatcccatcactccaaaaaaacttaaataattagccaggcttggtggtgcatacctgtagtctcagctgctctggaggctgaggttgggggatcacttgagcccaggagtttgaggttacagtgagccgtggtggcgccactacactccagcctgggcaacagagtgagaccctgtctcttaaaaacaaaacaaaacaaaaaaacccccaaacaacaggcacttgtttaggcaaatgttccaaagtattttgtgcccctaaaatagcataggccttgtttaaaattggcattccaaaaaaatttttaaaaactcaaaaaacaaaacaacaatgaaagcaaaaaacaaaccctggcactgcatcatttttaatttagccagatgggaaggctgaggagggagtcagcacaggaaggcaaaatgcaacctgctcctcagctgagcactgaatgtagaaaccgtgtctcctctcggaagacctccctccccgactcccccaacctgaagaagggtccgttactaaacagttgcagtcccccaggccgaattccctgctagagcaacctttgggctattgatcaacagaaggctgaggtgatttatctaaaacactttagtgctaaatctattgcaagttccacttttaattcaagatcgctttctgcttcctccttcttaaatcaggattagtgattcaattcatttcctaagttgctaggcaatacatttatgagtttataactaggcctctaaccctttcccatgaattcagccaaacccatttatttattataatcaaaggaaagaaatgcttcacggagggttaatctttcacaaagtctaatgggggctaataggaagggaagagtaattaacacacaatgaattatcacacaatgaattagtttgcacttcaaactaatttgtggaaggtagctgtggagtaacagaaaaagcattaggttagggaggttgaaaatcaagttttagtcgttcttcacgaccaacaggctgtgtgactgcagggcagcactgagccaagggactgaggccttcaggtctccagctgcccagggcagattaaacaatcacctctctgaccaaggcaggggtacgagatgcaaggttaggagagtactgttgaagaataaagtacgatgaaaacataaaatatgaacagtaggctgggcgtggtggctcatgcctgtaatcccagcactttgggaggctgaggcggatgattacctgaggtcaggagttcgagaccagcctggccaacatggcgaaatcccatctctactaaaaatacaaaaattagccgggcatggtggcacacacctgtaatcccagctactcgggaggctgaggcatgagaatcgcttgaattccaggcctagtggcctctagtacctgaaatggtgagatctttaaatatgcttgcatattaaaagttctttgcttcaaatcaaagtggcccactgacacagcactgcccagtgggggaaatccctggtgaaaacagaaagcaggactctggagtttatcaatctgctccttttctgctgtgctctttgctctagaacaaagtagcatacacaggtgtcctcgcacacactgctagaatctaggtatctgggcatggttcctttcacaccacaacttgaggatgatccttcaactgtggatcctccgtcccttctgaagccagtcctcccaccctggctgatggtagtatttctcagtcttacccagtcaaactccaccaatacggccttccactattttctttcttctaacctgctaaacacaatctctctacttgggctccctacacagcaactactagactattgccctgagtcacccacactctccctacccactgtcatactgggggagatcagctaccttgcaggtcactgggatgtggaccctgtatagccagttgaaattaacatccttcagttccttaaaaagccaggcacatgttgtcatacattcacagactggctccacttgccaccaacataggcactttgcctttgctctagattctgaaaatatgttgaggaccacactgcaaagacttgaaaaaatatgctgaccttctttatttagcatctttatttacatagaattatcttttgcatatctttctgtgcttttgcttccaagagtagtcatcagtgagcagaggtttatggttaactcatctaattattggcaattgaagtagaagtatctccttgaggcacaggagcatcaacttctgtgtctcttgccgtgtcagtaagcaacatacaatggaaccggcagagctctctttcattcctctgattgtggagagtgggttagagaaaatgctattaatacagctgcatccagccatacccccaaaatcatgaaatgattgccttaggactgtaggaacttctcagggcaaataccacttgtttagaaattgtcagaatccaagtctgctaaagttgttcatctaagagagtgtcaaattcatccactgaaaatatactgctattcaagctttccaagcataaatgggatagagggagttgtttcaatttagggaaaaaaaaatccaggtgccaaagtctttcttaagatttagatacagcaatagcaatggtatctttgccattctataatgtgttccataaagtgttagaacttttaaaaccaactgactataatttaaggataaagtaattttatataccaggaactaaagatgcttccaagaaataaaaaagcaaatcaatcagcattgttcttatttgagtctccacaattattatctgtcaacaaccatcaacaatattttgcacagttggaatcaccattatgctgatattattggtcagcatgatgctgggttatatgctttttgcctgggtttcagaactttttctataaccgggaggttgttttcccaagcagatttggggaacttgggtttacctaactactgaaacaacaatctctttcgtcacagaaaaccaattggaaaaacttccgattcagatgctggggtttaatagagacaccaaagagtcactgcccgtgagacttttccctggaacctaaatccagttgccttggccctaagttgctgtttcttaagttcacctgtttcatgacttctgttccctttctccaaaacggagggggtccaggtgggaggtctgggtgagaggtccagagaaagaccagcattcaccaatggtgatcacctcttttaccctccttctgtacttgattagttgaaaggatgcaggaataaaacacatgaacgtttggggttttgtgaggaggagtcagtcagctttgagtttatggagagggacaatggtcacacccaagctttctacttcagcaccacgatgctgttgtctttgtcaagaaaggaatgctttttcagtaaaatgcaaccccactgaccacgcttgacatcacagcccacaaactattcccactgtgaggaagaagtcacagcggagccacagcatggcctgggctcttttctgattgtgtctcttaagaaaacagtacagctgaaactctctcccatctcagaggctgggaattaaatgtagttataaaattaaaaagtcagaaaattatcaacagaaaagacacatatatatctctagataaacagaaagacaaatgttctagccctttatctagtaacatctcctctgatggaggagtgatgacattgttgacttttcaatctacaagtgatttttgttttctgtttcaatgttctccagatccaaagggacatgctggataataagtggccacagtctattagagaaagcatcatgacaaagtgaaagcacaatatttatagaaaccccagatcaagcccttcccccaaatggttcctttctgtatgtatgaaggtgtgtatgtgtgtgtgtacatgagcgtgtatctataggtatatgtaggaagcatgaaggttgggggaaagggatgattacagtggggagtgctgggtattataggaagcaaaggattttagatcatacactcaggactgcatctggtgtctaaaccagagagaggagtggtacttaccttatttgttgcatcaataaatttgactcctttatatgagacagaaagaataatagtagggaccttcttcatttgctctgtagacttctgaaattaaaattagaaagctgttagagcagtttgtgttgcgtggcaactgaagcacacaatttttcctcctgaaagataaagatgagctcaaattaaaaacaacaacaacacacacacacacacacacacacacacatcagatacacaccacgcacactctaattttaatgtctgcctctcctctcttgggcttagctatacttcgggcttataaagttatccgtcttgcccttgaggatctaaaaagagtttgttccgctactttgtgtggatgaaggagtacttcttttccctgacactaaagggtgaatgaagaggtctgtctcctactgcaatttcaagtgactgttcctttcacaagagttaaaccacatcggacttaactccaagggtgcatttgacattaacaaaatatatgcacccccccttttcctagttaccttcattcttccaggcacagataatgcttggatgtatacttaaaatagggatgtaaaagatatcactatgtattgttcttgaactggaccaaatccataaatgctgatattatatttacagcagaatcacttgtgaccacaagggatgtaatgatgctctagaacaatgaagccctccaggagcagtctgggttttgagccacagcaaaatgctggacagcccaggtaacctactttatcatttagagctgctacattcccttaggccaagttcttgtgatagatgttcacactggctgaatgtgcttagagtttgcagcttgtacagttttatgcatctgcaaaaagtttctctataatttagtatgtgcctttcctgtttagctttatcattcatcaccagtcaccagcagtcagtttacttcattgccctctatatatactagtaataatcacactaaacatcaagaagaacctacctgacagttagcctggtggattttccagttaagacagatgggaacataataggagagaaaacatataaaaggtgagagagaggaaaccatttcaataattcaccaacagtgtaaattcattaaaaaacaaaagatgccacaaaagaacaggcttcagagtcatcaaagatgcagtgccactgttattttagaaatgctgcaggctttcaccggcccctttctttctctgtttctcatcattctgtttactgcaccgcacagtcttaggactgacacacaagaaccttccactttgagctttcaacaactagttgtcttatgtctattaagggaatcaggaaaaaatagaaactttcttgatttattcatttatatttcccaattttctagttttaaattctggaatgcagccagaattcaggaaggcttttaattggatagtgtgagtgaaactcattgaactcaatgatgagacttcaattgcatcttttagttgagctgtgaaaaggggtgtttcacattttcctgattgttttggcacaacatctttttgagagttactacgcctgtttcaaaaacaatggcttactaaaagtattgttatttaatatctgttgttgtatacaggatgtgaaaaagcagctctcttgctttttaaccagttttgaaattccctggatgcatcagtgttcctttgtgattgccaaaaagagagattatgaaaataaaatataaggttagaaactcgttttaatgcttcttccaaccacttcttaaaaatgtgcaagacacatcaaaggcaggctagaagaaatcatgtgcaatgtgttgattttaaggcaacgcggtggctgaactctgtaaagagggagggctggggcagcccaggcgatagttggaataactgaatgcatatgtgaaaaattttctgcaaagcgtcacagtggatttcggtaaatcacctcacttatcttttgccatgaatccattctcctggacagatctatctgtaatgcaaagcaatatacagctaatattcagatgaaaatctattcgttatttgttcagcaatcgagttgttactttaggcaacccactgtgcttgtcactggaaaagctcgagtctagttcagggatggcagacagacctcaaactgtgtgcaaacaccagtctgctgaaagcactgtgttgagaaagattctgagctgtgtctgagctcagtagaaaagagggctggaaatgatgtctgccatgggagaagaagaggacgaggcggcccaggggctacacatgaacatgcctgctaggtctgataggaagaacagctacaattacaatgttgacaaatgtgacaggagcaatatgaacaacatgcctccaggatagtgaataaaaacagccttattttgcttgacagagtggggccagtcttcattcattcattcaaaagacaatgacggcctattaggggtgattgagctgactcttgatgaataagcattttccaagtagcaaagaggccaaaagaggctgttttagcaacagaactaatacatgcacagaggcctagaaatgagaatgtggtgggtttgggtaactggtggagatgagagtggtagagtaggtttggaaggttgtgacttactctgccaagttagggtccgttggaagcttttcactagagagtgacacaatcagacctgtgttgcagaaagattcttctggtggttgtttatgaaggagggactggaagagctagaggctggatgcagggagtcaggaagttattgtgcaaatccaaaggagagagagaccctaagcacctgagttgaagtagaggcattggagaacaggaggaggcaccacaatgtcgatgaggaagaactgagaggttctgttgattgatctgctatggaagatgaatgggtgggaggattccacagatgaagaagccactgagataaggaatactggaggggaaagtgtttttgcgtaagcataatggaaatgcttttgcacatgctcagtttgataagcaggtggagatatccagtaggaaatgagaatcagatctggaaatccacctacatacatggatggccaaggaggtgggagtggacaaggtggtttaaggagtgaacaagaaaagagggaaggacacacttcaggggaagatgaaatcccaaggggtggggcagaaacaagagctaatgaaggaactggaattgaagttggaagatgcctacaacacagtatcacagaagccaaagaggagagggcttagaaggtaggagcaatgccccatgccatgaggactaacaaggcctaaaatggtgtgcctaccacagtggctggctcacacaggagctgctactttcattgggcttactgggtggaattcctggcttttgcaacaagaaaaaattgttgctgatttcattaagagtagcttcaagaaaatggtggcagcagctggagaggagaacacagtgagctgtgcaatggatgccagttaaaggaagcagaaagctggaacaacaggcaggtcaggacacagctcttgagctgacatgaaggcatcagcggtggttcctgtgatggtacaaagatcccacatcagatgctcggccaagttgaacaaaaaaaagaaaagatgaaggatagtcatttctttttcttccatgggtcccaggaatctctgctctcctaactggaggcagcactatggtgtcagtgatgcaggctgtgcacaggcctctatgaatggcagtgttgggggtggccatgctttccaatctggagcccaaactgtactgctctctccactgagtcatttgacaagaagctgatggatcctgaccagccagagagttcaaagggagggtgggaaatcttctgggtagagcccctccttgaaggcatttatacaccctacaaaagataaggatccatcgtcttttaaaggggttttctgatggtgtactttgacaagagtttccaaagaggtcttttcatacataatcttagcaaaagatgaaaatgcatagaaagaaggcaaagaggctaggcatggtggctcatgcctgtattcccagcactttgggaggctgaggtgagcagatcaccagaggtcaggagtttgagacaagcctggccaacatggcaaaaccccgtctctactaaaaataaataaattaaccaggcatggtggtgggtggctgtaatcccagctattcaggaggccgaggcagtagaatcacttgaacccaggaggcagagattctagtgagccaagatcgcgccactgcactccagcctgggcaacagagtgagactccgtctcaaaaaaaagaaaaagaaaaaggaaaaaaaaggcaaagatcaaagttattgagtcttcagggagtctaatctgggaggcaagaaatctagtaagtgcccacttcatttcatgaaggctttacaggcatcaaaatgtgagcacggggcttcagtccaatcacaggcagtcaaagtccctccttccccattttctcttcggtgttatgatcatcattcttttctccttcccagggacgaaggcgcctactctgaacatcaagttactgagcacgtgctctcaggcaacactggtttctatgacctatctatctgcatgctctgctgggtgtctgtataattaatactcccatatgtttctgttaaaaattcaagctttattgatttgtataaacagaactctgtacttcaggcccatttccccagtgaaagatgctcaaggcgaaccttctgttatcgttttctttcgtttctagttgcttttccctatgccatgctctttgtggcatttttcaggtttcccaatgttctcaaatttaccccccttcagagccagctttacagaagagactaatttgtaatggagacctctgagtacataagcagataaatactcctgggtaaggctccaaattattttaatttttacagcatcttggtcacctgcaaaaagcattatagtgatattcaaatgtattttgttcacaatttcccaaattaagaggatcatacttttatttttccaagagaaatgatatttagttatatagagatgttacgtttctgaaatctaaaatacaatgcaacatttgaatcctaaattcaaaggcagtcttctctttaagcacttgagtttatattgtctataaccattaaacagaaacaggaatcagaatttcatatctggaggtggccacctgaaatattgttcttagtaagtcactgaatgcttttagagcatttttaaaaagaagagattttgaaatcaccaagagaaagaaataaccatctttcttcttctcctttttaattttaaattatgaacggcttggtatcaggtcagaaattatcattggtgcttttattactgccttaaagcatgttctgaaaataagtaggttttctattttgaatgcagaatcagtagtatggagataccctttccagagtgcacgaactctaatctcagagcaagacttttccgagcacgaatgaaagcagaggggtttatgatggggagcacttcagttgtgagctgtaatgctctttgagtctggagtggtgttaatgttccgagtaagaatcattagtgccccatcatcagcacagacagggaaaacagtgaggctaatgtggggaggacgccaccaacccttcattcttacaatgccccgattgctcccagtgtatctgaagcacaggctggggaagggatttccggttggtctgttgccatccaacttacagtatatttttaacctacacatggctatcctgagaatgctttctagttagatattcagtcctgagtcgtaactattaattttggcatataatatcttccttagttagattcaaagcttaattattatattccatttcagcaagtaaattaaaataggatcaagcaattatgtttggtagccctaagtgactttcaaatgattaaaaaacatacacaaaataagcattattgtggtgattttgtaggcagtgaaactagctaggttgtgggattacaagagataaaaagcagaacaccaatcagcaatttgaaatgaactctcaccatttgaaactgagcttaaaggccactttctggggaaaggcttccgcggtctcccaggctgacaggatggcttttctcttgttcccctctctgccacttttcccgtgcactgccctgggtctcagcgtggtctgcttgcttccctatagggagctccttgaggactgcccacacctttcttgatttgtcttcactgtaatgactagcacatggtcttacattgagccctatgaagtagccatttttcaagtcaagaatggctaagtaccagcagtttcataggattcgatctaatggttgctgaactccatgactgttaaaggaacaggccagtgaattaatgtatcgtaacaagcacgtagccagcgttataaggaaccacaggctgggcgtggtggttctcgcctgtaatcccagcacgtagggaggctgaggtgggcggattgcctgagctcaggagttcgagaccagcctgggcaacacagtgaaaccccatctatactaaaatacaaataattagccgggcatggtggtgggaacctgtagtcccagctactcaggaggctgaggcaggagaattgcttgaacccaggaggtagaggttgcagtgagctgagtcggcaccactacactccagcctgggtgacagagcgagactctgggtgacggagcaagactccatctccaaaaaaaaaaaaaaggaagcacagtgccagcctctcaacacgctgagagctcagcaaactttcagagagctctggtacccagagccagcaaagaggccttgcaaagcttgcaggaggaccacaaatgtgattagagggttaccaagacattcctatggggtggagaaaacttcaaagattttggctgggtgtggtggctcacgcctgtaatcccagcactttggaaggccgaggtgggtggatcacctgaggtcaggagttcaagaccagccggaccaacatggtgaaaccccccatctctagaaaagagaagaaaacagacaaaaaaaaaaaaaaagatcatgagagttttcagtctcaaggaggcaaggcttaggtcttcgtttctgcaaagcaaactggctcaaattgcaagcattaagaagaaaagccttcttgacagggtagaaggattcctaagggcagctgggaagtttccccctctagacatctttaaaaatagtttgggttctcatctgtcattaatgaggctaaatgaccttgcaaggacttttctggtcataggaggtctggcacaaaggctgagggaatacagaacctaagaccaggtgacaagaacagacagtgggcaagcagccattgaaaccacacctcctgcatatgacatggccattgtactgcctgtgtaactcacatgctctggagcacaagtctggcacagcacaaagcggtgccctccgtttctatatgctgctgatgctgcacgtctgagaccatactttgagaactactgctctaaaaatgcggtcgatcagtttgattgaaagttactgtcagaactgttctctgctgctgtgcatgtaaactcgctgtactgcatcctacattaattcagaaagaatctagtttatcaaaacacactgttctccacttgacaagtgatttccaaaaatccttagttagcatttagctacagctcttggtcttgagagcaattaacaagaattatttaattcttcatggtttctcagggactgtgaatggataaaacattcttcacataaaacaaagagttcagttcataatgacagattcaagagttgtacccagaatagatgttggccgggtgtagtggctcatgcctataatctcagcactctgagaggccgagacgggcagatcactgaagatcaggagttcaagattagcctggccaacatggtgaaaccccgtctctactaaaaatttaaaaattagctggacgtggtgacgggcgcctgtaatcccagctactcgggaggctgaggcaggagaattgcttgaacctggaaggcagtgattgtagtgagccaagattgcaccaccacactccagcctgggcgacagagagactcaaaacaaaaacaaaaacaaaaaacctgaaaaaacaacgatagagttaataagatcaggggtcttgctgaagatgaagatgtatagtttttttttttttattaaagttcccctattctccctcaaattaagcacatgctcttgagagatgtgacaggcaaacatgaacatgggcttgtgtactgcccctgggagtgtaatctggaagaagttttctagaaggcaatttgggaatagttatccaaagtttcacagtgtgtataccctttgatccagccattctatatctagtggctcattctaaggaaataatcaaaccaactgcaaaagatttaggtaaagggtgttacccatagtactggctatcatttgaaaagaattggaaatgacagaatgaccaacaaggagaactggttaaataaatttggttcaactatggattggaatattgtaaccaaccaccacaaatgatattggggatgaatatgtataggaataaaaatatttcaaaatatattattgtgtttaaaatacacggtaaaacagtggatatgcaatatttccacttcttactagaaaaatagtacctacaaatgcataaataattggtctggaggattacacaagcataagatgttaacagggaggaatttaccacttctaggtggtaaaatcacagttgtttttatttctccttcctgtttttctattttagaagtgaacagtaatgaacgtgtattgcttttgtaataaaattttaaaaatgtatgattttaattaaaaatgccaattgcaaatgtgtgaaaaaacacactgtttgaatctatcacttataagtgcaacttctgtgttttttgggggtgtgtgtagccatcttgagcttatgaagggacccactgaggagctccttcctctgagaagaaaggggtagttgtcagcaaatgagagtacagggtatgtttggattcctggcttagttccattccttccttgcggcgtggttaggtactcaacctccctgtgtcttagttacttcatctgtaaacgggtatgttaatatagcatctacattttagagttgtgaggattgtacaggataattcagtgcctagcatgtagtgaacatcaacagattttagctattactgcttaaaaacagtattttttttggtagagatgggggtcttattgtgttgaacaagctggtctcaaactcctggccccaagagatcctcttgcctcagtctcctaaagtgctgggattacaggtgtgagccaccttgctcggccagctgttattgttattctgaggatagatgctttcacttagaaagtccctctccaaagcaaagcactggcaaaagagagcagaaacaaaattgaaatctgtgtgcataactgaacactctccaggctacttgctatgatggcagggaaatggtggttgcaacaatgaactttcagtggatcaatatacctgggccaatgagaagagactcaatcaatcaacatgtttagaaagagcttgagacaagtgggaattaaagacagaagcagcccaggaaatctttcagtgatgtgaagtagtaagggtgttatatgggagaaaagctagcaacaagggctataaaaaataacaaagagaactggggtttgaagacaatatggaataagatggttggtgctctttagccttctagagtaggcccgtaagaaaacattcacaatgagaggctgggcgtggtggctcacgcctgtaatcccagcactttgggaggccgaggtgggcagatcacaaggtcaggagttcgagaccagcctggtcaatatggtgaaaccctgtctctactaaaaatacaaaaattagccggacgtggtggcggatgcctgtagtcccagctactcaggaggctgaggcaggagaattgcttgaacccaggaggcagaggttgcagtgagccaagattgggccactgcactccagcctgggagacagtcaaaaaaaaaaaaaaagaaaacattcacaatgggaaaggcacatgtgagcaaggatcagcaataaggagttacctatgtggctgtttctttgtgggcattgcgattcaatagacacacaacacacatttatgggcttagaagctgtattcactatgactcacgcagtatttgggagagagtgaaagaaaataattgatgcttccatgaaattgggcaacagagaatttttttttaaagatgggatctggctatgttgccccggctagaatgcagtggctgttcacaggtgtgatcacagtacactacagtctcaaattcctgggttgaagtgatcctcctgactcagcttcccaagtagctgggagtacaagtgcatgttactgtgcccagctcaacagagacttttaaaaaaatagttgtttaaaagttttttttcccagtctgattcctaagaagtaattcttgaagttatatctgaaaatgacaacttgtcacagaaggaatttgtatgaggacagaggaacaaaacatgattttagtttgagtctcttctaagaggaaagaggcttttacatttagtatttccatctaattttaagatctaactttttcaaagttttccaacccattccctctattgtttcctaaaacacataaaaaagagaaaagtcttaatacttcaactagggcatggattattatttggaaatttgtatatttgaaaattcacgctttagaagtgcttctggattgaaagtttaaaaatcatacaaattaagaggaacagattcaatgagaactatggggaaactatccaaatcctttgggaaataaaagttccaagacctaaatacactagatttgcttatttctgacttaaaaataatcttaaaatatttcctttcttatatcaggaaggcagatttctacctcatcttagttgaaaacagatatttcttttttggggaggattattttttaaaaatatcaattgacacataataactgtacatattcatggggcacaatgtgatgtttcaatatatgtatacattgtgtaatgacaaataggggtaattatcatacctggaaccttaaacagttatgatttctttgttttcagaaattcaaaatcctcttctagctattttcaagtatacagtacagcattgttagctacagtcaccctactgtgcaattgggcaccagaacttatttttcctacctaattgtaagtttgttaccattgagcaacgtctccctattcccctcctcctcatctaccctttcctggctttgataaccactgttctattctctacttgtatgagatcaactttttagattccatgtatgagtgaaatcatgtggtatttgtctttctgtgtctggcctatttcacttaacataatgtcttccaggctcatctatgttgtcacaaataacagaatttcattctttttctttccctgaatagtattttattgtgtacatataccacattttctttacgcattcatctgttgatggacacaattttaaataaacacttagcttggatccacatcttggccattgtgaatagtgctagagtaaacatggaggtgcagatatcaacatactgatttcatttcctttggatatatacccaatagtgggattgctggataatatagtaattctctttctaattttttgagaagccgccatactgtttccatcattgctctactaatttatattcccaccaacaatgtacaagggttctcttttctccacattctcaccaacatttgttatcttttgtctttttgataatagccattctaaatggagtaagatgtggtttttgctttgcatttccctagtgattcactttgggtttgctttgcatttccctactgattaatgatattgagcattttttcatatactttttggccatttgtaagtcttcttttgataaatgtctattctggtcatttgcccattttaaagttgattatttgtcaactcaaaatggattaaagacttaaatataagacctgaaaccactagaagaaaacgctggagaaacacgtcatgacattggactgggaaagaattttttggatatgactccaaaagcacaggcaacaaaagcaaaaatagacacatgggattacatcaaactaaaagccttctgcacagcaaaggaaacaacagcaaaggagacatcttagagaatgggagaaaatatttgcaagctatacatctgacaaggattaatatccagaatttataagggacccaaacattgcaatagcaaaacaacaaataatcctatttttattactttttaagagaaatttccttgagaacaaacacctgtgaatgatactaaccatcaactatgggattagagaacgtaagactgcagagagtattaaattgaatataatggcttacctcttacagtaacagatgcttcctaattgtatatttaattagggaagtgatgcattactgtatattagtgaaaattaagccccagggcaaaattcagggttcgggatggggtatgggtaagcctagggaggcaaaattgaagagcagaacctcatctggccagagcaaatccttcacttcaccaaaaactgtatgtcttggaatctttgaagtgggagttattcataccaacataacaacaacaacaaacccactgaaaagtcaaagcaatatacttatggctttgtaaaatccagtcctgtggacacattatttaaaagtggtaattcttggccaggcgcggtggctcacgcctgtaatcccagcactttgggaggccaaggcgggtggattacttgaggccaggagttcgagaccagcctggccaacatggtgaaaccccgtctctactaaaaatacaaaagttagccaggcatggtggcaggcgcctgtaaccccagctactggggaggctgaggcaggagaatcacttgaacccaggaggtggaggttgcagtgagccaagattgcaccattgcactccagcctgggtgacaagagcgaaactctgtctcaaaaaaaaaaaaaaaaaaaaaaaaaaaaaaagacttcctctcaagcttggcaagcttggcgtttggtcgatggggacccatgggggttcaacatgtgtatcaagaagtgttatttctgtctggggcccatccaccctggccatggcaagatgttcatccgcaatgattgcaaggtgttcagattttgtaaatctaaatgtcattaaaaactttaaaaagaagtgcgatcctcacaaagttaggtggaccaaagcattctggaaagcagctggtaaagagcttacagtggataattcatttgaatttgaaaaccgtagaaatgaacctatcaaataccagtgagagctatggaataaaactactgatgcaatgaagagaattgaagagatcaaacagaaacacgaagcttaatgaacagattgaagaaaaataaagagctacagaaagttcaggatatcaaagaagtcaagcaaaacatccatcttatccgagcccctcttgcaggcaaagggaagcagttggaagagaaaatggcacagcagctacaagaggatgtggacatggaagatgcttcttaaaaatctctgtaaccatttcttttatgaacatttgaaaatgccctttggagacttgaaactgctaaattattagcttattttttacataaggccacttaaatgaaaaatgattaaaatatatttttcctaccttgccatctaatggcactaggcagcatttgtataataactaatggcaaaaattcatggctagtgatgtataaaataaaatattctttgcagtaaaatattccctttattaatgttatagaagggaggatacaacaaggaactaacaatttgtatgacagtgtcaaatattatttagattttagaatttcctgttttgcttcatttgcatcttagaagagcataatgacattgtttgatgaagcctaattatgctggactgttttgagctggtttaacccttctgataggtagttgtggatgtcgaggatgagaactgaataatctttgcctgaaatcacactacactctagaatttccactctggagaatactcagttctaacttgtgattcctggtagaacaaactttatttttctagcctagcaatgatctagaagcagaggaatcccagtgccttttaaaagttattatgtggttttcttttaaaaagctcctgtttttggaaagtagaatttctgggtacaacatctgtttattatttgcacataaaataagccatttaaaaagtgaaaaaaacaaaacaaaacaaaacaaaaaacaaaacccagggcaatgaatgttcctggcacattggagaggcagtccagtctctggattcacagtgtgggtagtggagtggactgcctggtttcaaatcctggctctgccacctgctgtctgtgtgaccttgggcaagtgacttaacttctcttggactttgttttcccatatgtaaagtgggagcaatggcaatacctactgtgtggactgagtgaactaatgcacataattcagttgtgcagggcagggtgtacagctctcaactgctacctgttattagccctaataaactgattttaggagggcatgagtatatgtcatttttaagatcgtctattatgatcccttaggctgatggcaacttgaaagtgcctctatggtaatacttctaccactttggggtaattaaatgttcacatgttggtttcctccactggattgtgaactcggtggattttagtcatctttgttaacaaagtacatttaaggaaacattgatcagaattgggaaccacagtgatttacttattactgggagagacattttcattttggctaaaatgcatactttgaacagaaaacatctttttttcaattaaaagaataaacaggtaactcttaatctacaatactttggcctaataatattaccatgaatcaactttttagaccgtctgtgtcctaaagtatttttcatggggagttttgattgaactgggacttttggctgaaatgccaccatgctgagaacagagaaaacagcaacttggggttcaaactgaaaattagctgcaagttgagatctacatcatttatagttggtgaaagttctaattcacaatagaatagttccagatagcagatcaaccctatgcttctggttttgaaagactctggtgaaatgtagtgaatgcaaccttagctactttatcaagaactgagacttacttaatcaagattggaaataagggtttatgatagtccgagaagtaatgaagtttctattttcatgtaaactacataagcaccaagagcagcaaaccagaaaaatgccccccaaaacagaagaatggcttctaaatatatgtttttttctaagtttcattttaagcaacagacaaggatttaactaaattattctctacttaggctactaaaatggcttttctattgctatcaggatgtaatttcagatccactcaatttcatgaaattgactgagattcaaatcatacatctggtatattttaaatgatgctgcatgcactaggcaatactgatgctgattatcacaccggagtagctggtctcaggtaatttagttaagagtattaaatcagagatgcccaattaatttattagacatgttcatgaatatttctaaaattattatgaggcttgatgaatgaaaactttccctttttcttattgttcattggtgacacaaattaggccagataaatatttagaatacaagatttccagaattataaaaccagggagaactctaaagtgtatctagtctaatgttctcattttatatgtaagaaaacagaggatcggggaaacaggagaatgtagtggttaaaagcctgggctctggagtcagacagacccgaattccagtctcagattggcaagttattccctgtgtgaccttgagcaagttattcaacctctgtaagcctccatttcttcgtctgtaaaatggggacaataattgtactaggggacactgtaaagactcagtaaatgttagcagctatcatattatttttatgaataacaggtgactcctaaggcaaataaccagccacggaactaaaacttagagtttctgatatatacagaagcttgtttttttatctaaactcagtacctaagttaaatattcactggtactgacaatttaagtactgtctaactctgcattaaatagaaggataactatttcagtcttttttgctgttgaattgatcaaaatattagtgattacatattgaagtctcaatttcatgaagattcacacatatttagctttccataaacaatggatatttcatgtttaccttcatagctgtttcagtgtaattatatgctcttaaattattttccaccaaaagctgctcatataaaataaacaacaaggtatattggccataaataaaagttaggattgcacttactaatgaccttaaatttgactttagttagatgctatattgaacaagtctgatattctcaatttgtgcagttactcagataccagcatagcctctatacacctgttatggaggaagcaagaacaagggacacgtacaaaaggaaaaggtgggtctgcaatacgagttagagttgctttggctaaaatagactcctaggaatcaagcagccactaatcacagatatttggaattgccattttttttttttttttgagacagagttccacttgtgtcacccaggctggagtacaatggtgagatctcagctcactgcaagctctgccttcaggttcaagcgattctcctgcctcagcctcccaagtagctgggattacaggtgcatgccaccatgcctggctaatttttgtatttttagtaagaggggttttgccatgttggccaggctggtcttgaactccttgacctcaggtgatccacccaccttgacctcccaaagtgctgggattacagacgtgagccactgtgcccggcctggaattgccatttttagttaacatttgcccttaaatagttcattccactcaaagttgaatttaaaaaaataaaaaaaaaaaactgagtaagaaattgcataaagaatattagctttatataatatgctcttaatacttctgcttttgataattttagtcaattggtgatgttttcagtaaatattctcagactattcagtgcgtgcttaaaaccttttgttgtaataaagatcatttttctaatctcgaaaatgatacaattaattttaaatctttaaaaataattaagaacaaatatagtacaaatatagcaaatagacattaactcaaactatagtgagataagttcaagcataaacatgcagaaagcaagagcacctttttatgtaataccaatgtgattcagcagaccaacagatggagaaaatagtaatttgaaaggtggcaatttgtatccatacccagtatttagtatttcagctactagaaataaagtagtttggcagacttacccgcatttttgcacaagcatcttgggttgattctgtccccctaagctcttttatcagcatagaacctaaatactaaaatacaaaaaaaattcaatgatttatgaaatggaatatacatatgagtaatgttttaaaaacaaattgtggaagtattactggctaggtttcctggctgtaagttgttgcataactttaaaaaactgacagtaactaatcctaacaaataaatgcattcatagagaaaatgcagcagaattaaccataagttctgggggctgtaattgctctttataatgaaactgcaacatcttctaaagatgccatctttcaaatcatatttaactgcaaaatgggggcatctaaaaatgttttccccttttttgaggcagcaatgtctgcaaaaataaatcacactactatctctgtaattacagggttgcatgagacagctgagaagctaagcaacatgtcccccatttaggcttattctgctgcataggtaattaatgttaggcttttaggcagagatgcagttttggacctttttcattcacagctgtgtgccctatggttgatccacctgagaacgggatgggagggtggggggagggagagaggcattctcagttgtttcccaggggaagagagctgggttcctggtgcgaagtgccacctggagggctgaatggagctagaaggatgacagtctcccaagaattgccaactactttgttgttagaagaccagaccccatactgtatcatcctggtacaaaatgcccctcgtgctccagcttctggctggggccaaatggttttaaacaaaatgtctgatttgcctttctatcaattgactccccttcaaccttttgaagctttagtagggtttttgccttttgtcattcccctgccccttgccctccccccaccagcccccaaagagctctatatatgttttttaaaaaagtgaattacaataattattttagaagatatctgatggacacttcctgacaagactggagacttgtactctgcagagacggggatgggaaccactcttgtggactagggaagtgcctgacttgaagaagacgtgagagggcacaacagcagaaggcgtggtcagggccttggagaaaggcatgttcagaaaggcttggggacttggggtttggagggaggagccatttcaatcctatggttttgggcagtaccactgaaataaatccaaagctgcaatataagtaagctttagtaaaagaggggcagaaagcagaaaatgaaaaaaaaaaaaaaaaaaagctcaactggtatgagataaccacaatgtccatctaaatcaaatgaaggtgaaatttattatcttttggtaaaatccttatcttttaagttatcagggaagtttgcctgattgaaatgtttctttttaagagaggcagtttcaatgcactgctgaaggttcagccactttttctgctgtcgtcaagacaaccaccacctgacccaaaacctacagtatcttttgaacatttaccagttcctattacatttctcagctaattataattaattcccctcttctaaaaaactaaacaactaacctaaactaaaccaaactaaactaaacaactaaaacagaaaaatagtataatcctattgatgacagtgaaaagaatctggtatttacataaagtggcagacccagtgttttgagacccagtgtttggtgagtgagcagagatatatatatatatatgccatatttacactcatttccattttaagattgtacgttataacatttatttaaaaatatacaactatataagaggtcacaacagaccttaaacttacaagattaaaacggttttaaagctctagttatttggactttctctttggatagaaggctactttaagaaaaagtgaagagaaaaacattttaaaaatttcagtgatggatatggatattttggtatattttcaatgtaaatgcaaacaagctgaaaacataccccctatctccacttaggcccaaatactgaattgagggtaacttacaaaagctttgtaatcacacgactggaagataagcttttctgggtgatgctgccagtactgtaccggggtagaggctgtggcttcattcggaggtcgcaaggtaatggaaggttctccccagtctcctgtctgaaaatgacatttattctagaggcaatatgagcagtcagcaaagttcattccctgtagctaccctgagctcaccttacacacaggtgctgtgaatgtaccaaaatgcatttgggtgtcttatgtgaatataaatacttggttattacatttttatatgtattagcatatctctcaaggctgagttaatttttgaggtgtggagttgaattattctatttttagaatgacatcctaagctaagtcactttaaaataaaacatgaagatattcataaatgatttactaatcacaattttccatcacaacagcaaaggacacacaatctttaaaagaattttgtttttaaacttgactgaaatttttagtttgaattgctttcacattcagaacacacagttctataaatttcagttcccaaatatgacatgtactagccactttgaataattttagatctctggagaaatggtagtgtaagcatgatgctaaacaaaatttaaaagaaaaatttactaatgggtgacactaatttctctcatctgaattcaattgcactgatttaatgatgctgtctcagatggattcagctacttttctcagaaaacctaacgtaccaatgaagactaaacagtgaaatgccaagtttggtcacatgtacataggcatgtactttgaggattctgattcacaaatacaagcacattcccaaatgatggtatatcatatgatacagacctaaaacaggaggacctcccatcatttcatttatcattttccatgaggttagcctcaacctgtttcatcagtataatagcttaatgtgagcatctataaagtcaaaggccagtgttggcaggtattttctgggctctactctgatttacatactacgcatgagatatttcttactctttctcctgggaaagatttggatttttccaaaactcagttctttgttctcaagtggacataactaaaactaaataggcagatttctagagtgactctcctctaacctagatttggctatatatagaactatgagaaattacttttctcaggagttggaagagtgtaaaaaggtctcataaactccaaaatcaaataaaaccttggttagagaacaagttccacagaagtgctagaaagtgtgttgacacactgtgggatttcttaaggagaatttttaaggagtctaggacaagaatgcaaaattttggatgcagttgtatgttttgggagagaaaggaagttctctgctttattaaattctttgaaagaatctagaaactccaaaagattaagaaccacagttctctaggaatggcgtacatagggtgcatattttggggaggagaactagctctccaattttctttgcgcactttggacttacattaggtgacatatgaagtagctgccaatgataaaaagccctttctagaggacttcagtaatgcacaggctttttttttttttttttttttttttttttttttttttagcagtggagtgcctgaagcttttctccttgagatgggtcacttcgactcgcagaagagcaaagttagcatcacgctatttccttggcttctcactgtagttagtgtgtgactagttggaactccttcggcttttctctcctgctctgttctcagccactctccacattagttttgttttcgttgctgatttacttttacattgcttaatcctcctattccctgtctgttggtattttttatttttgtacacatttatggggtatatgtgaaattttgttacatgtatattgtctgttggtattgttaagactttacttgcaatattaactttagcatttttgtctgttttattatccatccctgactcattcttgagtttttcttttatatttatatgaatttttagtttgtaaaagtgataactgactgcaattctaaaattagattaagtttttctttggcttcttattttgattttttttcttttccttctttctcaaatggctggctctttattctctctctggtctttatttcatctggctgtaacttacttttgaaaaactagtataaaattcaaaatataggatacgtggatttcaatatcattttgaagctgagtgtaataacctttaagtgataatagcttaaaattctggaaacatgcagctatgggttcttaaacaaaagctttacccaaatctatcaaatcatcctctaatctcccccattaaacttctccctccttctcccgctccctggataaagcaacaacaacacggcaaacaggtattgtacatttaagtcacaggtaacactgttaacaaaacaacagaagtttgcatgcaactccgtggaatgatacaaaaggaggatctggatggcttccaaagatcctttgatccagtgtctgctgatgtgacaactcaaaccaagcatcagatcttcatgtgaaccctattacagttcagcagaggtagaccttggccaagctcaacaggtagttttcaaaaaagtctgaacacggcatgagctggtggtgccatgagttgcagggccagggctgggaacagggctgggggtgggaatgagttgggggaagctagggttatgaaaacatttcacgtgttagtacattaagcatgcaaatcatatgcaaattcattctctaattgttccattaactcacacacttttataattaaactttaatgtgagttccatacatttaaagccagagccacagccaaatgctgatccaaatatttacgtcatccacataagttgtagcagccattgtgggaataacaagccccagcacatacattccaatctcggtctggaaatcactgaaatcccttatttgataaccactggaagaaattagtggaacatccacttaaatctgtttagacagcgccatcatctgctctcccatgactccactttgtccaaaatcacaaaccacttgctttgaattcagagtgatctgataggattttccctaggtgctaaggtgggagataattacaaggaaaagaaatataatacttatttcattttctttgtggccttcaaatattgcttcagtccaaatattgtcaaattccctacagggactgaatctacctttctggaaagagacactgaattttatcagatttagtgctatttccagaaattcatttttaaacagagggaaaggtgttcttaagattgaatttattagaaaataaatttcttttctgcctggaaattcatcaacttctctccccacccctgcctattttttttttttttaaacttagatctaaaagtatttagaagactcaatttgtagatgttaattcttctttttggaattaatttaatgggaatggatggactccaacaactggacttaacattacactgtcgtaaaggacaggtatgaccttggcccttggctgggattcagctgtacctggttgactcccagtaagaacaaaagagttcagagaacaagggtgccttaggtctcaaccctcctggaggctgaattacagcaggaatgagctatggaggaattacgtagagtagttactatatggaatggaagaagaggtcaaaaaagaaagatttttgcctcatacataaaatcattttgaactttgaagcctagtgttaggtcttgttgactagtacattcatgtctacataatacttgcatctcctcaggcaaatatttttaaatttagtaattttccacttaaaaatccttattaaatattaaataacagacctaagaagtcttttgccacaataatggtttataatcaaagcttatttttaatgaaaagcagacctaaacacagctaacaacgcaatatttcattagaatagcaaaatgaagtaggaaaagtttagggtagaattctgtcatattttaaattattattgacacagtggtctttgaaaggattccttaagtaatcacaaatgagaaatcaaaatgattcaaggtactcctaataaatgtcttcaggctatctctttggcacttaaaatatttacagaaaatctttcctttaggttcatgtatttgaaagatcttcatattccaagaattttgtcatggcttaaaacttcatttatttggtatttattattattttttatatgtatgcttaaggcctttttttttattaagcacactaaagaacatcaattaaacagaggaaaatgtacatcattagctctcttcttcaaactcaaataaaaactaaacttctaacataaaggaaaaatactttgacattagaattttaaatggagaattgattctgtgtaacacatgtttgcaactgccaactataaatctgtagtctgggtgagtctgaaggactataattgggccacatctaatataatgtaattaaattaaacattctcttataccaacaactgaaaaatacaaaagcatcaatgggatttagttaaaaaacaaaaagcttcacaaaatacagagatttttactggatggcagattccaaattgcagcttttaaactttgcattatttcaacaggtggtaaatagctgcaaatttttagttcacatgcactggacacctacagcaaattctaaaacaaattgtatcaggtagctgtctccctccaaaagggaaactgaatattacatattctatatgctctgagaatagaaaggaaaaacccttctctatgttattttccgtctttattattatttatttttccaagatggagtctccctctgtcacccaggctggagtgcgatggcacaatctcggttcattgcaacctccgcttcctagggtccagtgatcctcctgcctcagtctcccaagtggctgggactacaggcatgtgccaccacatctggctaacttttgtatatttagtagaaacagggtttcaccatgttggccaggctggtctcgaactcctggcctcaagtgatccacccgccttggcctcccaaagtgctgggaattacaggcatgagacactctaccaggcctttatgttattttcttcttaaggaaaaagtttcctaaggatgtcagtagataattaaaagccatgcttacaacttacttttctaacattaatagaaaagtatggcattttccaagccttgtattattctttaaaatttttaaaaattaggatttaattgatttttaaaaatagaacctttaaaatcttttctatgaggactgctcccacctacttgcttataaatttagatctgaatattaacaaacattagtctcaatttcttcagaacacttaatgaaaaactaaaatgattttaaaggacaattattgttttaaggttttactttcaataattatgacaaatttcagagatgggctacccaaacatacataagatatatgtgattacatttactttctgtaatctctaaggctttgaagaatgctatacacagctctatgcttataaatatgcatacgtatatttgaaagtgaatgtaaggaaaaggcttcccataaacattcacacataatgaaagcaggatgttgtagttgttctttcaaaaaatcttcaagaatgaagaattctagtttgatcaaatgcagttggttatactgaatttgttcctttagatgaaaaagagcagagatggctacttacgaacacataaaagctctggttaacatttatgagtccaagaggaactgctgggtcacgtgaacaccagtaccaggcaatgtatagacaccatggtcctcaagagccagaagtcccatgcacaggagtacatatgtgcctgatgcagcatcccaaaaggcacttcacaaaaatacccgtggcatcccttcacatgccgccccaagaatctgctcagtgattctcaaccaagtgtctcaacctctcagacagcaggctatccaatgggagaaattcaaaagggtgtgaaaatagaatagtattttaaaatatggaacataaaaccccaaacatttaaatgtttattttccaaatagaaataaactttttctaaagtatgcaaaggtgaaatatgaacatttgaaaatcatgcagctcagagtaaaatgggtcacaatttcatacaatttgcaaagatcaattcagtactgtcaaatggaaaaaggctgagaaccactttgtagctgtaaccgtgcctctcccagctcacctccccccacatttgcataaaatgtatacagaataacatgcaaatcatactcagaaatttctcacaagtgaagcacatgaatctttgagaatcattagacacaaagggttgaagagtccatgaatatggggaggtacaaaatggggaggaataatgctgatatatacatgtgtgtatatatatatatatcaatttacccttttctttttcctgtaaaagcaagtttaacacagacgcctggaatgaaagccaaaactcacatgggacatattttaaccatacactttaaaaccaagtatgtttcttgttttaggacaatgtttgcacatcaactaatcacaaggcacagtaaatgaagtataatagacaaagagtctcggagtcaccagacattacaaattttctgcattgccaggacacagtacctatagctgttgacaacactgtgcaacacagtacatagcgcaagttcaggagaagaaaagaaccatttgtaaccttacattatgaacctgatggatcgctgagaaaggaaatcctgcgttctgattcgtccatatttcacagacagacgactgctgatataaacagaaaactatcttatcttgtcaatatttaaaacatggcagctaccaaggtagcatccaggaaggaaaagaggaaaataataaaatgcaaagaatcacatttaaaaaaaactcaaaaaatgttttagggtgctcaaggtttaataattgacttccaagtcattctttttgctttaaaacattttgagttgactaaaaaaatcatttatgcatttatgcaaggaaaattaccaataaattcatgccttggaaaaaagcaaactgtattttatatttgccggaaaaccagaaataccttcccccttcacgtcactactttcagaggataaatattttcatcaacttcaggaaaaacaggaaaaaacctttaacacaggtccgatatttttattttcttatcttcaatgaccaagagcaaacagtgcaataaaatgacttttcctgatttagtcattgctctatttgacaaacctagaagatatttatgcctccagagttcttacgggcaaaactcggtagttaacaaaggaagacgtgtcagcttgctacccagcactgggaggagtgaaggaggtggcaggaaggaggctggggcagggaagaactgaagtcagggaaattcagttctgttcctcaagcagaaacccttgggaacagcatttgggagtctaatgattcagctccataattctggctctcccccacaccattaataagataaacttatcagtaatgtttgctcagaaccaaacactaaactaaccagcatcccttcccaggagttacagtagaaaccttcaaagagaccgactgagctcttggcttgacccatcccaagttctgttcccgaatttcatcattctaaaagacactgtgaaattaaatcacagaaaatggcagagcatgtaaacttattcagcaagctctgtgagcatctttagcattcacaagcagtccgtacaaagatcactgcaggaagaaggcaagcacataaccataatatggttaagaggcccggcaaagaactgtatcatcagcaaacaaatgatagaaaagaaggcttatccctagctaaaagtttcctcaccccagaaacgctcaccagcaatttaacacctctctctctagttacaactgcatctccacacacccctacacctttgctttccatgtcttctgttaaccagaggcttgctggggatggttaaggaagttagatccccagggtctgaccaaaggcacttccaaacacctttcacttaaaccagctctgctatcctcagttccctctctaaacttcatgctattttatacatccatagagggttcttcctcttcttacctttctagcaagttcagtcttagacccattcactctgttggccttgtctccaatagctctcctctgatttgaatgtactaactccatgcgttagctggattaccatcttaagtggcatcctcacccagtcctgagctaattctttacacaaatcacatcttctgcaactttcacacacttctagtgttaatctagtgctagaagtgcttctagcacttctagtgctaaataatccagagaccacctgtcatctgatagatgaagacacagacatttaaagaggtgaagtggcttgctcaggtcacacaggtgagtggcacaatgtgtcagcctgctgggatggctaagaaggagtgtgagcctggtactgatgtcaccagaaggcagagggccactccagctatatacagcttggttctactgaccctgaaatgaacagaaactaaaaataaaatcgtaagccccctcaccgactgaacggacccccttgtggccaaggggaccccagaaaaaccttaaaattgagtttctgaccatgatgggatgggaggtgagacaagcctcattatacctcctctttttcatggtttagacacaacaactgatcggaattaatgttaaaatagacatcataagagtgacagaacagtctctttgtggctataagataccaaattatcaacaggacccgaggccatgctaggcaaaggttaagtcacgcacccctatacctaaagaataaactatgttccaactgccacaaggtttttctttttctctagcagctaaacaggtactggccttaagagaagcaatatttaaacaatttgcacctccaccagatgctgattgacccttagcccctgctccaccagccataactacagctggacaagagattgattcagtaactttatccaaataagattactaaccatggactagttctggttggtctacagagattgcacacttgtgtgccttcatgtcctgaaaagcccttctgacgaacagggctaactgtaatatatctacatgttaagtctccaacccaaagtgaacataggccacatgttacatgcatgttggttcaatacacatgtgtcaggaccaccttcatgaatattcacagctcttgtaacacattgaatatatgtgtttagctaatctgttcagcataaatcttctacctaagcccttttccttcgaagtacccgtctctggggtcttggttggaggtgcttcccagcctgcgggatggccatcttgcaggctgtaaccctttagaagaaataaagtctcctctactttactaaattcatatatatatatttaagttaacacaagtatatctaaatgcaatcagttcatgagacagtcttaactgcactggggtccaaacaccaaaaagttgttttaggttgttttggttactcccaaaggggccatgcccagtctgcctgcctgatgggcacaaggccatttaaccttttgggcagactgcatcacttcctggtcactttgagtcatgaagactccattttgtatgaaatccaaactcatatctgattcaaacttttccttccctccttgtgtgtcagtcttggggcttaaaaagcccggggtggataagagaagctcggtctgcgctttgacttctcctaggagaggtgagggcaggtgtcatggtctaccttggatgttccctgccccaagctctacctacttcatgtgtttagttggggaggaagaaacaggaaaaggacgaggtccctttcttgtctggctgttcctctggcagccgcactgcttttcagctaacgttaacatggtctcccatgtgctctacgtagcagctgctccaacctaggttctcctgtgtccccgtgtgatttctttggagagctcttctaggatagagggcaggtcctcccactgcacagtttctgctggcagaaatctgcctctagcttgacttcttccaactcccactcagccctcctaggacacatgcatgccccctgaaggggacccagggggacaaacataaccccagactccttctgcacatccatgtggcccacatgatatggacacacatccttgtcacacagaacagtagaagggcgggctgctctgtgaacactccccctctctgccagggcatccctccccaagactctctgtgtcagctcggtaggtgctatgtgacctgcctggcagaagtccaattatggataccaaggccagttttccctcctgcaggcacccccaagccagatgtacattcctcctggaccccttctcaccaggattggagagcacgggaatgcattctgtctcctctctcatggcaaaggaggaaaagccttagttctttccacaggactcagacaattccctgtccttctccagcactaaccaatgttctgcctatgtggagaggtagctgacaggggcagggcaggattcacactgcctccttgtaaaccccgaactaggtgtctggctccatgattgatagctttctctttagggtgtgcagtgcttagtacctacaggaaaattcccacttagcatcctgggaatagatcttccaatagtgaatagatctttcactactcacagaaatttaccagagttaagaagggaaaagaggatcctacgccatacttatttcattaaaaaaaatcatataaaatttttctcaatgaagaataaagaacctacccctagtcatatacactgagagttcatacatggcttatgtacattttttagatgttataacaaatattttctatttataagctatgttgtaaatttagagaaagtaaaacctctataatttctaataccgtcatgcacaacataacgatgtttcagtcaacgacagactgcatatgctacaggggtctcacaagactacaataccatatatttactgtaccttttgtgggggttggaagaagtaaagctagagccagacttaggtatgtttagatacacaaatactcaccattgtgttacagtcacctacagtattcagtatagtaacatgctgtacaggttgggaggagcaataggctagatcatatacagcccagctgtgtggcaggtgacaccatctcacgttgggtaaatacacactatgacgtttgcatgacgaaatcacctaacgatgcatttctcagaacgtatccccatcattaggttatgcgtaactgtcatcgtgtcagtgcaagtggtaaaaagtcagaatttaaaagagtttaaaagcagttgtgtttgagttgtgaaaattattattttattttttttgacacagaacctttgctctgttgcccaggctagagtgcaggggtgcgatctcggctcgctgcaacctccgcttcctgggttccagtgattcttgtacctcagccactcgagaagctgggactacaggcatgtgccaccatatccagctaatttttatatttttagtagatatggggtttcaccatgttgcccaggctggtggtctcaaacgcctggcctcaagtgatccacccaccttagcctcccaaaatgctgggatgaaaattatttttttaaaaaatcggatgcattccagataccgcagtagttttgttagcagtaaataatttgtcaggctcacagagcaagcgacttaaggcagacctgttgtaactgctgcattcataatatgaaatggctcttctcctagacatagggtcattatactgagtgctggaattaattttttaaatccaagagtttccagagtagaaattaattatgtttatgaaaataacatttcagggtaaaacatgtattgaagtactgagttttgaaaagttttgagaaagaaatataataccagtcataaaatttcatctggggcccaaattcctagaaaagtagtgagttaagtttttttgtttttttttttttcttgagatggagtctcattctgtcacccaggctggagtgcagtggtgcaaccatggctcactgcagactggcccttccaggcttaagtgattctctcacctcagcctcccaaggagctgggactacagggatgcaccacttcacctattttttttttttttttctaaatgtgtagagaggaggtcttgctatgttgcccaggctggtcttgaactcctgggctcaagcgatctgccttcttcggcctccggaagtgctaggattacagttgtgagccactgtgcccagtcttaaatttaagttttgtttttttttttcttttttggtggcattggagacagggtcttgctctgtcacccaggctggagtacagtggcacaatcttggcttactgcaaccactgcctcctgggttcaagtgattctctcccgggttcaagtgcctcaacctcctgtgtagctgggatcacaggtgtgaaccacctcacccagttaatttttgttatttttagtagagatgagtttcaccatgttggccaggctggtctcaaactcctggcctcaagtgatccaaccaccttggcctcccaaagtgctgggattacaggcatgagccaccgcacctggccaaattaaactattttgtttttttagtttttgtttgtttgtttttgagacagagtcttgctctgtcacccaggctggagtgcagtagcgtggtcttggctcactgcaacctctgcctcccgggttcaagtgattctcctgcctcaacctcttgagtagctggcattacagatgcctgccaccacatctggctgatttttgtatttttagtagagacaggtttcaccatgttggacaggctggtcttgaactcctgacctcaggtgatctgcctgcctcggcctcccaaagtgcttggattacaggcatgagccaccgcgcctggccataattaagctttacaatgtcttcatctgtaaagaaggagaatagtacttgacctacttatttcaccaagttgttgtgcagcttcacgagagaggaaactttttcacagctaaatgtttagggcttggaacacagaaggaacacatttttaccgaatgaatggaatcatataacacattcaaaaggccttggtaaatggcaaagcattatgcaaacattagtcactaccgttatccgttatcatttttaactggtctactctattggtgccacttgtgcctttcataagctatgtcactgccaacacacttccggttaattgtaccagaaactgctgacttcctattggaagattcctcatatttcctgataaagacagtaaagggctgccagcttgccgaagagagaaggaacatttgtcattagcatacctaggtgtcaaaaggctgcttgtagagcttagaaacagttccatgaaagaatgttaatcacccctttgcaatttcatttgcctattttctctcaatccctgtcacatatattgcaaagcctcatttagtttttctgaacctgaattactatgaaacccaaacaaataggggtaagtaaaggtagacttacaactgagatattaccaataatttaatgtttacttctttgatggtgaagtcaacacacatttgaaggtgtataattttatcttcagttcagacctctctcttagctctggaaatgttttcttaaaatgcaatgcatgtctcgctcttgttaccgtcttatactttcggttaccatgacttcagctcagaaaatacaacacaactgcattcaaatctaatcacaaaataaaaagaatataaccaatttccaaagttttcctcctaaaggtggacttcctttttgatccagtagtttacaataaattatctccccttcattatggtttgtcctctttcctggagcattctcagaaattgctataacatcttccatcaaaagcaaacaaactccttcccttgccccaacatcaccctcggtttcctgctcaattactctaatcttctttaagcaaaactccctgagaaatgtctagatggtctccactttctcttttcctgtcctcatctgagcccactctactgaaactgaaacaattttctattttccttgacctatgtgacacccttgatcactcctccattccttagcctctttggctgcttcctgttatctgagcatccctggagtgttagtcctcagtcttcccttccttcttggctatactaggtggtctcttccagttgtgactcccaaattcatatttccagcccagacttcttccctaaattcaagacttggacacccagctgcctgcttgatgcttctccttttgcatttattaaatcagctcaaccttaaattaaatgtcagagaccaagctcctgatgacctcacctccctgtgagcttccttgttttggcaaatggcagccattttttttccagttcctcaggttcacaatgctggagctctcctttctcctgtatctcgcattcaatccagcagcaaagcctattgaatctacttctaaaatttcaccttcctgtcactacttgctccaagctactcccttttctcgtttgatttattccattggcttcttacgggtctcactgctgttatccttgcctccttagtatctcttctcagtactacagccaaaatgacccatctaaaatgaaagccaggtcattccactcagctccattcaacacagaagataattcagtcctaacaatgacctgcaaggttctccgttctctggtacccacactgctctacctccctaccctcctctcctacccatcttcgtcttgctgtctgggttcttgacagcaaagcacattcttgcctcatagcctctgcatttgcttctctttctgcctgacatgttctccctctggctactataggcctagctagctccctcacttccttcaagttctattctaatgtcactttttcagagaagccttccctaggcatattacatccaaattaagtctgtgctttccactctataaaagaattattctttcaagcagaaattatttatttatttatttgtttgtttttgagacagggtctcactgtcacccaggagggagtgcaatggcacgatcttggctcactgcaacctccacctcctaggttcaaatgattcttgtgcctcagcctcccgagtagctgggattacaggtgtgcaccactacacctggctaatttttgtatttttagtagagacggggtttcgccatgttggccaggtctcggactcctggccttataggatcccctcgcctcggcctcccaaagtactgggattacaggtgtgagccactgcacctggccttaagcagaaatttaaaatgtaaaaaatgtttggcacataagaacctatctccctgtcaccctgacattcatgcaaaagtagttactggtcatctactgtgtgcaaggcctgggtcacaaagtgagtagggatcaatcttgcttttaatcaacgtttatggcatgaaaattgctttctccgtggacagaaccagtagtaaactgggactgacaggctgatggtgggtctcagaacagagcaagtagatgacagctccatcaactcgataacccctattaagctctggaaagcttctgggagtctgctgatattatatagctaatctaataaagaaacttttatgaatagagccctccagtcagattctaccagagatgaaattttctgccgtgttctagccctgaaaaaaaaaaagaaaaaaagactttttctctgtttctcccttatgtttgtcataatactttcaacacttcagggtattcagaaattgaccagaaagaaaccagcaagaaatatgaaagtttcagagtgaaagctcaaggaataatgaagtgcattccttcttctggatgatagtgcttctaaaagaaaatgaaaacagacttgaagagcaaacaaaacagcttcaaaggcagaagaaaaaagggcatcccagcaaaggaagccttagccaatagccagcaaactcagtggctccttgagcagagactgggatgaaatgagacctgtcaaaggatggagtcaaacaaattcagtgcagtcaaggggtaacgcaccaaacaccttgtatgcatattttctttcagcagtgacagccccacagttgcttcttctgtgggcattaactgaaccctgcctggaaaatcagaaaattagagccttttgtttcttgtgagttacccagaggccgcaggccagcatctgattacttcttcctgcccaccatcggagacagaggaacactcctccttctcacctcttgagtgagttttgagatacacactcagtcctgtaacaactgcatgggatttagattcttctctgcaaccacactgttagcttctcaagttccctgtctgtgtctatttatttctagttctaaagtgtgaaaaagttatgcatgcacccactgaccctttttataaaaggtctcagctgaactatttcatttgcaggaaatgctagagtcaagaaaatgctgcttcctgccatttctccatctttctgaagggcaatccttccaaaacttcatgatcgtgaccttcccctgtgcctgtggggaggatttttggacagatcagttatcacctgctgggaaggaaaagccaggccaacagttgtttctctaacaacatctgcacgtgtgacccatgattgctggagtcagcattaatcaacctaccaagagtgggaggaagtaaacaacacatttggttccatctaagtccactggcatgatataaattctaacactgtcttcccaagtttaaggttttccttccattccctttccaaactcccttccctttcccattcctctccagttccctccctccctccctccttccctccctccctcccttccttcctctcttcctctcttcctccctccctctttccctctttcccttccttccttaactctaattctgggactgatatcacataaaagaagtcctcggctactaaagtaggagagaaggagagaactataggcttatgatattcctgttattcatttgtagaggtaatatataacctgtattccctaatatgacagctgtagccctaaatggcattacacaattgtttatgaaatccctttacaagaaaaaaatagagcagaggaaaaaaatgagcattgcctgtacaatccagctctcattgtgcagctccccaggttccagggatgttgcagggaatttgagtcaattgggatcatgctgtttatagcaatatgggctgttttacttgttctacctcaaagtctggatgctatcaaacgtttttcagggccactaaaaagcagaacattaataactaattcagaaaggcagtgatcagctttttatcataacatgaatggctgaaaaaaacctagattttgcaaagtaatgttgttctttgtaacatctctttacaatatacattatattcctttcttgcaaagtgaggttgtcatttcctttacttaaattcatttattaactggagcccgactgtttgtttcctgcttctgacagaaaagatgcattgggcagagtcatttattcaatgatgtttattgagaccccaccatttcttcattttatccttgtgaaaaatatgaaaaaacaaggtgcagttgaacaatcctcttgaacgatgccaagctaagaggtctctagtagaaagctcacagtttttttttcaattctactttaatcaacacttcactcaatacactgatggatgacttcaaaggtttgttgttttgaggtaagattcttaaaatgagcacattacatagttgaaaaggatcactgatatactgagtggcaactaagtcttagaaaggtcttgatagactaggattattggatgagtaactttataaaaactgctttatctggaaaaggataatgtaaatccagcgctgctgagaaaggaggcgtagctattgataaaggctgggaaattttcatgaagaaaagcacagtaagaatgaatgacatgttaatgttgatctgcccagagctggggaaccaggatgctgtacggcccacatcccccttatcacatgggattggcaaggagctggagacatttaatatagtgaagggaaaatatcaaattgtcttcagtcttaaaaaaactcttcccagcaaaagggagcagatgtattctttgttgtttcagaagatatcatgaactatgtaggagttatagggaggcttatttcaattcaatataaggcaaaagttatatcaactagaccttttccaatcatggggctgccttacaaagagcgggccagctttccagtcaagtttaggcagaaacttgtggctgtctgtaaggatgtattagaatgggtgcctgcatcaattaagagatgggactacatacattttctggccccttctcatcttaaaattctctgcttttctttaacagtacagttggtcatctgtattctcagttctgcattcttctgactgcacagaagaatcttctagctattaatgcatacagacaaaagcaagttatcacaaattttgtgatcctgcattcaaacctcattagaatagaggcccatacagaaaggaggtcatatcatttcacaatgctttacatgaagcaattgtttactatctctgatttgtaaagaatgaaaaattggatgtcaggagcaaaggattttcttcaaatacaatgtttatccatgctactttagaggtttaattctctactgaagttgcatttacataaggtattagatattcttaataggatttttcaaggaactcaaaacattgcattggagcatttggggttttggaatttctggaatgtgccacgtccgctagttcccagtttgcagagacaatatggggtgttcatcaacactgtggttcacacgacagctgtgaagctaggctgctggcattggaatcctggttctgtaccttttaatttttgtggccgtgggcaagccacataaatgctccatgcctcagtttcctccttataaagctgtactaatcagtgctggctctgacgatgatgccgatgaatcaccaggcctaagctagaccgatgatacgctattgttccaggcagtgtatttccctaaaaaactggagaccatctcaatttgtgtccaatctgatctgtcgtagagccctgtggttttatgatgcctatagccttacataaagtaatttggtcaacagtatttacagagtgtttattttagaggaattaaaaaatgactacggaagagtgaggcattgcccccacatagccaacatacactttaccaaaaaagaagcaaacatttaaaaatgaaatataatgaaatattttgaaatacactaactcataaacatcctttaatttttaaaagtatttaagtatggatatcatccataattccttttccaaagagcaccagtgttaactaggttataacatgaataggagcttcttggacagtgtttgctttcataaaaactatgatttccaagtcagtgaagaggtattagtttgggcttacaagctggaaaacagaaacagttttgcaagatgtagctaaacatgagatttactttaaaatgcatttactcccagatgcagttgagaaagcataatgtagaagaaaactagaagttatctcaaaataataacaataatttctaaaacaacccaaacgtatagtttcatagtttgtaaaacacttcgaaaaaataccattttatttgtgcctcacaacaatgatgtggggtgggcattaacctcactctaggaagagaaaactaaggctctgcatagctaagaagcgtgtccaaggttacagaggaaatagacatcagagatgggatttttcaccatgatctcatttcttcaaacctggcattctaacaaagctcatcaaattaagtatgaaaaaatgaaatcaatactcatctgatatagcaattttccatcagacaatctcagaattccaaagtcagagtggatttattcagatgcccattattgctatttctgcctgcttagaaaccagcccctcttctagcagcagcggcctggctgttcatgggaggaggtgcctccttactcctcagtccacattgttcacatggagctaaaaccacccctggtgtgggacctctgtcttgctaatcaatctgtctgtctgtctgtctctctctctctgtctctctctctcacatatacacacccctttgcaattagctcagggaaggacacttgatccaatccaggctcactggaactgatggaacgtaatactgagactttttcttttttgagacagagtcttgctctgtttcccaggctggagtgcagtggtgcgatcttgctcactgtgaactccgcctcctgggttcaagtggttctcatgcctcagcctcccgagtagctgggattacagacatctgccaccatgcccagataatctttgcatttttagcagagatggggttttgccatgttgcccagcctggtcttgaactcctggcctcaagtgatccaccggcctcagcctcccaaattgctgagattacaggcataagccacgatgcctggcctgggactttttttttttttttttgacactcttggaaagataggttctctttcttgtaacttcaagttaaacagcaatttggcttgaatctctccacacggagagggaggctctttgggaaaagagccaacacagaggacagcagagccaagagaaggagagccagagagcaatgcagcaaaacagcacctggatccaggactcctgcccttttctgcttaagccatcttgagttggattttttgttacttacatgcatctggaaaagtccttgctgataaattactttaggcctatacgcacagaattaaccaagacagggccacacaaacagccctatttctactagatgttaaaaaaccttctttttattttttttaccactggaaaaagaaagggaagaaggagaaggagaataagaaccagagaattctcctacccttgaaaatttagcaagggcagattataacagccaaaactgacctgtggacccaagaactggactgcatgtaataagaaacattctgaaaatttaacaagtggaaaaataacctgctgggcctctttgtgaacaagctgctcaatgtcaacaagcccaaggcaccactaaatatcacaaggtcaattccactgaaatagggtttttatatattgtcagattttttgtttagttgttttgaaaacagaatattttctattgatatcttctttttctttttttaaatccatggtctggttttaactgcaaacaggacccttggttaagcaccagcacatggagacaaggtggagacgtcagagcttctctagcaaaacgactggaggtgtttagggctgacgggtctatcagaatcaactctggctaatttgccttcttgatgaccttgacagggaagaaaacaatctagacctgtaagatgagtatcaaagcctgaaaaagaatccatctgagtgattctcccacttcttccaattatttgttttaagactatagtacagtattcacaagacactaatcatattgacattagtgttgcccaaaagacacttaatcatactggaatttctaatcccaaagttgtctcagatagagcagggtgtatttgctaaaagaaaattaactgaccatattaataaaaaaggtgtacaatacatcaggtttaaattccaagtatggaagcgctattttccacttttgtgttggtcatagctggctagtggcctagagttcttggcttgaaatagggcacagatatcatcaacattccagatgatctctgaagctcgggtgtcagcttgtcaacttgacgagctgtcaaatcggaagctcctgacggaagagcttattgagtgcactcttgaccttcttttttggttatgtatgatctgtctgtgcttaagtattaagagttgctctttagaccttcatggaaggaaatgttgaaatcatggacaagctgagcctttctgagtagtggctatgtgatgaaaatctaaattaaatctaggcattaacttacggacattaaacaaaaaatctgatgtgacacagtaataggaaaacttgtttagtttggggaaaaaaacactctcttttctttgagacagagtctccctctgtcactcaggctggagtgcagtggcaccatctcagctcactgcaacctctgcctccagggttcaagcaattctcctgtctcagctctcctgtctcagctgggactacaggcatccgccatcatgcccagctaacttttgagtctttagtagagacggggtttcgccatgttggccaggctggtctcaaactcctggcctcaagtgctccgcccgctttggcctcccaaagtgctgggattacaggcgtgagccacggtgcctggccaaaaaagccactttccaaaatgctgttcctttcttggttgtgctattttctgaaaactgattctgtaaattccagtaatgccagagcagtgggtagaatttctgggaacaacaggcctattctctcaggaaaagtatataagaggagaagttactgtcctacttctttcccagacatggcaaagtgtttgcctcatggctttctgggatatccatgctttttaagctaacagttctgtgcacaatatatttccataaagttccaaatttcacttaaagaaaaaaaagccctctcacttgatattttatctaacaatgttacaataataacgtgttattaccatatgatattttttgttacaattttgtaacctgaattggtagagaaatatggcatccattctctgctttccctggctttgacatcattctacccagatccctctgcatcgtgatatatgctccttggcagatgatgtgtttacacaattaaaataataaaagaaaaatgcaaattccattctcaatctacatgctaaatatgggtaacactggaacaaaagatggtctttatagaatgctacaaccaccggagcacttgcccttcaactctctttgtcattaattggcctacaatgagcagggacctttgaattagggactgacaggtgatgggtctgaaccgatagtcatatctgtctatatagtgctttacagtttagaatatgctttcatataaattatctgatacatacaggcctgagaagcagacattatccacattttaaagacaaaaaaattgaaattcagagtcaccacataactcggtccaggtcacacagccagaaagaaaccaaatcagaattccaaccgaagaagccactaagaaaacagcatcgactatttggagaaacaccacaagcaagaatttgtttgtagacagagttaaccccacacctacctacaaagcttttcacaaacatgggagacaggcagcgttctgacacactgtgcagggtctctgctgaaggatcaacaaataaccagtgcagttttgcatttaaggatttcatggtgttaaccacgagttgattcaatcagtttccactaaactactgtgattttctcttctgcttgctgtgcccacataaatggaatctattatggcacatgagaaattagtatttgttgaactgtttttaaaatattttatatcattttaatacagaggcaggcacagggcatcagggactatagaagaacaaggatagggttaggcaggccagggcttgagtcccagctctaccatttaccagctgtgaggccaagcactcaccctgtttggcagatgtgcacataggctcttgtgaggattaaataagatactgcatgtgcaatcccaggcatgaacctggtcacagcagtgcttctgtatggctcagcttctacttcccttcctttaataatatcaaaacaacaaaccttggaagaactaaaatgtaatatacaaaatgctttcaaatagagaagtaattgacctagttgtacttattaatactatttagattgagaaatattaagcttgcaactgaattaattttctaataatttagaaaaagtgtctttagtgcccccaggtaatactgcttttttttaaatcttaggcaagagcattcaaaacataaagattttatattacacactattctcactaatatttaagctaaagtttatgcaaagatatgcatttcttttactgttgagaagcctttgttttgtgaaaatacaagtactatttcattttctcatacgtttttctgtaaatggaagccttctataaatggcttaacttgcagcatttggaaacttttttttttcttgcatgagtttggagaatgtggccttaaccttattcattccatcactctcttattgttcattttaagggtacttcgacttctaaatatcattcaagaaaacttctgaagactgcaattaggtcctaaatactgaaaatattttcctccttctgatatattttccatttactatctcatttccacataactcagaattaaaagctgatctgccatgtgctgtacacacattaatagtgtgtaggacaccttgtttgtgctaaaatgagataacagatgtcaaagtactttgagaatttaaaatcactatgcacattaaggtataattacacatatgtgaatgcaacatttatttattaggggtgtggaaattggggagtgtttcagaacttctgggctaatgagtccagtttagaattacaggctggagaagctatgttttcaacatgataggaaacccatcattcagatgtatttatatcattacattcagttcatgctgaactcaaattttgtttcttgcatattcatttaaaataatttgatgccagagtactgcttatatcagaataatagcaaacaatactcacaatatttgcaaatcccctgtatcccaagacaggtattttaaatattgtttcaaattgaaaaaatcaattaaaccccattctagtgttttattttaaatatctgccaacaaatttaacaggtaaaatggacattaaatttatctcaatttaactttaagcattgcttttccaagttaagcaaagcacctccaaacatctggtaagcagacctcaagaaggcaaaactcctaatgaattattgcggccaccaagaacttaaggtttctggcccagggctagaattccaaatcactctaatggtagctcagctaaacttgaagtagaggggtttctaagaacataaatctgtccaggtgattttctctcaactgcattctcatttcttttagtaggtaagaaagaaagcctgaaggtggacttttgcattttagtgggaaatggactggttaggcaagcattaaccaagctacagtaagcttcttgggagaaactccttgggaaagaactggaggaatggagctccaggttggaaggaggtataactggctgcttgcttgcaaaaattttaattgctaattcaagtctttaggaagacccaactcgattgtctaaacacataacttcaggggaaaaagtatggtctagagagatatgacaggtttttaaaaaagtatataaatttcaaaaagtattacagcaaatgaccaaaaataaggtagaataagaaaaaaacaaacatcaattgagtagttgagtggtgaaaagtcacataaattgaattattcaacaacaagatgacagagtatttcatattttgacaggttaaagcagtatttttaagaggtatgcattcattgctccatgggttttggccttccatactagcgatcatgctcaaaactgcaattaacaccacccagagagttgcagttccagaatccctttttctcattgatcagattcctgtggtgtcatctcctattttctctgcagcagaagtgctgtattgaacagcaggcttttagaaagcttctaataagctcctgatggctgatggagcctgtgtgtctagcagtcactcgatcatcgttagtactccacatgaggggaatgcatgcgtgcacaggtgctctagttcactacgtcccatcagcctgcttatctcactctgttttctgcttttaggcttttttcacctggccagataaaagcccattccattttctcaaggcaagacaattctcataagggatgcatttctgattggagtgacccgttaaaagatttgtgctatttggtactactgcccctgctttcgaaaacctcaggcagcatgtaagggtgcagtcttgctaggccacctctgagtgtttatacataggtagaagggtaagtcgttttttaaaaaaaccctgcagtatatggagaaatttcataaattatgtgagcagctgagagaggtaattctgctatactgcggttgacacagtcaataatagctaatgctcattaaagaactatactcccttacccagggaagaaatgggctcagaaaagacccagttcatattaatacacaaagacaacatggctcaaagttaaaacaaaccacatctctgaaatgctgtcattagagaaatttaaccacatatgtgactcgaaaatataacaagtaacgaaataaatgaaaagtttggggggaaaaagctttcagatgccctatttaaaagagcaccagtgaaaacagtaataaaaattaaaagacaatacctagcaacagagaaagataaaattattcttatttctcctatattttccatcccctttcaataaaagagtctccataatcccaacattgccattgcctgcacaaagaacccagagaacaattcaaaattaaaggagctgaaagaagacacagtatcccaggccttctctccccaaggcatctgcaggcagaatagccatggtttccagaacattctcatcacatttgtctctcgtgagctgcagcatacaatgtttaccagaggctttaaaaataaaatctcactaaacagttgagaaaaatatttaacaaccaaggcaaagcaattacagtcaaattttcacctcgagattcccatcttaggtgtgggaggcagagagaagactcctgcacatcagtctgaacctagaatgaggatgaaaagagttgattctgccaatggttgacaacaaatccatatttttgaatctcagggtgaaatgcggagctacccgcccatctgaatgtacattaagaacagcgccactgttcggttaaggctgactcaagtttctaagcagcaatccgaggacaggctagacatgaacatccctactaaaaacatggaaaggtctgaacgtgacagatctcccttttcaattacttgtgctagaaagcatcatcattttcaactagtcaaggtgacaatatgagaaaacgcaactagtcccagtagagcatttctgtatgaatgtatagacttgggaggaaattaaccacatcacacagggttaatccttccccccaaacttctgccccattatccaaccaatttacattttgtaatctagacttttattactcattttcattatgatttgactttgacactatattattcccttcagggcaaagactttctgggtgcaatgagatcagacataatttcttcagcaggaatgcataacaaggacatgtgtacacattccattcccagacatttctgtctcggtctagttcagatgagcaaggaatgaaaggcggggcataacatggtataaattctagttaggcacggacaataagcatccataggaagctactgttcactattaaaaggcattacctgatatggttgaaaaatatcacaaaggcttataacaccttacctgagccatctgcctctccagttttgatcggggaatatcatcaaagtagttttcatttcttctcctccttgcatcgccctgcatgataatgtgaggaacgtctagggagccaccagtggtgtaagtgctttggctaagtgatggagacaactgaggaggagtgtgattaccactgggttcctgaatggaaatacatcatgaaataaataccatgttctgtggctaacctttggtttcaaaattgtgaaatactgacaagacaaactgtgggggtggggagtcgcttttgaagcaacagccaaggaatgaatgacattccaccactttattaatggcatgatctagtcaatacgtttttcccctaagtatttcaggtcaaaggtctgaaatatcaagagtcaggttctgttttcctaaagcagcatcatggatggtctcaggagggaggcacacctatgttgggcacctctgacactactgcatgtgtttacaggggaggaactgggccctcatgtgggcagagcgtcctcaccatggtagatgccatgatgagaaagctaaaatgagacccaatgggtcttgatccttcatcaaagaatggtctgacaacagggttgggaagaggacacagtacggcaacacagcatgtcacacgcacagactgcagagcagtgcatgctacgacagaggatgcttttccaaggcaaagacaactccatccaagggaaacgggtcaggaggaagatagggggcatagacagctcagctctactatttgcaagtagaatgaggattgggatcatggtgtttctccagatcccttctcctccggatattctggaccttctatgatagatttaggtcctatacttttgcatggaaatctctgtctttgatctttttttgttcccctaaatctcttccagagagccagaatgagaggttcagaaggggaaggaaaaagagcagggtaagtagcaggaaatgactcctctaaagagtcattttagggtgactacactgatggtgcttatatctttctctccttccatgtagcaaaatgaaggcaaaacaaaaatcttttttttttctaatttatttgaggctcctctttctaaggggtgaaatttctatttgtacttttatgactcccaaaactctcaagtagcctccaaatatcccagtgtaccctaatgcccccagtaattaattaaaccagtattcatgtagtccctacccatcccactccagtctctctcaggaggctaagcttgtcctcctggagccaattctcttgcatcccctgaaatccttgcgcattttcctctccaaagctgaatcaactccaaatcctaacagctcctttcctgtcctgccctctgttatcctgacagtggctatgctgtttgctgaagtttattgataagaggcagcccactgcatttcatcacgatggttacgtccgggtgccgtgcttgtgttcatctcttcagaaaagaaatcagaagcaagcaagtgcaggacaaaatagagagcagagtgggcaccccacagctttcagggagatctcagcttttcgacgaattttagaaaagttcttgtaggactcatgaacaccagtgactgccggccacttcttgccactgccatttttgcctggaaatcatctttctcacttcctctctgccctttcctccctcccttccttcacttcctctttatttctctctcctttatacaggttctctttagtttcctacctcataatttttttttttttttttttttttttgagatggagtttcactctgttgcccaggctggagtgcagtggtgcgatctcggcccactgcatcctctgcctcccgggttcaagcgattctcctgcctcagcctcccgagtagctgggattacaggcgcccaccaccatgcccggctaattttttgtatttttagtagagtcggggtttcactgtgttagccaggatggtctagatctcctgacctcatgacccgcccacctctgccttccaaagtgctgggatcacaggcatgagccactgcgcccggcccctacctcataattctaaagtgtagttgaataaaagaaatacaatttattaagtaaggttttagattctctattctgaatttttgaagtgagtaaagctggacaaattttacttcttgaaaaacagaagaccctaaggttaattttaaattgatctttacttaactgtggtccttgatcaattttctttctgtgggtttgaggagtctgacagaaaacccatttccgctctcttggcgtagatggggtgtgggatgggaggtgagggagtggttctttaaaggtagtggtttgtcaggctgaattccattatagatggatatctaaatctcaaaaatatatatttaaccaatctagaaaaacaaatcttgttgttttgattgtgtcaaacaatcaaaagacagattgttttctacacagatatggtaaacttcatagaaaagagccagcacttcctgatctattgcttcagttgtataaagtgcacgtttataaaacctataaaactacataaaataattcttttattttcttactctgttgcccaggctggagtgcagtggtgcgatctctgctcactgcaatgctccgccttctgggttcaagtgattttcatgtctcagcctccggagtagctgggactacagacaggcacaaccacacctggctaaattttttctgttttcagtagaggcagggtctcaccatgttggccaggctggtctcaaacaaatagttcttaagataagggcagagaaccagatgaatgtgcttggcacttaccctgagggtgatggaccgagggggcttctgtgggggatcgtcgtgcagcctgtctcccagagatgccaaaatacgtttcctgtggccaatcaaattgatttttaaaacctgaaacaacatatatttgggttaaatatttcactggagaacaaataatttttatatgtcctaaaacatgtggggtgaaaaaagatttgtgcaaagttactcctgcaccatgagatgtggtgtcacttcagtgtgaccgctgaagtccagaaagattgcagtagcatctggaaagcctggagtggctaagtatcaggggcacaaagagaagggaggatggttctccttccactcatgctgcctgagagcctcattcccaatgcagcagcctcaagagaaaccagctcttcttataagcagccgaaacctcacaggataaaatctgagtctggactcaggcttcagagggacaggctgccctctgtctctttccctccatccaggatatgcagtcatgccagcctcctctaggtattagaagctccacattcattctcaccttggggcctctacccctgctcaaccacctgcctggaatgccccctctcccctctgagattttcaaataaccagtgacttctcatggttctggacactgtgctgctgatgtctcctcagaaaggtcctcccccgcctccttattgaagaagccatgccctcaacccctgacatgctctccacgatgatccatcctcattttatcacactctaaaagcactttctttacaagcttagtgtttgtgttttgttccaccctctccaggtaagctccctgagagcagggcactggcatatgtagagcactattatttcccaaaagcataaaaggatgactaaaaaaaaataagggattaatgaatatgaaagaatgaatggtaatagagatgggagttgcaaaattagagtcatcttgcataaggatacagttagaatgaaggactgcctattggggtagactcagagcctccccaggatggtattttgaatctgaccatgctgcaaagggcacatggtagaagagctctcaaagggaactgagaattgcagcgcctcaatcctcagccccattcccggtgctttaccagggccacacccctttcaatcttcccaacttctctatctggaaggagttctcacttgacagatgaagaaactgtggttccgagtggttaagtcacctacccaagagccagcatgtcgtggctctgggatttgaatcagatttgcctgattccaaagcatgttttactccaaagtatacgtcacaaaatttgggcatttctccaaatgttaccagcttcttaaaaacacattgtatattcatccattcataaaaatgtgtttacctcttccctacctatgtgtagtcccaggatataataatcttgttgggtaactagtttccaaagtcgttatcccatgtgtacatttttctcttctcttttcaagttttaagatagaaggtggggagagcgtttctttggcaggcatcccatgataccttgaattttttttaaatttcaacttttaatttagatgtaggtggtatatgtgcaggtttgttacatgaatacactgagtgatgctgaggtctgggatatgaatgatcccgtcaccaggtagtatgcatagtacccaataggtagtttctcagcccttcttcccttcctccctcccctcctttgtcgtccccagtgttcactgttgccatcgttatgcccatgagtactcaacgtttagctcccacttataagtgagaacatgcaatatttggttttctgtttctgcgttaattaacttaagggtaatggccttcagctgcatccatgctgctgcaaaggacatgatttcattcttttttatgtctgtgtagtatttcatctaccttgactttttatttgcctatttgttggttaacttacgggccttttggcctaaactgatgtagattttaaactcacactacgccctattcctttgacagccaccctctgacccatgtctgttgatgatgaggagggtaaatgttagccaaggtgaatgtccccatgcaccatatccctatgattttataaaaccttcatctccccaggctgattaatcctaatctttgcaagtttgttttcataaagcagctcctcttttccataaatcatttcagttgacatcctcaggactttctcctaccctattatagctgcttaaggtttgctgaaaaaatggctcacaatattccaggtgtaagtgaaccatggctttacatttatgcaggatactgttttctgcttttaatacccgtttaaaatgtccttcctaagcacacgtgatttctagctagccttttagctgcagtaggaataaccagggacaaaagtatacactgactataaaatcccttaattttgttatagctaatagttcaaagccctttaatctaggagggatgatttgagttatttttccctaaatttcttatcttacagttgtccaggcagaagcccatctgccatccttctgcccactcacacagccctatgttagctttttgcatttatattaaccagtttggcatttcactacctggaagagcttagtgatttttgcatatctggaaatttcactatgtattcctttcagatgatttataaatatgctaactaagtgtggccctactgctgattacttgcaggcagcattgtttatacgatccatagaaatgcccttatattcttgtattgtttctgtttttaagcatcaagaccaaataattcctccatctcagaaaaaatatgataaccttttcaaaggtattttgcaagtctaaatacagcatattttctaattctcttttattctcatcctcaattcctttgccaaaggcttctattggatataaattcctcccataaaatcttcaccgcctttctcccagcaggtagctggacctcatgctgatggtactaccttgccccctccctgagtcctgctagaaatgttttttataataaagacatttgcttaattattattattattattattattattatttacaaaactgacactaaataacacataactgtggtacaattgagctgatgtaatccccactattgcttttggtttactctcccacaactcaattttgggcaggttacctgactcctctgatctcaggttttctcacatataaagtgaagaagttaatgacaatttcaaatgtggttgggaagatgaagagtaagttgtgagaataaccagcatagtgcctgacacatagaagaagcaactttcacagtgtgcttattccagtgaatgggttctgagggtgcacaggaatcctggcccagaagaacaaggacttgttcattgtcataaagtcaatcatgttaaacaaatacactggagctttggatgaagagatgtggctaaccttgggaaagccctcaatgaagtaacttatcctagtaggaacatggctgatttctagctattagtctgaggccagacccaatttaaaagaatatgctcttctgccatccacatcgcttaatcttcaataggaggtaagctgaggcactcctctgcactgaagcttcattgctgtctcctccatagagctacccagatgagggtggacggatgaatgaatggattgatggatagatgatagatgatagacagatagacaggaaacgaattaacacaggatggttagtactatcaagatcacctggataactctcctttttatcagaaatgagcccccatcactgaagatactgatggtaacttccatttactgaacattttctatactctagttctatgtcctagttgtgctagaaactaccaagtggttatacacaaatataaatatctcctgtaatccttacaatagcatacaataaaaccattctcattttagagatgcaaaatctgagattatgaaatgctaagtaacttgcccaaggtcacactgctaagaggtacatggctaggatgtgcacctgattcttaaccagcccttcactactctccttgctcttcttcttgctgttaacctctataccttttgacctttagctacactattggttatgtcatcatgaggcttcttaagatgttgcttcttactttgagttatcatgtttaaagcatttatatagggttttgagcatctgaaaacattaaaataattcactttttagtaaggcttatagcattgttaaagctacaggctacaagggcaggtacctcacagtattccctgtgaaatacacatatagaccaaggacaggaaaccctcatcacccaagattcaatccgagctggctcactgtggagtggtagagagggtgacagtgggcttcaaaacgcccaagttgacagtaagaaatccaattggcaaaacaataacagagagaatattccaaagaaagatggtcattatggaaaagtcaagtctgaaggtggctgggtttgccttgagtgagaaaggctttatagcagactgtctttgcaagcagatggggttcctgagtagtggaatcctacaaccccaggcatcatgggtgataaccagtgtgaaaactttagttttcaagaacaccaaagcaatggttactgcagtagagaagaattctgtgttttcgttactgtttgggttaaagttaactgttcagacaagaacataatgggagtaaaagacaaaataatggtaatatattggagattcagttattctaagatgttgaagcaattcagttcggctcaaaaaacaatactgaatttctgctaccaattatttggaggattcaaaggggaacgtctatgaacagagcttacaatattggagagatcaggcacaaataactacattatcacaccattaactaagaaaaattattatacacataagcataagaatgtggctccaactgctgagttccaatagataagaaataaaagttggccaggcgcagtggctcatgcctgtaatcccagcactttgggaggctgagatgggtggatcacgaggtcaggagatcgagaccatcctggctaacacagtgaaaccccgtctctattaaaaatacaaaaaaaaaaaattagccaggcatggtggcgcacgcctgtagtcccagctactcgggaggccgaggcaggagaatcacttgaacccgggaggtggaagttgcagtgagccgagattacgccactgcactccagcctgggcgatggagcaagactctgtctcagaaaaaaaaaaaaaagaaaaagaaaaggaaataaaagttatggcatgtgttcttaatggtttttattacaactattgtaagaggaatgtgggtcaaaggcaaggagtattgttgaaaccacaggagtcagccacaggtgggtatccattcatcacagcagtagccgcctccaggaattttctccagtatcacttaaacaggataattccggaaaccccactgtgaatctcagcaacaggagaataatcatgctggatgacaatcctataatatcacgtcactgctgtttatgtttctgggtttggctgtgggaattctgccagacagtatcatgatatacccttacatggaatagcttacttcagaatatatgtcatagcaaagctgaaagtcaatgtacttaaacttccttttttcttttaaaatttaatgtgatataaaattaaacatgtttaaatttatatcacattaaatttaacatgtttaatttaaacatgatgtaaatgaagcatttttatctgcttttaaaaaagtaaataacattttgattataatagctatactgctttcccattttagacactttataaaatacagaaaaacaagtaagagaaccagtaatccacaaactatatctaaatagatatatttcatttctcccccatgattatgttttgtggtggtcatatcacgagtaccattttcgccttttcttcagttctttaaagctaaagaacttttctacatatacaactctcagtagacattttaactaactccatattatcacattattgtttcagagaagtatgtcataattcactaaacatttcccctatcattgaaaattttggtttgtgctcctttctggatagcaaacattccacatgcttaaataattctatcatcctacaatttccgttctcaatgccatgtttacatagacacagcatagaaaacaccaaagaagactgcaagaatcacacaagtcacgcagaaaagtcatgtagcaacagtctgtctctatgttctgcatgaaatctcaatccgtttattgccggctggaccaactcctgggaaaatcacaaacccacataatgttcctcagtgccatattttgcattttgttatgtttttggagttcagatttagctgacagatgtgaaacagcacatgtagctggaattcttcagagagtacacatgcagcgatgctgggcacacaagcgattctagttctcaccaccaggcgactgcatcctttttatttctagattgttattgagggagggagttcatcctgcatttggaactcccttccattttagggggtagattatttcccctttcctttctagatacttggccaactaaagagaacagctcctatgcaagtctgtagagctcacctggcttcagagtagcctcttctaataaaactgcaagtgttctgagcagttctggtgttcctaaatgccaagaatggaagttgcggtggaaactgatctgctttgttctcatctgcagaactaaaattgcaaataattgtcaaagttttcccccctgcctgataacaatttctaaacactttccacctgaaagcatcaaggcaaaagtgcctgtgtaaaattccatttcgaattcctgcaatcttagaaatcctcacttgaacttgcatacagttttgaccatgacatttttctctcttatttcttgaactgcaataatccatgtccagcatgggatggtgaacagaaagacctcaggagcagaaagtcatgacatttggttcttctcttactcttcttctagctaagtaatctttaatgtctttgagttgtaatataaaggggacaataacagtcttattcaacaaatatttcttggatgcctttcacatataaccaccatgttatgcaatttgtgagccacaaagaagaaaaaatatcgagtcctccagggctctcaatccaggcagtaaaaaaatattaaaaccatgtgaacgtatgtgtgtgtatatttgtgtgtatgtatgtaggcatctatgtatgtatgtatgtatctatctttctatcatccatccatccatctaaatatatacgtctacacagccttcccagcctaaaaggggtttctgtggaatgaatgagaatgactaggaagcttatctggaaattataaagcacagaactaaggtactaactaaggtattatttctcttttaagtataacagaaacttaaaactttcttaccctatcaacaatatttagatattacctttgatatttaaatgtgccattatggatatctctgggtagattttagatccagaatcatgccttccacttctccaatcttctctcctgttatttctttgctccatgtatacacacttgtgcatattccagagtgtctctgcctggattttcattagaatctcacaaggatgaaatcgagatccacctaaagccttgcttgctcaccttggattacatagacctttctctctttgaatttctttagtatctgtggtctaccctgtgctgttgacacatgatacatcctggtgggtatagctaactctcttttttttgcgtatgtgtcttacctgatcaactagactctaggcgctgaaaagtcagatatagtgtcactgcatctcagggtccctgaatgcatctagctcacgaatacaactcaaaggtgatctctaagatctcaactcaaacccctgtcaaggtggacaacaaatgaagcaggggagatgtctctaaaagaaaaagagggaaggaaaataacacctatgtcttatttcattccgtttctactctcaagagtcttctattctttctgagctttggcaccttaattcctacacacagtcttgccacgggtgatgcaaaacttccttacatcccaccatctgtaactctttccctttacctctgccacttcatctaaaaaaaatccctctgactacagtttccaaattcccttttccttctgctattactttccaaaccaactgctactaaataatcagcaaataactgtttgacagatgccaccgaaatacaactgtactaacctatggaaaggaaaagaggttccaagttatacagctccagagagagcaaaggatagtgagaaagagcgagggaggaggaatgcgtgttttctgaatgtagtctgtctcattaaataggaaatactaattatgaggaaatgagatcatctttgcatggaaagagagaccttaatggtataattgcctctgaacatttaagggctctggaggtacaaagccttcttttgtaatcaatgagaatcttaggtttatttgtaaagctctctgaattacctcttgatgaaggtactaattttctgattttcatgtaaacattgcttcagaagattaaaaacacacacaaaacaaaacaataaatcagttcccaactaatttccctgaaagttacttttaagtaaagcttgctgccagttaagtttttataggagaaatttggtttacattgctcaataacccaatcattggggttattgaaggaaaaatttgttacaaaagaaaatgggaagtatgtgcaacatcccagatctgaagttattcttggagatgtgaagatgtgctaatagcatctgaaaagtgcaaatctccctgcagtactatgaatacataaaaatgctctgcatcttaagaagtagagagactgctgttttgctatattttgctaaccatgcaggatatttactgctaacgagggtattttctaactttatttcctttcaatttttgagatcataaaatttatgatcaattatattgtgtgactgatgctctcagtattgtaaaggaaattatggttaccgaaattcattaacatatatccatataaaataaacagaaacacgcaacatacatgaacacacccatatttgtaaaagaagctctaagacaaattgagtctcaagagacaatcctaggtaagtgagggcctggttactccgtttttggattataagtggtcttttctgctctgttgctgctctgcccctcttcttgaggtttagctactttaatggcatataacaccctccatcagcagacagaatagtgaaagaggcagtgaattcaatccagccaattctgtttctgtcagcagctctgataaaagggttttatgtgggaggaggtaaaaaatctacctaaaactagctaaactaaagttttaaaaatgcatccacagattttacttagcctagccagctactactgcactttagaattggacatttaccatatttcagctacgtatggaggcaaaaaggatgttaaggttaaaagaaagtattataaggaaagcagaggttgagtcccaaggatgagttcaaaaagaggaaaaaaaaaggggtaacaacagtgagagagatttcttatcgtcccttttctccctttgtccccacccccaccactatccccttccttatcttctggagagtcacatcacagagtagagctaggaatcaccctaaacccataagaatggctaatgttagaaaagaatgaccctacctcggatgataaggatgtggaggaactggaactctcatcttgctggtaggattgtaaatggcacagtcacttttgaggaaactgccagtttctcaaattttgacccagttttctaacatataacccagcaagttgactctagctagcaactcctagctaaaaatgaatacatatgcccacataaagatgtgtacatgaatgtttaagcaacattattcataatagctaaaaattagcaataatccaaatgtccgatcaactggtgaatggataagtaaaatacagtatattcatgcaacaaaatactgcctaatgatacaaaggaatgggctacatgatacaggctatagcatcaacagacctcaaaaacattatgctaagtgaaagaagctgcacacacaagatgatagaatattgtaggattccatttacatgagtttctagacagcataaaactatatgtacagaaaacatatcagtggttatctggagtaggaataggagcagggattgactgcaatgagcataaaggaactttttagggttatggaaatgttctaaaatgggattgtgttgatggttggatagctgtataggtttactgaaatttacccaactgtatacataaaatgggcgattttcatgatgtgtaattaaattgcaatgaagttgtttttgaaaaaagaataatgctgggagaatgcattcagtatgcagtatcgtataaataaggccattcctgaaggctgtaatccaggctgctcgagaagacctctgttgtcttggaatataccacttatcagctggatggaagggtgagcaacatatacactgcaggatgtcttaaggaaaatgtgacctgcagggtagctttgttctaggagcctagtactatttaactataggctaatagatcagtagcatattctttattataagtgcacaatacagtaaattagtacgactttcctatgtatgtatatttttgagggtcttaatcctccaagtcataacacttcagtaaaaatgtttatgctttctaagtacttacaacaaatggcttatggatgtttgcggagtgatcactaggagccaacatgggttctctctggatgggtaacaggtggtgatcatgagatgacactcaagaaccagagaataaggttgcattctaagcaccaaattaatcacatcaacagtgctatgatttgagttttctctgacaaaaactcagctttaaattggatctccaatgtggcagtgttggcagatggggcctaatgggagatatctgggtcatgaggtggcgaatcctccttgaaataacttatgccattctctcaggagtgagtgagttcttgccctggcaagactggattagttgtcacagggatgaattagttcctgcaagagtgggttgttaagaagccaggacatcctgtgggttttgcctcttcacacgtcagcttcccctttaacctttcaccatgttgtgatacaacaccagaaattctcaccagaagctgagcaggtgctggcaccatgcttcttgaacttcctagcctgcagaaccatgaactaaataaaccttttcttctttataaatcacccagtctcagatgttctgttatagcaacacaaaacagactaggacaaacaaagcgactggagtcagaatgactttctagcccatgaagagtcaatgaaatagactggcagtgtgactacagtttaatcggtgatactgaaacccagctaaataaagaaggtgtgccagggtggggtggagaagcaagggtagagggcatattgaagcagtgaaactatctagctttggcagcagcatggggagacactgaatcttaacataagtaagctccctgattactcaaggggttattttatcaggttttgtactgatctaaatgaaacatccctcaaaattccctttccttcaataccacatgtaccaggaagcagtaattgctgaatcagttttctgagtgcccagatatgagaagaggaaatgttgaagacgggggatcagggaggggagcatttggtcagagaatccttcccatcatgtattaacagaatggacatcttgatacattgatctctccttaattaaattaaatccacaccaccgaggcacagaacctgctcaggagggcatagtgattaagagcagggcttggtgtcaggatgacctgagtgtgagtgttggtactggcatttactctatatgccttttggtcaattacttaacgtctctcagtatcacctaacttgtgtaaaatgatggagctaagaaacagtattcgcctcttagtgtaattgttaggattaaatgagacatatgcaatgcatttagcacagtgcctggtataaaatgagcttcataaaattctaacttcattcagtgttttgattaagcccagtttctgaaatggaagggctgagccctcccctggaaccccaccagaaggagctcagcagccagccatgcaccttttccctggcaacaatccctgcatcatcagccactcttcaaactttggtggcctcattgaaaatcagtttttgccaaactttattgactttctttttttgacaggtattagtatgaggttgacagaccaggagaatgtcatagatatagtgtctttgattccaataaagcacttgatgaagtctttcattatctgcaagatggtgggctctatgagggaaaaattaagtggattcacagctggttgtacatctatagccaagaggcttgatgaatggctctgtcataacctgttgggggaccactgattgaatgccacaggctctgcccctggattctgctctattcaatatttttattaatggcatcaaaatagacataagaagaatacttatcagatttttcaatgacataaaactgtgaaaaatatttaatataataataggctaatgtaaaattcaacattctctcaacgggctgaaaaggccaagctgacaccaaaaagatgcaatttaacagggataaatataatgtcttacattaaggatccaaaagaaatcaattgttcaagttcaagatgggaaagatatggctgtgccacagttcaaagaaatagctgaatttttagttaaacgtaggaaggggtttagcagaaagaatgcaaaagtatgggtctaatggggagggaatgaacccatttagaataattttaccaaataaataatctcatttaccttgctattacaacctaacaaggctggtaattaccttaactttagaaatgaattaactgaggttcaggaatttaaggaacttgtcaaagtgatgacaaaatcaggatttgaatccagttccgacttccaaaatttgtgcactttggattcattctatcttgctgccacttctctcccagagatgctgtgtggctcaagtgagacaattttaatggacgtacctagcacagtgcctggctcctaccttctgctcaaaagtggctgattatttttctcccagagactcattaaatgtaaggctgggtgcttatatgaacaaccagtactttattattataatatgaactctgcagtctattctaagtcttttcaagtttatccattaatatacctagtgcagaaatgattctgttgatttttattctctcattcaccattatttccaaatccttaatgccagaagaggaagtccagcctggaaaaggcactggaaaatttgagggcaatctaaaaatctctgtcagtcagtaatgattcccagataattaaaacttttttttttttttaattaaggtaactttcaagggctgcattagtggttcaatgctgcgtattaacatgacaaaaacctctattacctttagataatgaggtggtgtgttaagtaaccttagtacaatgatatgcatacagaatgtacaaaattttcaattaattcaattatttaattagtttagcttatggttaaaaagatacttttttttctgttgttggaggtcttattagaattcttcatatatatatatatacacacacacacacacacacacacacatatatgtacacatacacacatatatatatatgtatattttgttctttcctgcctaagggtggtttattgacagtctttaattcttccctagatatctggaatactgcattgcatctgagtcatgctctgtgtagactatttgtcactgggccacagtgctgctgcaaaaggtggctgaggaatgcacactggctccagcagtatcctgtaagatttagctcttttaaataaaggaattcttaggagcagttagttttcattgcctcttgcactaaaagcaaggcctgacaacattagctatccaaaagttccagttaatgaaggtttcattgtaaaaaagaatccatttgggggaaggtgcaaactctttgtaattttctctccctctttctcttggcctaggccagccatggttcacaaagctggagaatggagaatcattagctgctgatggtgctggtcatcccaccctggcaaggaaaggaacaggtatgttgagtgaccaggttgacctgtgcagtggatgagccgaaaacctcttttgtaagctgttttgtaaagatatggagacaactgatgattctggaggtggaggatgctttgagggccagaacacacactctgcaataaagcaggtcacttccttcaggttttaagctaaaatgtgaacacatcagtggactttcacataagctgtgctttctttctggaatgtctccttttcctcttctccatctagtgaacctctactcatcttctactctttcgagttaaatactacttttgaacaaataatagcaaaagaacaattaacggcaacagaactttggaatgacagttatcaaactagtcctgatccataaacaaaagtctacttagcacattgtgtgaaaaaatgaagtctctttgtttttattttcttaaaccactttattccagtatgactgacatgtaaaaggttgtacgtatttaatgcatacaacttgatcaatttagggataagtacatacacatcaaaccatcaccaccatcaagactataagcatacccatcagctcccaaattttcctccagctcctttcattattattatcatcatttttgtgtgtgtggtaagaatacttaacataagatctcctcttctggcaaattttaaatacacaatacactattgttagttactggaactatgctacagtagatctctagagcttatttctcttgcataagtaaaattttctatttaaccatcacctttccatttctgcccccagcccctggtaaccaccattctactgcctgcttttacgggtttagctatattagattccacattgaagtgagatcatatagtatttgctttctgtgcctggcttatttcacttagcataatgtccttcaggttcatccatattgttgcaaatggcaggatttccttctttttcatggccaaataatattccatggtatgtatacactacattttctttattcatctaatgatggaaatacagattgattccttgtcttaggacattgtgactaatgctgcaatgaacacgggagtgcaggtatctcctcaagatcttaattttttttcttcttttgagatggagtcttgctctgtcacccaggctggagtgcagtggagagatcttggctcactgcaacttctgcctcccgggttcaaacgattctcctgcttcagccttctgagcagctgggattacaggcatgcgccaccatgcctggctaattttcgtatttttagtagagagggggttttgtcatgttggtcaggctggtctcaaactcctgaccttaggtgatttgcccgcctcagcctctcaaactgctgggattacaggcttgagccactgcgcctggccaagatcctaatttaaatttgtttggataaatatccagaaacagaactgaagaatcatatggtgggtcaatttttaatacatgtttattttgtatcaggttgcaaatttgttgatcaaaattatgagttcaagatgaaaaagtgaaaagtagagcaatgctttctaagaaatagatactgaatcatcaaatggaaaagtaatatccccacttgctaatttaattcatcataatttacaagtctctaatgaaaaccaagcaacaaacaatgacttagtatttgttagaaaacagtttaatctccagttgtcactgaactcattagcaacatatgtcattcacacacagtgaggaattattaatttttcatttcaagaaaattgtcaaattaagctggatagaataacaacatacaataaaaaaattggtaatttattcttatattgccctagaatgatgatagtgtgtggcatgtcattaattaataaacataatattattcacatagtgggcccttgatatccatgaaatgtgtaattaatgatgaaaatgctatagtgttactatcacacttactgatcacatcgaagttttttccacccacacttaaattaaatctccctgaaatccctggttcaaatttcatgagattcaagtaatttgtgatttttttttttttttttgatgcggagtctcgctctgtcgcccaggctggagtacagtggcatgatctcagctcactgcaacctcctcctcccaggttcaagcaattctcctacctcagtctccagagtagctggaattataggtgcatgccaccatacctggattaatttctgtgtatgtgtggtttttttttttttgagacggagtctcgctctgttgcccaggctggagtgcaatggcgtgatcttggctcactgtgacctccgcctcccagatttaaacgattctcctgcctcagcctcccaagtagctgggattataggcgcctgccaccacccctggctaatttttgtatttttagtagagatggggtttcaccatgttggccaggctggtctcaaactcctgacctcaagtgatctgctcacctcggcctccccaaatgctgggattacaggcatgagccactgcgcctggcctgatttgcgatttttcatgaagaattttttaaaggccaaagttcatcctcaagataagaaaaatgattgtttgccatagaattcttctaatctcaacttttaaaagaatttattaacatttcaggtcaaatgcctcaaatgttgaaatctcatattttaattctttgagatgaagtgttttccccagcatttcttttttttttttatttagatttagtcttaactcgcatcaaggtttataaaaaatgatatttctatttcatgagcatggacagaatgtgttgaagcctccctgcaggaaaattatgagcagaggtaaaaatccttgcagcattcttagctccttagctgtagtgtctcttagagaaatgttgcatataaggaatgctaattaaggaggctgggagaaaagagatgccacctttccaaacacaacatttcaaaaacaagtattactaacatggtggttttatgaagcacttgaatcttacataagtatggcttgttttttgtttcctaaaaaaagactgcatttgagcaaaccaaaacccgagtaatttaaatcatgaatttcagagaaaaaagttttgcatctagctaggaacttaataaaatataagttttcaaatactttttttttctattttaaaatcaggtacactgctatttgcaaaatctctagtcaagtagaagcagaaaaagaccgtcttaattttaaaagagtaaccctgctcccatttatgaggatttttgcagggagaaagattttataagatattcacttcaatacaaaagggcttaaattcaagagtatttaaactttgaatttcaacttatcccttggaatggcctcatggctaatttcttgtctatatacaaggtcaaatagatgtatgtctttggttaatttggactgactgccaagcaatttattaggaagctggaggatctaaattgatcatgaagacaacagaataaatgggctttgtctgattacttccgtttacctgatgattaaatcctgcctgcagaaaatttatgtgacttccaaataacacagagacagacagacaaccccatgacacactatttaaaactcttatcttcattaaatgaaaaaaaatcaatttcaaaagtaccttttgttctttatgtctttgttaaattacgtctgaggaagtaaaagagcttcttgttgccgtacttcctggtctattgtcatatatcccacaattggagactttttgcaagatgggtaatttggatatcaaatatgagaaattataagtgcctttagcagatactgcttttccaagagttcagtgtgatcttggataaaaatttgggcagatggcttcctttggaggcttatacattgttttccacaaaatgtagttgatggagaccagagaagcattgcattttttttttttttttttttttttttgagacggagtctcactctgtcgcccaggccagagtgcagtggcgtgatctcggctcactgcaacctctgcctcctgggttcacgccattctcctgcctcagccttctgagtagctgggactactggcacacgccgccacgctcagctaattttttgtatttttagtagaggcagggtttcactgtgttagccaggatggtctcgatctcctgacctcgtgatccgcccgcctcagcctcccgaagtgctgggattacaggcgtgagccaccgcacccggcccagagaggcaatttttaagatggaaaaaaaaaaaaagattctctccaactctctttgcccagcctgccaatgctcccattttcacagcacccaggccagccaagacctaaccttatgcagaaaaaggaacaatgctttaactaggcacagagttctattacttttgctacctaatatgcaaaacactaaaggaagagggcttattaaagaaccgcagcatgttttgtaaaagttggtcactgagtctttgacagaactgctacagtactacagttctaagttcctactggcagcttctattttgagagtcatgccttgatgggagctacaaacaatgcagcccacagtagtacacattcatccatccattcattccttcagcaaatacacattgagggtggaatgtgatggctgatgttaagttggttaggagcacacaaaaatgcacaggacatacttattgctttgagaagctctgggcctagtggggaagatgaagtgacagatgctcttagggagtaggttcagagtggtgtgaaaagtagggagtggcaatctctacctggggagctggggatggcctcacggaatagaagacaggcttcagggctgagaaggagatttccaagtaaagagctataggaaggcgattctacacagaggagacaccgtgtgcagtctcagacgtgtgcaaggacacaacaggacatgtctgtttatggtttcaaaattttacttagttccctattaattttgctaagggggaaccatatgtgtgagtagcaggactgggggatatgaaggtgggtcagagccagattgttaagagccttcaaaaggaatttggtcttcaacttaaacaaattagaaaatacgtgtaaagtgcttggaaagatgtccagcatatagtgtatactcggtaaatacaagctgtttctgttatgttgaagtagacaggaaaccaaccaaggttttaaagaagggaaaggatgctcatgactataatcccagcactttgggaggctgaggtgggtggatcacgaggtcaagagatcgagagcatcctggccaacccagtgaaaccccatctctactaaaaatacaaaaattagctgggcatggtggtgcacgcctgtagtcccacctacccaggaggctgaagcagcagaattgcttgaacccaggaggtggaggttgcagtgagccaagattgtgccattgcactccagcctggtgacagagcgagactccatctcaaaaaaaaaaaaaaaaaaaaaaaaaaaaggagggaaaggatgatgatggcagagttggtttataacaataattctgatgccaatattgagaatgggctgcagtggggaggcactgtccacaggccaggaaagggaaataattcaaatagtgaggataaggctcagcaattagaacttgttcattactaaattcccagggtccaacatagtggctacttgcagtgggtgctcaatgaatagttgctgaatgaataaatgaatggcaatgggaggagggagcagatctgagaaatctctaggcggcagaaacagcagggttggtgagtaccagatgtaggcgttaaaggagagggaggtttttttaaggatgactctggaaattaggcttgggaagatggtgttgccaaattctgcaatcaagtagaaaggaggaagaacagggttggcagggaacatgaggctctgggagtactactttctatgcatctgctgggtttagcctcttggagtgttgagaaaaagtgggcaagggaggacaaagaaccctcacatgggcactgagctgggtgttttcctttttactgtgtttaatccccacggactatgagtttgatattgttatccctgtttacaggtggggaaactggggctcaagatgacacattagcgaggtggcagagcccacattaaaaacacgtatctttctgccacaaagcctgagctttttccccccctccatccatcaaattgcctcctccattaaaatgaacatttggaatatgatatattccatatttagaaggctcgggggtgcagggtgagtactttgcaaaggaaccaaagcctaacttctgttaactttctgcttcatcgatactccaaatctgtcttcctcattcacagagtccctatgaggatccaaaaagatgtgagaaatcttttgaaaaatataaagcgttctataaaaacaaggtgatatcaaaaatgagaagaaaaatatgttcagattcttgttaaggaattctagaacactgtaaaagatgacagaagctggatactgtcttaggaccatttgactggcaacagcctctttccaactatggttcagggagcaggttgaggtttttctgtctttaggggtcagtcttcctaaaatatgaaaacccgggtttgaggtatggggaaagaatgaattttgccttccaaaggcagagtttacaacttgacggctttcactcctctttcaaaaataaacctaaattcctatcagttgtctgcagagttccatcagggacttggtagagtggcccctaactggggagcaggaattatatgtgcttcctccttgttctgcaaagcctctgaacaccaccgagggcccatggagagcgtgatgatgtgtctcttggcccatcacaacgtaagcatgctgagcagaggctctatcccacatcctcactgtagccacagtgtccagcaggaaggggctcactgtatgtaactacaagaactttcggtgtttgcattcttccctttgctctttaaatggctggcttcttcttcccactcagttttcagcttaggtgccacgctgggagaggcctcctgtgactgccctagttaaatagatcccccctgctactctctatcactgcactctgtcatttttcatgtggttcctttcagaatttataatcacacatttgcttgtttggttatctgtgcctccctctcaaaccagactgtaggcttgagggcacaaagcatgtcaactctattcagcccagcatctagcatggggctggcatgtggtaggcattcagggtctaactgttgttttaatgaacaaacagacctaaacctgagatggtgggacaaccgacaggaaagcagaaggccccctcagcactcgggggctgttgttccataatcaggcttcattatgatctgggaccagggatggagccgtggattggctcacatgtggactgggcccacccctctggactcatcagcaagacatgcaaaccacatgagtcaatggtccacacacagccccaaaggagaagaacacaagtatcactattcctcaactttggagtaggttccttggtctcctagttaaatatgcatggcacataaaaataattgtgcagacagaaggactcacagttgcttaatgtagaccaggaaagtgtttgaaccattcagtgggtggtgcgactcctaggggaaaccagccacgggtgggaatagaaactactccaggaaatggtactgtatggaacaatttacatattttggggcatgggaagttttggaaatgcatttgttctcctccatatctaccactgaaataaatccttgagatttaaaatgagtagatgatatttagtaatatgactgaaaaatcacataggactcatttatgagccaggctttatgcgcaatttacaacctgtatggaaagcaacaccatcccctgttttacaaagaaggaaacaagttcagggaggttatgcaagtctgttagattttaacacttgcactcccttcaccatggagccaaagcctagacttaattgtttagaatatcattctaaattgctttttgcaatgtcatttcttatgcatttcttacacaccttttaggtgccaggaacgtatttctaaaggcaggatagcattgcagaaatgctagcctccaagagatggggtgtattttccattgagaagcagaattaggggaagggtagttttacctcctcagtgtcaactgaaatggcagtcattcaacatttcactcatttcccatcagacaattttaatctgaataaagtttttaaaaatctcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcctagctactcgggaggctgaggcaggagaatggcgtgaacccgggaagcggagcttgcagtgagctgagattgcgccactgcagtccgcagtccgacctgggcgacagagcgagactccgtctcaaaaaaaaaaaaaaaaaaatctcttaagaaaccatctccttacaaattcccttcttgcaaaatacttatttttcagtaaatatcttcgttgacaattctaacaaaggtactcaaattctatatcctggctatgcctgtcaagagagttgaaggaggcagtggccatatttagagggccaaaacctgttcttctggtggtatattttgctgatctgctgatcttgaaggactccagtgccttaaatttacccacatgtcatttattgctgcctaatgtgcttattcattattttttgaaaatagaagcatattcggaaacatatttaattttacgatgttaaaaatgatcacttctggttcttcaccagaactatatggagtacctggaatacagtaggtactcagtaagtacactattaataaatgaagaaaatatacgcaggataaaataaactgtttttcataattctatccatatatgatttttaggattgtactggcttaaaagctgggactatacaaatacatcatcaatgtgaaaagctgggaaaatgggaatgcgaaaatcaaactggctcttggccagtgattttttttaaaaaaacaaggtcttcaaatgtttgtaaactgcaaaatgtccttgttgtccttctccctttttttttactactggcattgtcatacaaactttgtgtctcttccaaattagtctgttgtttgggatccttaactacggagagtgtcaactgtgcgtctccaagacaaacaggttgatgcgctgtctttctcagacctatgctttaaagcccaggctagggtcatgctctgagactagagcattctgactttctctggtctgctcttttctggtccttgattttcttatctgaatcatggggtgtccattgtttagacggaaggttgcaaatataaattaaataattcctcagcaaacaatatctttctgtgaggtgcatatatcagtggctaggaaaatatctgaggcctgctacatcatggtttagtgaataatttgcattttatgatgtatatacagtgtagctatgaataatctgccagaaattatagctatacatatataagccatacactcactaatggtaacccattctccttatttttgaacccattctcggtaccagtaatagagagctcactggctttgatttgaggcagacctaggtttgaatcctagctctaatatgtacaggttgaatctcagggaaagaattcatctttctcagctttagtttcttcatctgtgaaatggagataataccaacttcataggcctattgaaggcatttaatgtgttgattatatgcatgaagactgatttgttaacaaacagatgatttcatgtgtgtgtgcatgagttgggtgcagccttaataagtgttccccttctcttctgttttgctatttaatgtgatggtgaggagagtggtcagtgtttgtctgtctcttccttctagaagttagggtggcataagatgaggatatgggggacagcagcctcagggagatactgaataacctctgggagcctaggaggacagatgcttgacactagctggggacaaaaaaggaagagcccaaacagtttttaaagcagaatcttctgtgtctagaagaatcaataggaaggtgcatcatcaaaagaactagagaacacaaatgacagggtatgacatgagtgttcactttcattaagtaaacactgctggggtttacttaatacctggtgagagggaaaaaaagcagtattactccacaaacatttgttaaaatatcaactatgtgagcaagccatacaatggagaggcaatgattcctaagacataacccctgcacacaatgattcctgacataacccctgcacacagtgagttcttagtcacaggggaagcacacacagacacaagagggctgtgattaatcctatatgaaaggacaacatgccatggagcacagaggaggaagtagttacttctaagaagaccaaagacattttcaaagaggtgaggatattttaagcgaggtcttagaggacgctgttcacagggaagaggagatgtaaaagcattctaggccaatgcacctgcatgagaggagtgggatacggtgtgagcaatgcttggagaattgcagctatttggatactgctgggacataatgacctcggcagccaggaattgtggttacattgcagggggccttgaggctagagagagagaactgattgagcttgaggagggagagtgggaagggacccagagcacagatggagttattggctttggagataaaaagggacacatgtttctctgagtaggtgagtctgggtgttacttggataagtctagagaagaagagacagtacgttctaacagaacatgccttgttaccttcatgctctcggtgtagtgggaggcaatgtcactggttgaataaatatgaataaatgaatgaatgaataaatgaatgaaggtggctagggtagaggattaagaagcattaaaatgaatatttcaagaactatttatgggggtcagtaaatataatatttctaaactcaaaacttctaaactcaaggtatttataagctagttgaagatgtaaagacatcatacatcttttcaaagcacaggaagttaaatgaatggttcctaaaatatgaatgttcagagggaaaagtacgtttattaactgcttgacaaagaagtatgtagctatattttgtgtaacacactatggtgtagtcttatctttttgggtatgtttttctttcttaatgttaaaatatttcatagctggtccatgtaactatagttatacttttagttttactcaggttcccgataatgtttgtcgcacagacaggtttgtgtactggttttaataattccattgtactttctacctcctcctccgcccccatccccagggtcttcaggtcacagttgggacctactctatgtactctggtgctctccataagcaaatgggatgatttctctgaaaagacagctctagattatagtcctgaaaaagagagctcttgagtcaatgaaaaaatcatagtttagagtagaagagaaaggtaagtatgttcagaggaaaagctggtcagatgaatgtaagagaggcttcttttatttgttcatttaattttgagacagtgtcttgctctgtcagccaggcttcagcgaagtgctgagatcatggctcactgttgccttgacctcctgggctcagccattctcccacctctgcctcccgagtagctaggaccacaggcccatgctaccatgcctggctgtttgtattttttgtagagatggggtttcgtcatgttgcccaggctggtcttgaattcctgggctcaagtgatccgctcgcctcagcttcccaaagtgttgggactacaggagtgagccaccatgcccagtctcaagaggaaattcttttagcagagctttgagagataggtatggaagaacaggctggggttagagtatatgttgctaaggaatctgaccctcactccatgggcaataaggagccatggagcagggatagaacacttctctggcactactggaagctgtgatgtccaatgtatgctctctggaagatctaactaaacacaaccttagcacttctctcaattttctttgaaaaggcaaatcttgtgagtcatttgttctctgtaaaatgagagaggaacatacattatcaccttatattatcgatttacattaagaagacttccggattctcttagggttgttgtgtctttctaagatttcaggcaggtgggtaaatccttattttcatggattttctattggctaaaggaacgctgtgtgtagtttgttggaatatactttgtagaagacattcttgcccttgtgaaccagtttgattcccgaatcacacaagtgctgggttccagaagagattttggatataacgccaggatttctgaccctacagctaagaataggcagcaataggaactcaagttacaaaaaatgacttcaatagagcattcacatatgtgatggtatcagagcccaagtcttcaaagagaaatattttgaaacttctccctggtttctggcaagagcagcaaatcttgatttttcaggcctttataaaaataagaaaagactaacaattttaaacctgggcattaatcaaccatttaatgatgccaacaaatgagttttactgtaattcagtgcggggagattaaaggaaacctaagagccacaaataagccattatgaacagtttacagtgattgagtacataagctgtgattaataatgatcagaagtaaatctatgaataacaacaaacagaaaggacttgttagattgagaattttatcagaaaggtataatttggatgttgactcagtggtaacaacaggaaaaataaattacctttatgcattttagtttatgaaaatcaaatagataatatatgaaacaacatttaaatcgatacagcccaggagatataaaagtataggtttgtgtggtcttctaattaactgacatttacacatttttcttaagatcactgtaagcaaaatgggaaagctctctaaatttttggccttttgggagggaggcttttcagtcttgctcatatttgagtcaatacactgatgtcttgacttgcgaaaaaattttcacatccctgttttgggctctcatattttctttattacacaggaaaaaaactttattgcacagacaaacagaagttaaattgaattgattttataagctgcaataagtacagctcccagaaacaaatgcaaatggaatgaacagttcttaccatatgtttcacataggctactcacgttttctctcgttccgagatgatttcaaaaaacctgttctgttaatgtatgtatgaaattctgcaatcttaaagatttaaaaacctatatgttttcaaagacctgaatatcctgatacacatcctttcacacctggatgccaaacacatacactgaaatatattctatgaacaaaggaatttgaaagggaccacaaatttcgcattgcatgctgaagctgtcctgtgtcagctcttcaaactggggcctctgaattttaggaaaaagtgctattattctggttcagtaagtttgaccctttgttgtctatctctgctccttagagacacaagcaggccttgtgcttactaagtgaatattaatatcttcattaaaccttgatagacaagcacactacagccctcatccaaaatatgcacaaaattagaaggcaaaaataaaaaaagagccagacattataagcccgtcaatggaagcagagagccacaccattaatggtggattgaaaaagactctgtgttgttcacctcccacgtataaatgagaacacacggtgtttggttttctgttactgtgttagtttgctgaggatactggtttccagctccatccatggacacagggaggggaacaacacacactggggcctgtcaggggtcagggggagggagagcatcaggataaacagctaatgcatgttgggcttaataactaggtgacaggttgacaggtgcagcaaaccaacatggcacacgtttacctatgtaacaaatctgcaagtccggtacgggtatcctggaacttaaactaaaattaaaaaaaagaaaaagacttcctcagttttttctctaatggcctgaagcaaaaattactctcatttcctcttcattgatataatttgtttttgagaggtgaggggacaatgggaagagagtggttttaagtcactataaaaagattattgacagatgcgtggtaaaatgaaagactcaaaaattcctgaccctttctcccctccagagttaggtaggcgggaaggaccccaaacttccatacaagagtctcttaaggtaaaattaagacagcttccccttcggagtttatgctagtatttcataattttccagccaagagctggaaattatgaaatagttgcataaactctgttaatatagatggatcaggctccaatcttgattttgccatttctcatatcatttttctagggctgagggggcgcacttcttggagtccagtttctgatataaagagaaaagccatttagtgtcttggaaaaaaacaaaagaaggaaggaagggtgttgttgatttaatagatcacccttattgttctaatggctccagatggctctcctactgtgtggatgagatttgacagtgccttcttggggagaaacagaagacttcactagcttcgctcagcaaatgaccactgattgcctggaatggaggagttaatgtgatcaattaacaatgtttgaagaaaaatgatgtttgccagctgttgatttcatcagcaagaaaaagcccacaataatcatcttagaaaagaacttaattagttttgatcctaagatagcatgcaaaagttctggactaatttctagtctgaagatattcataacatattagagctggcatgaactctggtgattactagaaaaaaagatttttaagtttgtgaaaacagagatgtgctcaaggtcacccacagttaacagaaaaactggggctgaatcctggggcttctgagctctgatatgctgctttttcccaccacaaatcacagtttttgagattcacactttgaaaagaatgatccaaagtaacactgccattttggggtgagtgttctcttatgacagatgagtttttttttaccttcctgtttccatatgtttaaaatgctattagtatttcaaacctcattttctttctttttaaaaattcagccatgattttagagtgacagatttgccatatcaatttctaaaggtaagtgtttgggtcagtttgctttttctctaaattgtgtttgtcatccctcagtgtagtaagattttggtgtggttatgctgacattaaagtttccttttcttaaaataaaactaatgacttgaccttgatattgtataagagtacaggccctagggtcagtcatcctgggttcagaacccagcctaccacttctcagccatgtattgcgggagagttatttatggttccctacatttcagttctctcatctataaaatgggaacagtaataatcccattctcaaagggttgtttgtgtgagaattaaatgagctgatctatgcaaagtacttacacagtgactggaacatagtgaacactcaatgtagctaacagttattattattattactagaaaaaaattgaaaaataattttatgtaattgttacttacatgagtagcggggtctcagcttcccaacacaccatgagaatatgaaatttcatcaataaattcaaatagacactttatgtaaaaccctttgctcaaataatgtaacttagcaatgactgacttttagatactggggaaatgcattcatatgaaccagtgcgacattctgaaaactggttcattgaatcccaataatataggttcttactctcaagtaggaatcaataatgcacatcccctctgtacccacatgccccataaaaaagctgttcaggacaatcttgctttatatattatacacattcagggcacatttagagttctgaaatttgaggtgcaaagtaagcattttgatagggatatttttccaaagaatgtttttggccccagcataaaatgaaaaatctctaccacagacagttgcatttcatggtccaatatagtctctgcatgaaaaccaacagatcattctacatgtctcctgacacatttacaacaggcactctgtgtaaaacccattcgcatcactgggggttctcaccaattcttaggcccttgacttatttgtgactgggatacctttatcacaaagacatgctttacagatattttcacggacacaagctattccagtcttgtcctgcataattaagtttttacattcagtaagtagagttcacctcttcctcctaatggtaagtgtttattaaccataatgactaataaagaggttctggcctccgtcacctgagaagaacaaaacagtggggtttttctgcagctcggctggatcccagcttctatgacctctgctgctaacaggctctccacaggcaatgaatgggagacgccagctatgcaaattagagtactgatgttccttgtcagctgcaaagcccaaatggccctgaaggtgacccaagtgaggcttctgtgctgtgtgcctggttaggtggagaccctgattagtctgattatggcaacaaattttttaattgctttatggggtgcatgaaaattatatgtttatctccttttattgaataaagtgtgttggttgtatatgttcaatgttggtagggaggaaggtattcttatatataaagagaaaatctgttactctttatgtcagatcagttgatagatattaaacaaatcatgttgttttctcatattgagtatagatcactaatgaccagctggaacagaagtaaacttgtacattagccagtaatgaacaaaatgctaaagatataactagagaaattctagaggtaaggaaatagtccacatatattaatacattttttcccacagtcatcttggtagaaagttgaccgtgatgtcgatgatataactgggtcagacaaataccttttaatagtctgtattacttacacacgcatacgtggcaacagatttaccttagacataaacacgagtttatattcctggaggtgtcctagaagcatgctgactgttgtgtcctcagtattattcacttcaataaccgtaagagctggcgttctctccaagactctgttccttgaaggaaggaactatctactgttcccctagtaagacctggcctacaataggtgtctgtgatgctttttttttttttcatttttaaatgtccattttgtttattgatacataatatttgtgcatacttatggtacgtgtgatattttgatacatgtatagaatttgtaacaatcaagtttagaatatccatcacctcaaacatttatcatttctctgtgttgagaacatttcaagtcttctcctctagctattttgaaatatacaatatactgttgttaactacacagtagtcaccctactgggctaagggatggttaatgtgtctactcagctagatcacagtgcccagatatgtgatcaaacattattccagatgtttctgtgaggatgtttttggatgagactgctgttcacactggtagattttgagtgaagtagattactcttcctaatgtgggtgggcctcatccaatcaggtgaaggcctgagtagaacaaaggactgacctcccgcaagcaggagggaactctgccagcaggcagcctttgggatcaaactgcagattctggacttgccagcctccataactgcatgggccaattccttaaaacatacctttctatgtatgtatacttacatcctagtggttctgtttctctggagaaccctaatactgtgtccagtaaaaatctgttgtctgatgaaggaaagataattgcctgcctctttccatcccttcaacactcaccctgactctcagaacacacgctgtttggcctcatcctaatctccattccctcagtttctctgttacatccctgccatttatcccatttatgatatccctccttccttaggcaggataaacttgaagatactgttttcatcttcagcatactacctcctttgtctttcctctgctcgccttgtaaatcttcaacatctaatcaaatcatgtgccttctctaacctcactgttgttttctgctggagagaagccctgccaccagccagtacatattcataatggttgactgtatgtggctgggccctcagaccgctcagaacaccttttcatggtccttagtcagcccctactctctaccaccccaaatctttcttgctattcctctggtctcccatttctatcttcagactctcgatcttattgcctgacaaatgtttcaagcagaactcatcaccttccccacttcttgttcctcttgcttagtccctgttgtgataaattatgtccctcccctccccattcatctgcccaagctggaagaaaatttggcatcatccatgcctcttctttcatcttcaattccatcacccatccagttatttaacaagcgttagctgagtggctattatgttcctggcattattctagagcttgggatataagagtggacaaagtaaaacaaaaacactcctgccctcatggagcttatattctagcaggggagaaggatcatgaacataagaataattaaatttacagagtatattagaaagtgaataaacgagacagggaaaaatagagcatgaaaagggtgataagaatcgacgtgtgtgttggtggggaggtggagtgtgcagtgttaaacatggtggtcaggatatgcttcaatgagaagatggcactggagccaagacttgaggtgagggagggactcacacagatatctggggacaaatcactttgggtcaaggcaatagctggtatagagggcctgtcttaatccatttgggctgctataacaaaatgccattggctgggtagcttcaaaacaacaaaaatttatttctcacagttctggaggctgggaagtccaagatcaagatgctggcagattcggtatctggtgagggcatgcttcctaatagatggccgtcttctcactgtaacctcacgtgcaagtgttagaaaagttgggggagcctgagggtgtctctaggttgttgttgttcttgttaaggtactaagcccctcccaaaggccccacctcctaataccatcactttaggagttaggatttcaatatataaattctggggagacacaaacgttcatatctaaagcaaggccctaaagagggcctttttgagcgaagtaggccctaaagcaagagtgtccctggcatgttgctcgagcagtcacagcacttctgcgaatcttcagttacagcactcctgtgaatctccaactgtccatctcactgctactacctcaatctaggctctgggccttctcacctaaattaatatactgatttcctaagtggttttcttatatctggtcttgctgcatgcccacctacttcccacaccgagctagaatgacctttcaaaaacacagatgtcacctcatcagaattcttccatggctccccactgcccacaggctgacatgtgcacattgggagggcttagccctctcccacctggctccagcccactgctgcaatatcacaatatcacctcgcccatccttgacgcttatccagaggtctgtacataagattctctaaatgcaccaagttccctctggacccttcacctttgggacactgcttcctcctcataaaacacctatctcttttgctacccattgcaaccctcctcgtgctagaaagcatggcctggtcagctcagtctcatttccctttccctatacaacattgcttcctgcagaaagttcctcctgcccttcctctctctggcttaggtaccctccactatgcttccacaagagtgtggctatctctactgcagcaatttcatactgtatcttcacagtctctttattttttgggctcccctagtaggttttgaatatgggcaaggatcatgctttttaaatatcccagcacttggagccttacttgatacataaggagatactacataagttttggtcaaatgaataaacaaatacacaaataagccccatgtggaaaggtgaggattatatagatgcataaatagggaaaaactatatgcagaaactgtacatagcttcctctaaaaaggaatttcttatggaagcagaatctgtaaccatgaggcagccacccagaggagtagagtaatgatttgtgctgctccagtgactatgggttaggatgagtttccaggtcaactggattactctgatccctctttagagccattgcaagaaatcacatctcaaggaaagactcttctggcacctaatctcttttgtactttagtccagacagtgcgaggccatcttcaaataaaacaatctctttggcttcacagacaagaaaaatgtaatctatttcctacacgtgacaacaagagaaaatctaaaatggcacaaaaatgtaatggtaatatcctacagagaggaaagagctgaatcaaaatgaaatatgaccaaatgcaatcagcagctaacagcaggaaaaaggcagctgtcatcttcatttctttcataaacttcttagaacaaattatgtcttttagaatgtaagtcagtttgtcgggcgcagtggctcacgcctgtagtcccagcactttgggaggctgaggcgggcagatcacgagatcaggagatcaagaccatcctggcttcatcctggtgaaaccccgtctctactaaaaatacagaaaattagtggggtgtggtggcgggcacctgtagtcccagctacttgggaggctgaggcaggagaatggtgtggacccgggaggaggagcttgcagtgagccgagatcgcaccactacgctccagcctggcaacagagcaagactccatctcaaaaaaaaaaaaaaagaatataagtcagttttctttctggatactacttcgtaaagcttctgccgtttatgggaggtaaagcattctctgcatcacccaacttcgaagctggcctgcatttgcttagacatttcattcatgaaagcctgccctctcttagcagaggagcgatctaaacaccacagtcccaaacacctccatctgactgtctcctctgtttgtctatcaaaccactgattaaaacacattctgcattgattgattaataaacaggtttcagcagctctggacactcagagtctagaaggagaaaagtctagactcaaatagataaaaacccgtaattcaaggcagaacacaccctgggcccgagggggctggaggagaggtgccaagtgtgggctgcgcatggaacgggaacactggtgttaggtgtgggctgcttggaacgtcccaggagtagcttgcctcatgttgcagactaggaatccagctgtctggaggtggaagaatccatggatggtgcatattgcagagacacggtttcaaaatcttttgcaggatgcacatgttagaaaagagatcttaaaaaataaaaaatcctctaatggctttaaatgagcatgaagcattcagatgttaatgtttagctgtgtagacaaggtgtttcccaagttatctcaaaggttgatgacatgacgaattgccccctttaaagaaaataccaaatacacgaacaacaaacttccccgaatgtgttgactatcttttggaatgaagagaaaatctgggtcgagttgaaatcaccaaaagtcaatccacaaagtggaatgacattgctaacacacttagcatgagacctgaccccatctgattattgctcagcaaatgggggctgtcctgattgattactatttgtccagtctctcaccagctgagctctttcctctgttcctaaaataaagggtagggtgggggactttgtgccagataactaatctttactcagtaccttttctgtttcaggcattctgttagcagcttgatgtactgttctcatctatctcctcaagagtcctttgagagatatattttataactgttttgtagaaaaaaaccacgaaggatctggagatgttaggtgtatccaagggcacaagatgattgggaaggagtgaagatatggatgccagagcctgaaaacactccatgtgtcccatggtagcttgttctttggccaagtagcccttgcacacccccgccttgtcttgagacatgtcaccaaagacactcaaaccataagctccatgaggaaggaattttttattttcaccattaattataccccagttccttccacagtgcttgatgcatgcttggtattcaatacatatttattaagaagtgaatagacccaaggcctgggatgaagtttctgtctccaccaccactttccacccattcaagagtgagctgctcccctacgaggactgggcacgagtcaaaacactcctgggaaggatgaagtcttttggggagttcaagaactcctgagtccggacaagacttgtgccaacctgggtgacaaaggaactgtgagaccctggatggagttacaacccgaagatatgcctgaggcctgtcattcagcacttaattcctttttctggtgaaaattaaagtaactaaaatcctggaaccctagaggcttccagaattgtaacaactgtcttcagtagccatcaatctaattacatttttgcaatattctcattttgagctacaaaggtacaaattacacaaaattgtgtgtggaatgcatacatatgtatgtgtgtgtatgtgtgtatatatatgtatatatataaacgttaacatttagatgttaatgtttagccatgtagacaaggtatttcccaaattatctcaaaggttaatgacataattgtcccctttaaaaaaatactgaaaacatgaaaaacaaacttccctgaatgtgagcctcactttgttctgtacaatggagataataaaaccttctgtttcacatgaagagtacatgatggaatatggcaaaatgtcctgaaaaccagaaagtagtcttgtcaatagccaagatctgcctgactttttcacttggggtgcagtagttaagagggaatgtgctggagcccagctctggcatggccactagcaggtttgggagagcctgtgcttcagttgctttacctgtaacagggagatggaaatgtacccagctcctggaattgtttgaaagattcaatgtgaattcaatgatataacacatctaaagcacttagaagagcccagcacatgaacaatgcttaaacaaatgtttgctgtgattattactgtgctttcgggatcactgtgcaaatgacgattctggtcagctatgcattcccagagcagtggaagggttcactagcagctatcttcagtaatacactgcagtgaggggtagtcagatccaggcccacaatccaataaaggtggttggtcccagaagttattttgccagataggcagaaatcaaattgaagagaagagctttggggagcatgtgttctttacttccttttcctccctccctcacccttttcttttctttgctatttaaataaaccaccactttcaggcctgcctgggagaagatattagggcagcagggagtccagctgggagatgatgaggaaagcagctgagcccctgctattccacctcatccactccatcctccccaattaactggtaacgaggtggtgacgccctaaccacatttcacttcctgctaacaaagcttgtacaacaaatgcaaacacttggctgtcagcttctgtccagcacacagcctcgttatccatctcacccttctgcatctatgtcagcatccaggaggcaggcccaggacgacaaaccttctttgtgctacactcaatgccgtaccaggctctgatggtgcttacaaaatgcctttgcccgacagtaacaagaaaggtcccttatagatgattttgtaagaggagacatattctgtgcaggcttgtgtcattcctctgattattcagactgggagtaggggcagggaaggtgccaccatttcatttcttcctttctcatctgataaaaatttcttcccacctctttgaattgaggtcaggtctttttcccttttctaaatttgcctcaaagaagtctttttcatttttccttaagaatgactttaatggtctacattttaacctcttcctcatgtaatgtaagtgatctgcaaactttcttatatcttattccttttgaatttcaaattcctttttttctaaatcaatcccattatggcaagacattattactttctgctcacataaatactatcatccataattttctctcttccctcataaagcatgatttatgttgatatttaaaagtaaattctgatatttagtctaagtactgtcttacatattaattcaataacataatttctacgatagaaaagtacataagagtacaaaatatgaaataagcttgatatagacatagttatctgcatttgaccagtgaggaaacaaaagctcagaaaaattagataccttgcacaaatcacaaagaaatcagtggttcagctgaaaattagaaccaacatcttctgatgattacacaacttttctggttgactaccaaagaagatactagaaaaattactaatgagtgaaaataaaaagacatttcaaagtctttcatatttaacacaaaattatttttccatagaagatattcaagaagcagttacacatttgaggagctgtttttttttaattaaaaaaaccatattctttatctacatctagataatgtagattgatgatccatctaaatcaagaatttatcttctacagtgggaacaaattactggaatttaagcaacgtgaaatctcatcactttagcaatgacaatgaatgtgatgtagctttcaatgcagtactgaaaaagcttgtacactgtcacatgtcccaggcccttaggaacaaagtttagtatgcaatgagtgacgagctctataatattttcattcgaaacagagctacacaggaaatctaggatgtttataataatatttggaatatttggtataaatgtaaaacattgtaatagttttctgggcagataagagctcatcatatatccttttagttaagtcaagtgactctggagtccagttataccattagttcaaacactaccaaagactaaatacaagctcttacaggctgaattgcatctccccaaattcatatgttgaagccctaattcccaatacctatgaatgagactgtagttgaagacagggctttaaaagagctaattaatggctgggcatggtagctcacgcttgtaagcccagcactttgggaggccgaggagggcagattgcttgaggtcaggagtttgagaccagcctgggcaatacagtgaaaccctgtctctactaaaaatacaaaaattagctgggcatggtggcgtgtgcctgtaatctcagctactcgggacgctaaggcaggagaatcacttgagtccacgagttggaggttgcagtgagctgagattgtgccgctgcactccagtctgggtaacagagctagaacctatctcaaaaaaataaaaaagagagctaattaagttaacatgggggcattagggtaagccctaatcccataaaactggtgtcctattgagattaaaacacagacattacagagggttgaccttgtgagggtaaagtgaaaagggggccatcgccaagctaaggagagaggtctcagaagagacaaccgtgctgataccttgatcagctgacaccttgctgataccttgatcagggttctggaggcaggacttccagcctccagaactgtgagacaataaattacttctgttttagtcactgtggtactttgttatggaagccctagcaaaactaatgcacttaacaaacttaacacctactttcttcctccagcctctgtgcctgtgtttcatgccaacttttagtttctccttgatctgccagtaatacaaagatgagaaggtctggaaggaggatttaggataagctgagaggatccatcttgtaagactatactttcctatgaaatgctgtttcctccttgttgcctggaaaactcatcctcaatcttctagacctacagttgggttattcttcttcagaaccttaatctcttcaaggtggtgcctctgctacaccctataaacccacctctggcacagcacatatcacaccatgttagaattgcttccattggcaactccttcctgatcttgtgaatgatttgtgctgctccagtcactattaggatgagtttccaggtcaacctcctgttttgaaaggagggacttacctttgtggtcatgtatttgacacctaagacttactcgttaagtgtttgttgaatgaatgaatgaaataaaatgatctccattcctattcaaataagcctgtaaataacagtttaagcatggtcatatttgtttgttgagaaagagaagtattaagtgatataaggtttaaaaaagcaataaaatctgcaaaaagaaaagtgtctattgatgaatttattaacaggaaagaaagtaatcgaggataagaagatggaaaaggtggaagaagagaccttgacaacctgaaaaggttatacccttgtgcagatgtggtggacaaatcctcacctgagaggaggaatcaaaggggcaactgctctgaaaccggccctagagcatccaacctaaaaacaatgccttcatcatgaagttccagaaccaatgattcaaaggataccccactgaaaaaagacagtcgtcgtcctagaggtaaaaatcactttacttgccaataaacagaaacatgagcaaatgggaaataagcaaaaatgaaatgatgtgtgtgctctcttccaaagggcagcaaaagcagctgagttaatgctaatggctcacatatggtgggtggggggaaaggatgttataagtcacaaaaccctggaatggagcagaggcctgtcggcaagttaggtggtgatgatggagtcaggatgacttggaaacactgtgaaaagatggcttcagataatgggccattatctgtctgcctcttttcactttgactactgtcctctataaataatgtagctggctaatctaaaacatacagaatcaataggaagccaaatatttaggtaccacaaaatgaggcaaaaaaagagcccagattttcaaacaatgcaagtgaccctgaaaattgtaacttggcaagtctgcaatattgtgagagcaataacaatctgttaacatctagagggaataaacccaaaagaaataagaagccgagctttatgaagggaaaaaaaaaatggcacgccaaatttgattgcttttctgatggaattacaggattactagtttaagggagtggagcagatgtgatatatttgaattttattagggcatttgggagaacgtctcacacaatttccttcacaaaactaagtgactttagcttgaacatgaactgaggagataataaatgaagggtaataatacgttacagtcaatctcatcgggaggaaggtgtttaagaggtgacactaaggctcctgttgtttggggtggatagaacattgattttaatgatctgtaaaaaaggaagaataagagtgacagagaggaaacatggagatttattggacaaaaagactaggaacctggttaaaaatacctgaatatagggaaaatgcaagctaacaaatatatctgtatgtttagaaaagtaaatatatttggaaaaatatttgcagaaatgcacacatgaaaggagaaaaatgagaaattaataacactgaaaagtacacaggagaagctccttgtaataaacttgaactgcaatacagatataaaataagagatcttaataacttatactgtcataacaatgacacacatagcttgccccaaagtaaattttaggttcaaaaagctaattttactcctctttgaattgtatcattataaattttaaccttcaagtttagcaataaaatgacttaaacagtttaaacaaaagtgtaacttcctataatgacagcagcatccatcgaaatactgtaccatctgtggactagaaactacccttcttcatcctagactttgccctcttattcatctccactgaatcacaaatcttagacaattctgcctccttgcctctctttgggacctatccttgctccttgttccatagatgctaatttggttccagccctcattctttcttaccagcattattaccagagcccagtattgcagtatcacatctgctctctgtgctgtcagaacaatctttctggaaagctgaccatgtaaattctccctgtttaaaaacctccagtggctccccatgccctataagacaggcctaggcatagtgttcaagcccttgaggatctggtcccttctgatctctttagctccttctctttccaactctctcctccctttccacactctggcctgaagcccttccagttctcggcagctctgttgtctgtttgcctgtctacccctccttgcttcctccttcaggatgccatgcagatgccatattttgaaggaagccttcctggtttctttctttccactcttgtttctttagtttgtttatcatgcaattttttctactctatctataaatggtgggaggcaggggctgttttaatcctctatgttgctagcctgggacacacagtaggcccgtatgtacatgctgaataaatggacccaaaccaccaatataatcagggactgtgtctactggtaaggcaggcctgggtttgtgataaaaagtgcattggttttgtgggcagcatagtggaggcagaaataacctctaaaaggactacagtgatgacacaactgacacactgctgtaacaagccagggggtaactggggtgtgcacctgttggccggtggctcttgaattcagtcttcctcattcatctggcctacaaaataccatagtttagatcagaccctgcaggaaccataacaaaaactgaaggacaggctggtctttaagtacaacttagcagagcatgacaaatgcagattgaaccaaagtgacccttcccacctacaaatatagtcatactacacctctgcttaaagtcccttcaatggcttcccattgctaggaggctgatgtctaacagcctcatgtctctcctcttcctcacactcactcatattacattaccactggttgccacaggcaccacatgtgggatgctcccatgccttcatccgtgctgtttcctgtaactgctggaagtgccctttaccctcaaccctttctcaggtttcctggtgaattcctgatcatccttgaagtcatctcaagtatgaccttctctgagaagtctcccacaacctttctaggtagagctgagcatgcctactcagtgtcgccaatgcaccttgtaatctatcaattaatgtaattgaacagattacaaagtgcattggtgtctgttacatgcttgctcctgtcccacgttatgggccttacacgtctttgtattctgggattctagcaccatacctggcccagatcaaggactcaaattatgtgttgaattgaatttgttgaattcacatgaaagacaatacttatccaaagcctgaatggctaaagtggttatctttgggtttcttttgacaataggaagcatcatcagaatggactaaaatgatcaagaatgtgcagaaggacctccataatcagtaactatagagataccaaactttttagttacataaattgaagacaagagcaattacagaagattatatttaatggccttcaggtacaggtagaaatcacatgatattttagactgctttctttaaaaatgcatcaaagcactgtgaaaagccaaaaacatccttttggaagcagcattttataccaggtatttaaatctattttcactgtgagtttattcagagtaattgtataataaagaaaagcacttggcttcaggtcactatgcatatatagctaaattatgcaattagatgacatgtaattaaccagagtagcaacacagccaatctaatggggccagttggggtctgagtgactcataaaaacattatgtagttaagcgataggcacctacaagaacaatgaattttggtctacctgcagcctaatgagtccctcctgtgactaaagaggtaatgcaaagagaggtctcagagacagggcagtgtcaatggaaattctgtctaagaaggagccaaggtatcatcttgattcttattttccaaaacttctaatgagataagaaatctctccaaacgtactgctgccaacattaccagcttgactcttccattaccacaaataataaacaaaaaacattagttaaagcttattttgaatgaacttgaagaaatacttcctgacccattactcaggtagtatatacaacagattgactattcagtaagtgaaaactaacggcggaagaaatccaaattagctttcttccttttccttcaaggatgtatacatggcaagcatgcatgaattaacacagttatgaacaagaaatattatctcttgtgtaaagatcaaggtttactgtctcattgtgtttggttttgggaacgtagttttgattttgtttgcttaagagatggaagaattccagttctgaaagaattcaagctatgaacaggaaagtatacttcaataattgtcccagtgacccttatttttattaagaagaatctagcaactgtcatacttgctaatgtggcaataattcttctaatcttaaatttttaagtaaggaaaaaatgaatatgtagccatttaatcacaaactcatcctctatttcccaacaccacttattccatatatatatttactgaatataaatatactaggcctcagtggaaacacgaaggatgtgcaagactcagtacctgcctttaaatagcttacaatctactagaggaatgaaatctgtcgcccactcttttattttcttcttcgaaatggtttgagtatatacagtatactctaaaggtttaattaaaatggaatatataaaaatctgaaaggatacatactaaaatgtaatctgaaagaggggtagcaaattattctttttgctctctacattttctaattttttttttccctaatgaggacgtactacttgtgtaaaaaggagaagaaagttattttatgaaagatgaaaaaaaaaaaaacacctcactctggttagcctgatattttgtccttttgaacacttaaaaggccccattaccaggcagaggttgcaatgagctgagatggttccactgcactccagcctgggtgacagaatgagaccctgtctcaaaacaaacaaacaaacaaacaaacaaacaaaatgccccattgcctaaactctgaaaaagtcaatacggggttgttgacaaaatctattattactgcccatctggtgatctgctgctcccctaccagtgaggaagcttcttgaggtcggggactctgtcttgtttgctattttgtttgttcaattcctaacagggatcagaggacaccatagataggtaataaacgtgtggggaagatgggaggacaggagagcaggaagagagcagggaaagctgaaggtacacacacttctgaggcttttgttaaaattaagtatttaatgcgatcactttggggaaaccacattgattaaactgacgggaggcatgaaaatgacataattgatacaaccgataattttattcttcaacaaaatctactattggccagagtgcccctttgagagataatggttcatatcagggagcaatttgctttcaccccttgcatacaaagcgggtttcaaaacctatgtagtttcggaacaaaagaaaaactgtaatgtcttaatttttaagcttttttcaatgcagagactctaacaaagcagatctaatgaacagggcatcatattgcatactgtctgtgtgattggcgccttctggagttgtgcagaagacaacctgtgaggccatatttagccactctgggcttgcttcaggctttaagttcttgttgttaaacttaatttttcagatccatgtggtttggaagcattgtgcttatgcctaactttggtgatgtattgacctttgtggaccaaggatgaaagctggcatgaaataagtacaggaaacttcataaaataacagccagcattaattgagcacctacaaactgtcagagggctatccatctatgtgtctatctaatatttagtcttcagaataactgtgcaaggtagatatcatcaccattttacagatgagcaaaataagtcttagaaaggtttagtttagtaattttcccaaaagcacacacagctaataagtcatagagtgaggatgtaattttaggtctgatcagcaacctcaatatgtcattcatcctcgcctttcctctgaagaaaagcagcagcttgtcttatgtattttaataacactggcatgttataaaaagttaacctttttgttttgcagttcctcatttttctttatgtatttctcttgcttcttgttttttttcccctctcctccaatatcaattcctattcctcttacgtttttgtggcatttgagaaaccttcgttgaaaattctttgacagtgtctgcaagtcttctgagacaaagtgccacaaagataatgtttaaataaaataccacatagtacagataattatatttaggctttcagtcaccctgaatattggacaaataaattctcttggaatcttcatattgatgtacataggacacacacacatgcacacatatgattagaataattttttccaaccagaaatgacatttgcttttgaaatgattaaatattaccctcaccatcagccaagatttccatgacacttgaataaacaaaaaaggagttgattactgagattctttgtttttcctcttcctttgcacagtaggaaaagtaatgattaaaaaaagtataaaacacatattaatgatacaaaacagaactatctccaatgctttgaagaatgtattcttcatatccactagggtgctaaccttcggaaagctacaaaatcaatcctgaaagttttatctcccatggcgacagagcccttttttaagtcagtaaatactaaaagtgatacaataacagctcatatttaggattaccaagtttctctacaggagacaggctcaggtatcaagaggaaaacaaatattcattaaaataatttagcaacaacaaaagacacgtgatgatgaaagtctgttcaaataacaagtgactaaaataagagtgctgataaaaaggaaggtagcactgatatggaactgggttttggtaacaatatgccaatcaggaataaaaatataaatcaaacttaactggaatgcataagtatacccagctttacaagatgggtaggtttctggccgggcacggtggctcatgcctgtaatcccagcactttgggaggccgaggcgggtggatcacaaggtcaggagatcgagaccatcctggctaacatggtgaaaccccatctctactaaaaatacaaaaaaagttagctgggcgtggtggcgggcgcctgtagtcccagctactcaggagactgaggcaggagaatggcgtgaacccggaaggcggagcttgcagtgagccgagatcgcgccactgcactccagcctgggcgacacagcgagactccgtctcaaaaaaataaaaataaataaaaataaaaaataaaacaacaacaacaacaacaacaagatgggtaggttcctaaaaagctttgtataaatacagttgctccccaacccccataattactggaaggagagagagaaagaccctaatgaaatcttgcagtaaattctaaattacaaaccgaaaaaaaattttgaatggcaaacagacactgctttaattccctgcttggaaagttttttttaaaaaaaattttttaatgaatgatgatttgaatagcagtatattttttaaaaattaggcaaacacgtatatcactgcaaataatatggaaaatagtatggaaagtggagaaaacccccaaagagctaatttccattttatatttggtatttaaatgccacattgataactgaacactgtagtataaataaattattgttaaactgtcttataaattgctcagtccttcagtccatagtcaataaaatataggccttgcctgtggtttactcaagactatagaaattcagagtaatcaatcattccaggtggcttttatagctttccaggtagcaagagctatattttattgaatgaggcatttaattagtgggtattattaaagtgcaattttccatattaaactgttttctatataaattggcttcctggtatgctgacttgtaatgacaggattatcttgcattcactcttgtagagacaggtaataactcatctttgtgcctgttttttgattccacagaatgttattctttctgctgtcatcaaaaaatagtttctgaacaaatattatccaagatttttcttatgctattgtcctataaactcaatattttaagactaacctgaatgctaatattatatattgtgatatttcttatgttataaaggaaattgtaccataatttctaattgtagactaatcgcagccattctaccacaaaaatgccatattcaacactttttcctattacagtataaaacaccatttgaccttttattttaaaaagactgtgacaaataaatactaatttaatgcataaagtctaataatgatctagatttaccagtgtaagtgacaggaggtaaattaatatggaataagtatatacttcacatgtttcttggcatatatgaagaagcactgaagcaaatgaatctatctcatgtaaggcaaatattatggaaaaactccagaatcagtagaaagagatatttttgccttttcttactatggaaattcactgttataatacttaaagctgcagatcttttctttaataataacttctgtttaaaaatctgtaacaagagataccattgctgattacataacattggtgacatactactgtgattttttcagttctgtaccaaaagacaagaaaaaaacaaaaaacaaacaaaacgataaattctgccaatgtttttaaacaagaatgtcttctacaccaagtgctactttcagatacagggctacagtgcttgaacaatcaccgtattagaaacaataagtgatacaaagagtaaaaacaattttcaaaaaaatcaaacttttataacatttacatagacaccaaagaggacaaaatatccatttccagaagatgtgcagtataattagtcagaaaggtatcgcaatgcttttgattatgatcagccagttgcaaagattatcaaataaacaatctagctattgctgctttgctagaaaaatgatcatcttagtggcaaagattaataactgctttttaaaaagacaaaaactagctttgtgatttactgtgtactttctcaagaatgcacagtaagtaaatcaacagtttgtttaatcactatcaatgtggcatgctttaatatattggatataaataattgtcactaaaaaatcatctgctgcatgttcagataaagctgtagagatctctgccttgttacctagcaactgggcaagtaactgccatactgcaaaaaaaaaaaaaaattccttattatttaggtaaagagaatgatcataaaactccacattaagatgttaatgaagccaaaatgtatattaagatacaacagctaacgattttagatgcatttatggccttggttttgaaataccatgcagtaatgaaaactgtaaagatttaaatctattatttcagcttgtcacaaacaacaacgttctttagagtgtatttttaaaagaccactgttattattaattttttatttgtactctttcacagacaaaggaatttcaaccagatcttctgtactgagtctatttattgaaagggtgatgcttacttgtttaaatacaataaaactgttctgagtaattagttcactgcaagggatcccaaattatttcttatatttcatataacagcttaatgtattaattttataacatctggaggaatctggcttaagttctgtttcaattttgctaaaaatctggattccaagattgtgcataaaatctctcttaaaaagcaataggggattagggcaattataaaatttcacttctgaggtccaaaattcagcatatggccagtcttcaggcctcaatctgaaagtaattctttctggtgtgtgatgaaggctgactggtcagagcccatatgacgatggtcacatgagagtaaggaaaccactcatcattgcaacaaacagagactgttttgtgaacagacagagctgtgcttgatgaaggcttcacaggaatccaaaccccatagcttacatggcattcctctgttgatttaatgtacgatgcttttattcatagtcacttacaatgcagggacacaattcaagaaagctcttcaaattattgcatggaattaagtttcttgataaaactttacaatttaagataaattatgctgaaaagttaaagggaaggttggctttacaaattaggagccgaaagcccagagagattgagtagttggaagttgtgcaacgatataacttcttataaaagtaaatatatataaagtgcatagaacagtgcttgccacaccagaaggattatatgtgtttgatattgttattttttattagtgtaattattattagaagtattggatctagaatctgttttttcgtttccagaacaatgttcttttcactaagcacattacctcaaaataaagcactgttttaagatgcaccatgtacatcttctatgagccaaagctgtattttaatgataaaggtgtgtattaaatgaagatgtatacgtagattcacattaaaagcagaaaaaattgagtcttcataactagtaatttatagttatttgtttaaaatcaaatctgtatcaccttcaaatatatatcatttacaggctaatagctaaacgcaagtcaaaatggtatcccaaaggaaacactttactagtgttagtgtatagaccaagatgtataaactttcccatctttaaatattttctctgagttacattttcactaattcatatcaaccattaacctgttatttttatttttataacattaactttacatacatataacctgatacgtttgtactgaaagatttcagacatttgttggattaagaaaagtttactctgagcctaaagagttcatacatatgtacttcttgatcttgattagtatatattcatcatatgcttctctgtatttacattctctctccctagctggtctcatctaggcacgtggctttagaaactatctatttgggggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagctgagattgcgccactgcagtccgcagtccgacctgggcgacagagcgagactccgtctcaaaaaaaaaaaaaaaaaaaagaaactatctatttggggagtctctcagatgtgtatctagcatcctgatctttcccctgagttccagactagtagacccaatgatctgcttgacaattccatgtggatgtcaagtttctcaaacttaaaataccacaaaaaaactcttgcttccttctttcactagtagcctaatctgttcatcatccactcagttgcacaggccccaaatttagaagtcattcataactcctccctttttctcatctttcacattaattcattagcaagatctctaggttccatctctaaaatatacattccagaatctgatttaagatggaaaatttaaactgcttcacagaacttcccttcctcaatatctaaccaaaggagaaaaaaagagtaaacattagtaaaatgaaaaaaagaagttccaacagtaaccactcaaggaaaggaacattaacaactataataaacttcaaaactggcagccaaggaaagagaagattctggaacaggctaaagagacacagtgttccttggttcttaaccctgtgttcaaccctagagaggtaaacaaaattctgagactttttgctaataattctaaatttagagaaaaacacattcagtgaacatccttatgtttccttttactactaaggagtaataggaacatgtgcaatgaaagaagaagatcaaagggctgattcaacagaagtgaacactccagggctgcccactattttggggaaacccatcaagccccagattatctcgaggatagctactagctcttatggaaccctttagttaattataaaaaggctatccttggtatctctccctccaccaccccccttgcccgccccgtcaatttggtgaaataaaggctgataatggagacatttaacacaagttaaggaagcacggcccaggaaatctaacaaagattgcatacagcttgagttgagctgagctgtctacctccctctgcaatttctttaggttgcagaaaagtggatagatccaagcaataaaacatagctcaaagaggaagcaaactggtctccaagaaggtgggaagaaatttaagaagttactcacactatgtctggggaaagctgcccaggcaccagcaagatgaaaagaaatagcacggcagatatgcaagcattctaagggagggaggcaggaggagggaaaagagaggaaggaaagagggagggagggagagagagagagcaacaaagtgaagaaaaaatataaaatgaaagtatcacagcatataggaactaaatctagaattttattcaaataaacagaaagaaatcctcacacaaacttcctactgtagaataacgagttcaatgaaaattgaagtttaaagacagaataatgaagaaatctgaatgagatgaaaaaggatattgtggacctaaggaagcaaattaaggactaaagatcataattttagaatcaataaacaaatcagaacatcagaagcagagtagacacttctgatagttgaattactgacacagaagaaaggacccaggtaccatgaatggagacacttctgatagttgaattactgacacagaagaaaggactcatgtaccatgaatggagatgaaaatgacaacagattttcatcaaatgataaactaatagatatggaagagatgaaagatgatccaaaataaggataagtgatgttcctgaagtaggtaacaatgtaagtagaataaaaggtgttttcaaagatatgatacagtatctgatctaaataacacatcatattgtggaaaattcttaagcagaccatccaacacctccacatatcttagctatgttattaagctatgtggataaagaaagaattccttgggataaaggcagaaaaaaaatcacctacaaagggtggcctcagactatacagagatattcaatgctattaaacaatgaagtaatagctgcaaaattataatggaaagaatacatgacataagaatacaacgttcggccatgatatattgttcgactacaaaagcaataggaagacgttctccaaaaaacaaaacaaaataaaacaaaacaaaaaactcacaaatgcagaatccatgggtctttctcgaaaaaaagaaacaaaaagcagttggcaatgaaatctaggcaattcagtgatgaatcaaagaactcagtcagaatgaagaagatatactaaagggctgggaggcaatggatccatttgaacataggaatttatactaaataaccatagtaattatgattacagaatagaaagtaaatattataaacacaggcaatataaattagttaaaattgttagctgaggagaggatgggcaaaagcattacctttcaaagcaaggaaccaatctgatgtgtttaaaactggaatatgcagcttaaaaatgtgattccaactctgaggtggatttactgttaacgctaaggaagcttaagttccaaggttttttatctacacaggtgatttgcgttttcccatgccctggaaggggtcacagcagtgcattcatattgtcatatttttgtaaaatttgtaaaaatactccattttcttaaagagggcccccaaattatataaccttcccacagaaatcttgatccactcctgatcaaacctcttaacatttttcatcgtattttttcttaaccataagggaaaataataactcccataataaggagacacttattggaagttcaacaattatttagtttttctttattttttttctgctgttaaatacaataaaaccattttttttttgagacagtctcactctgtctcccaggctggagtgtagtggtgcgatcttggctcactgcaacctctgtctcctgggttcatgagattctcatgcctcagcctcctgagtagttgggattacaggtgtgtgccaccacactcagctaatttttaaaaaatatttttagtagagacaggatttggccgtgttggccagactggtcttgaacttctggcctcaagctctccaccggcctcagcctcccaaagtgctaggattacgggcatgatccaccaataaaataaattttaataatttttatttaaaaatagcatcagcattatgactccacagttataaagtctttctttctatccgcacagtcatgtatcaatccctttgcacatatttatagaaagatgccttaaatgatataagtctactgctaaaggtggttatttctgggcagtggtatttggggtaattaaaaaatttaatctttgtattacatgcattgtctgaattatttattgtgatcatataacaaatatttcaaaaataatacaatgacttttttccttcaaatgccaagatagtaacagatattattttggatggtgagaactatagggaactgttattttgtactttgtattttcctgtgtttttaaaatttcaaaaatgttttccaaaatttgatattctgaatcattccacatctctccctttttcttcttccagccaagtcactattatttctcacctggactactctcatagtcttctgtgtggtcccacctgtgtccatcctagccctggtattacccagtctttacacagcagccagggtgtgctcctcaaatgtaaaaggatcacacctctgctttacattccccagctgcttcatattgtctttagaataaaacccaaactctttgccacgaccagcaaggctgacctgagctgaccgggattcagtcacgctggactgctctctgtcccccacacactgcacttgttccccctgacagatattccatgagctgttcccctagcctggggtgttctttctccagcatctccgtatagctggttccttctattcaggtctctgttggagggccaccttctcagggatacccccaaattttctaatttctccctccatctccctctccagtgcttcaccctgctggatggccttcatggcctttatcaccatctgaaatgatcttctccatttatttatttacttcctttgtatcaatcctctcccactaaatatctgctctagaaaactaggaccttgtctatcttgttcatcattatatctcctgctcaaagaatgtgcccagaagatagcagacacttaataaatatttctccactcaatggatacacacagagattgtttctcagcttaaaaaggcttgtgtttgcaaagctgtcttttaagtcagttgtttagaattcagaatgcatgttctttaaaatgagtcacagtacaaattcaatatcaagcctagctcacaaagtctactggacccataatgagttaaacttctgtatatctgcaacaaaaatgctagaaaatcaacatgatgaattatcactgggaaaataggaaattaaaaagaaacatttcaactgatctaaatatgaacaaactatgactattatttctctctcatattggtgaagacttttgtgaatattctgaagggaacgtcagaaccttttttattttttttttttttgagacagtgtttcactcctgttgcccaggctggagtacaatggcactatctcggctcactgcaacctccacctcccgggctcaagcgattctcctgcctcagcctcctgagtagctgagattacaggcacccgccaccacatccggttaatctttgtattttttgtacagactggtttcaccatgttgccaagactggtttcaaactccggggctcaagtgatccacctgcctcagcatctaaagtgctgggattataggcgtgagccaccacacttggcttcagggcatttttaagagctgcagaagtttctggttttttattgtgtataacttcatccaaaaatgtgtagcttttggctcctttgataacagaccattaaattagaataatgtttgtaactatgagttttattatctgtttttggttttagttaaagcttgggaatgacttgcacgtagttgtaactgcaacaggtggtatgttttgtgaatgcttacctgtcattacttgagtcactgtttgtgtcaaaaatgtaaaagaggaacgagtttctgggaggtattaggaagagaggggctcagaaggaaaggaattaaagaggacgtgtgattggaaagatatctgagataagagcagcgaacgagaggaaagaagaaattagtgatgaatgatcagaagaagacagggaagacgacttcctcctgctagctactaggaaatgttatcttccaagacagcttggttcctgtctagagtagctctgggtgggtaaatggagggagggccagtttgtaaataacgctgaaatttaagagactatatattatctaatttgaggctttgtcccaaatttggtttggagtgagtttttatgactaatctaccagtagggtgaaataaatagcatcattcatatcaggagtaccaaccaaccccataagagatattgaagagacaatgccaaccttccattctggagtaaagctatagtgcaagaaaacaatttgaaccaattattttcatactaagttgacagttaagacagaaaaaaatatatatattaagagccaagagatactgcatatggtctgcaagtcttttctggagaaatgaatcatgaagataaagagaactggcttatttttacagttacattttatatttctagaaaaataactacaacatggtcttgatgtctaaacatagggaaatgagacttttatgaacgttacacaacacaaaacataccacttgttgcagttacaactacgtgcaagtcattctcaagccttaactaaaaccaaaaacagataataaaacatatagttacaaacattattctaattgaactatactttgaaaatgactgaatgctcaaatattcttaaaatacaatgttctcttgccaagaaaagagtgttggtcttaaaatggccacaaaacctagccccgtcccatgttactagagctacagaatcaagcaccctccaaatatatggccaagcagccttggaggcacctaatgagtccaacgcagtcttcccatgtgtctcagaggctgctgtctgtagtgacagaggtgatagaatatggtaaagttgcgtatctaggaaaatctcaatgtagtccctgatttcccagagaatgttcttgtggcttatcctctgaggttagtagtttcagtttagtacattaattccaaacactaaagagatgaatccattcaagtcatttacagaaaaattgttttgagatttacccaaaaaacaaacacactataaagaatttagtaacagagaagattagaacttgcacttttgcttctgctggttcaagttttgttctgatattctctgcatttcctatttccatatgagaaaaccaccagtacatctttgctgtgtgaataccaacactgagaaatattggccaaacataaagatttttagagaattaatttttgatattcatctaaacaagccaatatattctcacaattttttaaagaaaaaaaaaagaactcagcttaatcatatatttgacttctaaaaaatcatctcatgattccatgaagatagagaaaaaatcagatgaacaggaatggttttcatttcacactggaattataagaaaggttaatttttgcataaaaattacatctacataaaaataatttctggaacaatgcattattgacagttatgtgggaagataaatgcattcacgtaaatgttctttctcaagcaaattactaaatatattgacagcactgcactttgaaaacaaccattttaaggcaaccaaatacatatacaagagtaaaaacattacatataatagccaatgtaatgtttcactcaatgcatattcactcaaatatgcatactttttttcagtttattgatatatactgctattaaattaaatagcaaacacttatgctttgttgttggctattgcccacagaaggaaaaaaatgggtagtcaactggagcctattcacacttctgttaattactggtggtccatggaagatgttatagtttgattactagcacttgtaaatattaaccaagtctaagttactgctataaaatccaaaatgtgtaaaaaccaaacacacctatacaaatacaaatgttttactcatgatcgttaatgactttaatcaagcagatcttctaattaattttgctaattgttcattcctctcaggacatttattggtttgatggatattactatgacatatgttgatgccagcatctggtcagaaatgagggcatcaataaactctccttggtgtttctacagaatgtgccaatgctataaacactgtcaatgccacagcatttatttcaatataagattttgagaacatgtctgcctttcatttagagaaaggataaacctacttcgaaacacacggtgctcaaatatgcttattcaatgaatggtgcaatgagaatggcttgataacaaactggaaaacatctgccaacatttaaaatagaataataacatcataaacgattattaggaatggcttcccccacaatgtactctgtcaatttataccctatttcgaatatgtagactaactttaaacaaatatagtaccgctatcttaaaggaagtgatcccctaaacatttctgaccaaaggtaatcatatgcagtaaattaatagacaagaaatgcatcagaattcgattcatgtatagaaatttggctaaacttgcaaacttttatgttgttagtaactattcagagattatcactttaaactgctgacaaataagtgcacttatgcagttttatttttaaaaactagttatcccaaaatatcatattaaataatacaccatgctgtatctatatttcaaaattattttaatggagatttgatctccaggtagaggcaaaacactgttttctccttctggcccccattagggaaactgtaacagtatggttgtctcccgtttctacacatgaatctattgtcactctactgtcatggcttaagaaaaaaatattgcttctactcaaggtgccaaactgcaccaagcaaagtaactccaatgcagtaacattaagtttggcaactgcaggacaaggtttccatccttgaacaaggagcactgatacttcactattttgccccccaacatcatatttccccctgcattctgaaggtttttttaaaaaatatttgtaacaatgtttttgtatgacactggcatcaagtctcccaggcagcatgcatctgttttaatttcatttgtattcgttactcctttcttctctatctgagtccaagagaatcactgctaacacacccagcactactcaggatagacaacgacagaatgaaacacttctgaggaagcctttccggtggcataatgccagcactactcattatagcctattttatcacagagccgtcaacattacggactcgaataacccagataccagcggcatccccttgcacgagctcatctgcggagtacaaggaatacagatttggaagaaacctctgagaggttttctaatctttcctctcttccttctgacttctaactttaacgtgagcccaccccaaagaagagaactagactctcttagtaacttgtgcaaaccttcagaaaagtcttaggttgtacctaaattcctcatgttgccattccaacactatttcctgtagttttccctttccagatgcaggagtccacagagcaagtatccttataagtgtctaagaatcatcaagcaattccaaagttcccgtgtctctaatctactgatccaacgtgcccggcgcacataagcagcaccgcgactgaatttcaagtcttctcaaactcacacctcagttgctcagagaggagaaatgcagcgaggactcgccttcctggccagtctctgaaaacgcgaaaccttcctgagctgtccatttgttttaggggctgtttataaacggctggttttcttggaggaaaaataaacaaataaatacggggcgatggcagcatcctgataaacacaggaccttgtttggcttttggcaagttgtaacctggagtaaaatcacatccaagttacaagcacgcaaattggaatttcgctggaaacactgacccgaccttcaccgaagcagcaaatcgcagtctctgctgctctgctcctgctctccaaggcttaacattggaaagtccatgcccacgtccccctctaattaatcaatgtagaaagaaatacgagggaagagagagggagcacactccacaccaaccttgccagcttctattcttcctgctattccttaaaggcgatgcacagcgcacctggaaattacgtggacttggcatggctttttaatattaaagacaaacgacctttggaaaatatacactgttaaagtcaaaccatttggagagacacccagcaatttacctcctcaaactcctcggaaccccaagaatgaggaaaggaaatggaaaatgcgcttaacccgggggtggtgggggaatcgataaccagaacaggtttgaaaaaaaaagcccccctcccgccccctccgtagagaccgctagctgaggctgcaacacctgccccggcaaagcgtctccgcagccttcccggcttgcccgactcggcttcctccgcctctgccccggctgcggcaccacttcttggagccacgtctcggcgagcgggggccgcggagcgagggggccgctgtgccgctactcacccgagccgctcgggctggccgcgagccgggatccgcgagggctggcgggctctggcccccgaggacgcagacatgtggcttgaacctccgctcccctagccgttgcctctgtgcatctttctgggcgcccccagcgaatgcgagcggcgaggcgagggcgagcgcgccgaggaagggcgggagaggcgcggagcttggccgcgccgcgctgcgccgagcgccgggctctccccgcgagctccccgggcccgcgcgcgcgccccccac

SEQ ID NO: 1729 - DNA, 77219 bp, Homo sapiens
caggagttagaagccgctcttcacagagatgacgtggagtttatcagtgacctgattgcctgcctgcttcagggctgctatcaacgaagagatatcacgtgagtaattctgatctttctaagcatttcttgccccaagaactaattaaccaaccatagtgatgtttcctgtctcctgtgacaaaccagaaccgatcattaggcatcacgggacactgtagatggaggacgtacacgtaaatttccaggctgtgtttggcttattctgcagttgggtttttattccatcataatctttgagtttatttcattctcacaaatccatatcacttactcttggataccccagctaacatattttagtgtagaatttcttcttatatttgccattttctgattttgcagtattggtaaagtattgcctaagaaatcaaaactagtttttattacctttctgtcatttgagtatcttctgttgtttacatagccagcagcactgatgtaataaaaaaaaaagagagatgtgtagagacattgagcaaaatgtgatgtatggagacaaataaaggagagtcctgataggacctcttgttttgatctttacttaatacacgtttctttgctatgtgtctatataggacagaactacagggcaaactcacaaaaaggtgagatgcaatgggtttcctggtctcttgccttctgatgccatgtagggggtttgagttgttatggtttgcctttctcagataggtaaaatggtatcaaattttttttttttttttttttttgagacggagtctcactctgtcgcccaggctggagtgcagtggcgcaatcccggctcactgcaagcttcacctcccaggttcacgccattctcctgcctcagcctctcgagtagctgggactacaggcactcgccaccacgcccggctaattttttgtatttttagtggaaatggggtttcaccgtgttagccaggatcgtctcgatctcccgacctcgtgatctgcccgcctcgacctcacaaagtgctgggattacaggcgtgagccaccgcgcctggccaagtatcagatatttttgttctaacgaattcagtctgttagggctgggaaacgatgcttgttgttaatgtgcaataaagttgtagacaaggtaagaaggagatgtaaatgctgtttttctcagggtggaagtctgcattctctaggggagagttattgctcgtgcactaagtataatgacttttccccctagaatacccaggttgtatttgtaaataaaaataaacataaaatataccttagaatattttcttccgttctctatttaggatgtagacttgggagtttgtaatttttaagcactgttgtattcgtaccttgtgtttaattccacattttcataacctggaattttttttcattatagcaatcagtttcttataaccacattttctaaatgtcattgtcaaataatccagtctggtagctgacaagttatgtctagcttttagctgttataaacatatataatgcatagctttgtacaaaattcaccaggttcctggaagtacatcactcagtcaaaagatatgcccatttaagatcttcattttaagcaaggcttaaaggcttttgccaggtttcccgtcacagaggtggttgtattttagccttaaatgatcagtgcgtgagagtgtctgcttggatgatccttgtgagccctctgtacacagactagtaggtactggcagcacaaacactcaccagatctcttagagttcacagttgtgacagggaggtccatgaatcattacagtaatgattatatagttgccagttatgtaattacaacagtaagtgcttagaaataaaaatacaacatattaacagagcatacaacctggggtaagaaagtgacttgtgaactgagccttcacatatgggctgttttctctcataggatattcctccgtggctgagttcatcctctaatttgtccttctgtttaaaattgatcttaactaattctgcttgtttgttcttccagatagtggttacaaagttatgtcctgttctttaagaactccccttatctaatcattctaactagaatcaaataaacctatgaagaaatgtgggcaaaattgacatccctacaatgtggtctttcttttttttttttttttttttgggacagggtcttgctgtttcacccaggctggagtgcagtggcaggatcctgtctcactgtagcctcaacctgggctctagcagtcttcccacctcagcctcctgagtagctcaggacaggactgtgccaccatccccagctgatttttaacaattttttgtagagacaaggtctgtgttccctggctggtcttgaactcctggtctcaagcgatcctgctgccttggcctctcaaagtgctgggattacaggtgtgagccactgtgccttgcccctacaagtatttattaaataatagaataccgtatccctgtatctgtctttaatttgcagagtttattggccttgatttttttcttgagttagtattcttttgactctctaggattattatctatctcttttttcagtgttaatactgatgtctgcttcaagctgtattatccattgttaagtaacaaattaccctaaaacttagcaacttaaaaccacaaaaagtgtaatcttacagtttctgtgggtcaggaacctggacaaaccactactggtgtgtttagctcgagttagcttacaggtctgtgatcaaggtaccagtgacagcagtcatcttgaaacttactactcatgtataatacacacacacacacacacacacacacacacacacacagagaaaagtgctcatttcctaattctaaagctcaatgaattttcacaaactgaacacacctgtgtaacagagaacctggacaagaaagaacactacaatctactttacttttttccctgaagggaattgcctaaaatgatggttccacatgcggttactgtgaatgtacactcgttcttgtctgaagttctactttgatctcattctaaagaaagagaaatttggataagtaaatgtttacctgttatgcctccaagactaaactgttctatgcagcttaaaaagttacttaatttcggccgggcgcagtggctcatgcctataatctcagcactttgggaggccgagacgggcagatcacttgaggtcgggagttcaagagcagtctggccaatgtgatgaaacccggtctctactaaaaatacaaaaattagccaggcgtggtggtgcacgcctgtagtcccagctactcaggaggctgagatgggagaattgcttcaacccgggaggcggaggttgcagtgagccaagatcgcaccattgcactccagcgtgggcgaaagagtgagactccatctcttttttttttaaaaaaaaaaaaggccgggcacggtgcctcacgcctgtaatcccagcactttgggaggtggaggcgggcagatcacgaggtcaggaaatcaagaccatcctggctaacacggtgaaaccccgtctctactaaaaatacaaaaaattagccgggcgtggtggtgggcgcctgtagtcccagctacttgggaggctgaggcatgagaatggcgtgaacccgggaggtggaggttgcagtgagccaagatcgtgtcattgcactccagcctgggtgacagagcgagactctgtctcaaaaaaaaaaaaaaaaaaaaagtaacttcatttagttgtgcataattcgcctcatctataaaatggaattagtgacaatattcagtaaagttattatgaggattaaacgaaatgatgagtgagagtaatcatcatgaaacactatgcctagttcctccaaaggctcagcagaaaacagattttgactcaaccaagtgtctgtatccttttccgttgtggtttgcatgttttagaacaggggccagcaaatgttttttgtaaagggccagatagtcaatacaggcatgcatcacatactgtcattttgttcagtggcagacctcatgtacgacagtggtcacacgaggttgtgatagacacaaaaatttttatcccctagagatattattgcccttgtaacatgcttgcacatgcattactcatgtggttatggtgatgctggtgtaaacaaacctagtgcgctaccagtcatataaagacctagcacttacaggccaggcgtggtggctcacgcctgtaatcctagcactttgggaggccgaggcgggcggatcaccaggtcaggagatcaagaccatcctggctaacacagtgaaaccccatctctactaaagatacaaaaaagtagccgggcgtggtggcggcacctgtagtcccagctactcgggagactgaggcaggagaatggcatgaacctgggaggcggagcttgcaggaagccgagatcacgccactgctctccagcctgggtgacagatcgagactctgtctccaaaaaaaaaaaaaaaaaaaaaaggcgtggcatggtgactcacgcctgcaatcccagcactttgggaggctgaggcaggtggatcacaaggtcagaagatcgagaccatcctggctaacatggtgaaaccccgtctctactaaaaatacaaaaaattagccgggcgtggtggcaggtgcctgtagtcccagctactcgggaggctgaggcaggagaatggcgtgaacccaggaggcagagcttgcagtgagccaagatcatgccaccgtactccagcctgggcgacagagcgagacaagacatagcatataccgtcatgtacactacataatagttgatagtaaacaactcttactggtttctgtatttactatgccgtactttaaatcattattttagagtgtattccttctagttttgtttagtttttttgacacggggtctcactctggcacccaggctggagtgcagtggtgcagtcttggctccctgcaatctccacctcctggtctcaaacgatcttcccacttcagcctcccaagtagctgggactccaggcgtgcaccaccaggcccatctaatttctttattttggggtagaggtagggtttcatcatgttggccatgatggttttgaactcctttttttttttttttttgagacggtgtcctgcctcagcctccccagcagctgggactacaggtgcccaccaccacaccttgctactttttttgtatttttagtagagacggagtttcaccgcattagccaggatggtctcgatctcctgacctcgtgatcctcccaccttggcctcccaaagtgctgggattacaggcgtgagccaccgcgcccagcctagttatttttaaaaagttaactataatatacaacagcctcaggcggtccttcagaagagattccagaagaaggcattgttacaggagatgacagcaccgtgcatgttactgccttgaagacgttccagtgggacaagatgtcgaggtggaagacagtaatattgatgatcctgaccctgtgtcggcctaggccgatgtgtgtgtttttgtcttccttttgaacaaaacagatcaaatgtaaaaaacaaaaaatttcaacaatagaaaacagcttatagaataaggatataaagaaggccgccacacagtggctcatgcctgtaatcccagcactctgggaggatgaggtgagaggacggtttgaggccaggagttcgagaccagcctgggcaacatagcaagactccgtctctactaaaaaataaaaataaatgaattagctgggcaatatagcaagacccctgtctctactaaaaaaattaaaataattatctggacatggtggtgcatgcatgtagtctaagctactagggaggttgaggtgggaggatcaggagttggaggctgcagtgagctacggtccctactgcactctagctgtggctacagagcagaaaaaaaaagaaaaaaatatttttgtatagctctaaaaagtgttttaggctgttattacaaaagaatcaaaaagttaaaagtttgtgaatttttaaatgtcatagtaagctaaatttattattgaaggaaaggttttttttaaaataaacatagtatagcctaagtttacagcatttagaaagtttacagtgatgtacagtcatgtgccaagccttcacattcatttactactcagttactgattcacccagagcaactttagttctgcaagctgcactcatgacaagtgctttatacagatacaccattttaaaaatcttttgtaccatgtccttactataccttttctatgtttagatgtgtctggatccacaaatccttaacattccattacagtggcttacagtattcagtacagtcaggtgcagtataggtttgtagcctaggagcagtgggctatgccatatagtctaggtgtgtagtaggctctaccatctaggtttatgtaaatacactatgatgtttccacagcaacagaatcacctaaccatgcctttcttagaacatatcctttatgttaagcaatgcgtggctattttaggccctcacttgcaacagagtctcactctgttccccaggctggagtgcattcgaccaatcctaacccattgcagcctcaaacttctagattcaagcaatcttcctgcctcagcctcctgatcctgaggaactagtgttacaggtgcacacccaccttgtattttaggctctgtgttgcaggtaatcagctctgtcactatgaaagcagccataggcaatacagaaaaaccaatagtgactgtgtcttattagaactttctaatcactgaggtttgacttttgtatcattttcacctgccaggaaagactgtttttctgttgttgttttttttaattttttttccccaccattaaaaaatataaaaaccattattatagactgttttttgtttgtttgtttgttttgttttgtttttaaaggaggtctggcgcaacgtctcaagcctgtaatcccagcactttgggaggccaaggtgggcggatcacttgaggtcaggagttcgagaccacgtctctactaaaaattcaaaaattagccgggtgtattggcacacgcctgtagtcccagctactctgtaggctgaggcatgagaattgcttgaacctggaaggcagaggttgcagtgagccgagatcatgccacagcactccagcctctgcgacagagcgaaagtgtgtctcaacaaaaaaggacatcaggccagatttggccctcgggctataattttccgactcctgtatttaggaagctagttaactattccagttccactgactcaatctaatctttaaaattgaaatatagaagccacatttcctttcaaccgtactctccaacctgaggtttttgcacttacaggacagcataacactgtctactcatggaaatgatactggccagcatgtcctatgtcctggacgctgccaactgcttctcaagaacactcatttaatccttccgacagccctctaatagaaagtcctctcccatccttccatcagggatgaggaatttgaggcacagagaagttaaataaattgcccaaggttacacagctggtaattgagacagtacagatctgtttcctagacctccgactcctaactgcagccccgtgctgtcaatgagaagtacaggagaaaagtgttaagtaaaacagttttccttgaaaacaggatttttaactctttgacatactaaggaagcctgtgaaccccatctaaaaataatgttttgaaatcataagattacacccgaacccaattatactgaaaagtagtgaagtattggccgggcgtggtggctcacgcctgtaatctcaacactcttgggaggccgaggcaggccgctcacatgaactcaggagttcgagaccagcctgggcaacatggtgaaaccccggctctacaaaaagtattatacaaaaattagtggggtacagtggcgcacacctgtagtcccaggtactcgggaggctgaggcaggagaatcagtggagcccaggaggcggaggttgcagtggagatggtgccactgcactccagcctgggtagcagagtgagaccctgtctccaaaaaagaaaagaaagtaaagtattgaagaatgaaatttttgatatagttagtgttgtattcatctaacagcagagctaatttcccaaaattactgtcttcagatctcagtgagcataagtgctatttggaaatatctgcagtatctatatgatttcagtagaaatcagttatttctgtggacctctgctttaaaacgtgggttttgtttgttctgtttttgttttgaagacgagatctcactcttcagcgcagtcttgagtgctgtggcgcagtcatagctgactgcagcctccaactcctgggctcaagccatcttctcacctcagcctcctaagtagctgagatgacaggcaggcaccaccgtgcccatctaaaagggtttttaaatcctagattgatctgcagttcatagtcaacaacttagacgtaaaaggaacctcatcatcaagtacagtttatttttttacctgaggaagcgaaggcaaaacaaaactggtataagcctgagagacatcgagaataaagtctcaattcaaatgattttttcaggaatttgttcattttgttgccaaaataaagtggtataaagtggtattttcctgggtgtaaggcgtggggctggactccgaggaggcccccgtgatgctgtggaaccctgtgtgcctgtatgtgacacgccactgggggcgtgtcagtcacatgctagtgttcactgtcacactctggagacgccccttgcggcttggatgaagcgtcagccactgggaaagcccacatggctgggaacgcgggtggccttgaggagctgagggcaagccttactacagctgtgcattctccccaggaaaaactaggccattagaaagaatgttaggcaaataatgcaagtcacagaagcatacacaccagtgacttattaagtgtaaggcaaggagaaccaaataaggatacatatatatggaaaacttacgaagaagatcaagtgaaagcttatcgcaattcaggaaagttatcatacctggtgagcagggagaagacggaaggtatgaataagcgcaagtggtgattctccagccttaccacacaatcacctaagggtggttacaacacaaatcgctgggcctcaccagcgtttcattccgtaggcttgggctggggcttgggaacctgcatgctgtgcaagttctgggtggtgctgatgctgcacgctgctggtccaggacttcgctggaaggtcactaatctaaggcattgctcactttctgtttttcagctcgatggtgaaatgtggattcttcatttttgacaattctttgcctttctctttcaatataaaacttaagcagagttttgatttgatgctaacatgttctttgcaacactacatactttttcttctatattctccctggaattgcaaatctggtcagtgggttttatggtcctgtatcaataaaaatactttaggaatttaactagtggctctttcagcacttttgttttccactgggaagtaacctggcaaattgagcactgggtggaaaataggaacttctgatttgctcttcactgtcaaagtaaagctacgattgaatcaaactgtgttttgagctacggtttaagcagcgtaaaaatatttttcattggttgggcgcggtggctcatgcctgtaatcccagcactttgggaggccgaggcgggtggatcactaggtcaggagatagagaccatcctggctaacgcggtgaaaccccgtctgtacttaaaaaatataaaaaatcagccgggtttggtagcgagcacctgtagtcccagctactgaggcaggagagtggtgtgaacccgggaggcagagcttgcagtgagccgagatcgcgccatgcacaagcctgggtgtctcaaaaaaatttttttcattaaatactcatgatgataatacttactgctaaaatgtttttccttttgtccgtacatctttagtagagtgctctttatagaacgcagactgatttgtgcttcagtatggtcttcacccactgtcctgtggcttacactcttaaacggtaattcatcaacattgtatattcaatttttcatgtatttatttatttatttatttatttattttgagagaagtctcgctcttgtcccccaggtttgagtgcaatggcctgatctcgactcactgcaacctccacctcctgggttcaaatgattcttctgcctctgcctcccaagtagctgggattaaggcacccaccatcatgcccggctaatttttgtatttttagtagagacagcgtttcaccatgttgaccaggctggtctcaaactcctgacctcaggtgatctgcccccccttggcctcccaaagtgctgggattacaggcgtgagccaccgcacccggcctcatttaatttttaattatggatctagcattgcgtaatagattccctaatttagatcccttataaacaaacatttagtgttttgggttctctttacagaaatatctgtcatctttttggaaatgacaatacttctgttaagtacgttcatcgtgtcttttttaacataggccagtgttttgtaacaaatgagggcaccacatagtcactatcctactgaagaaaatagacatttctgtcttcccagaaagtttcctttgtagtcagtcttccccatacctacattgtacacctggcaaccactgacgacatttttatcactatagttggagcctaacctgttctagaactgtatgaatgggatcacacagtgtgaaatgaactcacatcagcttctttcattcacatagtgcctgtatgatattcacccatgccattgtttgtatcagtggtttattcctttgaggggggtgggggactaaattgtatctagtgaaaaatatatcacaatttattgaatctgttcttgggatgagcacttaggttgcttccagttggagcctattatgaatgaagctgctgtgaacatttgcatacaaatgcttgtgtgcacttaatttcatttctcttgggaattgctggcgggtcacatggtaaaagtatgtttgacttaaactgtgaaattattttccaaacacttgcaacatttacgtttccaccagcaatatctgaacagtccagttgcttcatatctttttaaatttttatttacttatttatttgtttgagacaagagttttgctctttttgcccaggctggagtgcaatggtgctatctctgctcactgcaacctccacctcaagtgattctcctgcctcagcctcccaagtagctgggattacaggcatgcgccagctaattttttgtatttagtagagacagggtttcaccatgttaatcaagctggtcttgaactcctgacctcaggtgatcacccgcctcggcctcccaaagtactgggattacaggcatgagccacctcgcccggcctagttacttcctatctttgccaacatctgctgtttttaattttactaatcctattgtgttgaaagtggcagctcattgtgggtttaatttgcatttccccgatgactagtaatgtggagtggttattcatgtgcttaccataaatttgtatatgtcttttttggtgaaatatttggccaagtgttttacttatttcttttaaattagggatgcttatttaatttatttattgacttttttgagacagggttcccactctgttacccaggctggagtgcagtgctgtgatcatagcccactgcagcctcgacctcctgggctcaaacagtcctccggcttcagcctcctgagtagctgggactataggtatgctccatcacaccctgcttatttaaagcatatttgttgtagagacaggtcttgatatattgcccaggctggtcttgaactcatggcctcaagttgtcctccagcctcagcctcccaaagtgctggaattacaggcgtgagcagccattccaggccttatcaactttttaaatgtttactaaggaactgttttatattattaattttctttactctttgcttttttattttattgatttctcttttttatttcctctgtttactttggctttagcttgctctttttttttttttgcttctttggagtactgtttttgagccttttttcaaaaaacaggcatttaaagctataaattttccctaaaaaacttttaaatttccttctaacccatagttggctgcatcctgcgaattttgatgtttatattattgtttaaaacatgctctcctttatttcttctgtgacccaaaagtgtattatttaaattcgtgatttagtatgttagtggtaatactgttgagatctgttccttactgttttttttttgtgtgtgtgtgtgtgtgtgtttggtctattaatgagaagccagtattaaaatctctctgattgtggatctatttctcccattagttgtgcccattttgtctcatgggttgtggtgtcctgttattggatgtgtagcggtagctttgttatatagtcctgggaagttgttccatttcttcttatgtgacactctgtctccacatctgctttgtctcatattaatcctcagctttctcatgcttactgtgcctggtagatcattttctatccttttaatctttgtatttttatttatttattttttgagatggcgtcttgctctgtcacccaggctggagtgcagtggtgtgatctcagctcactgcaacctccgcctcctgagtgcaagcaattctcctgcatcagcctcccgagtagctgggattacaggtgcatgccaccacgcccggctaattttttttttatttttattttttatttttagtagagacagggtttcaccatattggccaggctggtctcaaactcctgacttcatgatctgtccacctcagcctcccaaagtgctaggattacaggcatgagccaccatgccaggcctccttgtgtttttttaaagtgtacaattcattggtttttatgtattaacaaaattgtgcaaccatcaccactatctaattgcagaatacttctattaccctacagaagacactttgtaccattagcaatcattccctgtttcctcccacccacttcccagcgtcactattcttactgtctccacaggtttgagtgttgtaggcccatcttataactggagccatatgggaagtgtccttttgtatctggcttttttcacttagagttatttttcaagttttaaccatgttgtagcatgaatcagtacttcattcatttttatggtaaaataatacttcattgtgtggatacacacttaatccttcagttcatgggtatgtacgcagattttagcttttggctgttaggaattctgccgctttgaacatttgtgcgcaagtctttgtgtggatgtgttttccttttctctggggtgtacacctaggagttggagtggctgggttggtagttcagtgcaacttggcgaaacttccacagcagctgcacacttagccttcccaccggccgtgtgtgaggattccgtgtctctgcatcctggtcagcacttgttactgtgtgttttttgacgtcctccattatagtggacatgaggtggtacctcattatggttttgacttgcatttcccaagtggctaaggttgagaaacttctctgctgccttctgctttttgttcctttgttggtcctttaatgctttcttttaggcacatgaatttgttttaagtgtatcactttatttccactattggcttcttattctgtgtgtgtgtgtgtgggggggtgggtgtttagcagtcgtagggcaaacaatatatatccttaaattttatccagagctattcagaatttttattgtacctcttcatgccttatacatgatacttgagacttctcacttcatctgtacagtatttaggttccattaaaaaaatagcctttatcattttaaagatacatttggggtttattcactttcttggttacccaacataaacattcataaacacatgtaaaaatctgtattatgtacatgtttctctaggcaaagatgttttgcagattctgccttaaccatattttcctttaatttgaaataaccatgattttaacttatcttggctgtcatgttgattttagtatgtgggatatagtagctattctacagccctagagaagaagaactgttattttaattattttggcctggtctttttataagcttcgagaataaatgctttatcaagtattcatacagaatcttttacttgttgctttactactagaaccagaatatttatctcaattcagtacttatgttaaacgtggcctgtgtgtacatgtatttcatttgcttcacaaattgttgtagcaaatgggagaatgcaatttgatttttcatcttatctccattctgggaagcctggtgccaaacctttattgctcccctgtagagagaccatggctgccctttcatgtccctaacacatgcctcaaagaacttaagagtcttcttcttgtgatctccccaaacagggtgcagatattaacaatgtgttgtcctacacagtgaagaattctgccagttccagccggcagaggcttgtgctggaacacttgaatcaggtcgtgccgtccttggtctcagcagtagaagcatgttctgtctggagcaagctgagaaattctctgctgggcctctaagaaatggctaactttaagagtttggaaaggttgttgactcattcttattttcactctttcttgctctttcactcatagagggaaaaaaagaggtaattaagagccagtctcttactgctgttttgtaggatggaaaatgaatgcgaaaatgggtcatttaagagtatttggaacttttcctagacaagaaataaaatagaccttgttgttctgagaaattccgtttggtttgatctttgcattactatttttaaatgaaatgttttattatagttcaagataatttcagaatgatgagaattactaagtcattaagagggaattgcaaggagatgaatggatgagtaagtgaatgaatgttccaggtaatctaaacttgagaagcttaaaaatatgtacacattagtttttagcagcacagtgccactgttctttttcctttattttattttactttatattttattttattttatttttgagacagagtctggctctgtcgcccaggctggagtgcagtggtgcaatctcagctcactgcaacctcctcctcctgagttcaagtgattctcctgcctcagcctcccgagtggctgggattacaggcacgtaccaccatgcctggctaatttctgtatttttagtagagacaggctttctctgtgttggccaggctggtctcaaactcctgtcctcaagtgatctgcccatctcggcctcccaaagtgctgggattaccggcgtgagctactgcgcccggcctctttttcctttaaatagtaaaacctgaaagtacatgcaaaattgtgtgctcatttttctgggggagaaagtatgtagtctttatcaaattattaagtgttttctgtcctatagaagatgaagaaccagtaagtcaaaagaattagcctgatttttagcttcctgaagcctttttatttcaaatcacccttagccagtgcctttgccctcaagagatttttccccattcactctctgatgtttaaaaggagatgtagatttctaggagaaggttgatctacatacaaggaaatggaattgtcttggattgtaggccctcaggtgtctcctagttaaggtggcatggagatagatgccttaagaaagcttttagcaaaagtgatgtaatttaaactgagtaggacaataggcctgttgggaaggaatctgaaacatggaattgtttgagacaagtaagggcttccagacagactgttgtctaaaggagcagcactgcggatgcacacgcagtgtttgtgggctggtatgcctgtactttctcaacctcacattggaataagaaaggtctcgctccctggcccagcatcttctgcacatcctccagtgaagctgctattctggtgaaatgatacagatttcactgattccatgttttattttattgcaggaaaaaacagactttagtgtttgtggaacttggtgtacattagaaattctcgaaagcatgcggtagataaagagatttattgccaaaggatgattgtcttctacacacttctggctactaaaaaagcagtttttaaaaaaacactttttcattttctttctttctttctttctttttggagacggcgtttcttcttgcccaggctggagcgcaatggcgcgatcttggctcaccacaacctctgcctcccgggttcaagcgattctcctgcttcagccttccagagtagctgggattacaggcatatgccaccacaaccggctaattttgtatttactttagtagagacggggtttctccatgtcggcctcccaaagtgctgggattacaggcgtgagccaccatgcccggccaaactttttcattttcaaattcaccgttacgacactgtctgcattttaatgtgagtttgaactactctttgcccggctcctcactctggaagggttggtagcaacttcacagacaatggagaggcagccagtccaaaccctgcaaggttcaagcactcagtaatggccggtgctcgtgtgctgaatgtgaatgctgtagtccagtgagatttgtgagagccctgattgttagaactgttacgctgcattttgataaagctgccatactcatgttttcccccgtgagatagtaagagtaggggaaagatgtttcttctctctttgaaaaagcaaactgtttaagtgtttttttgttttttttgagacagcatctcactctgttgcccaggctacagtgcaggggcacaatctcggctcacggcaaactctgcctcccaggttcaagcaattctcctgcctcagcctcctgagtagctgggactacaggcacacgccaccacgcccggctaatttttgtatttatagtagagatgggatttcaccatattggccaggctggtctcaaactcctgacctcgtgatccgcccacctcggcctcccacagtgctgggattacaggcgtgagccaccgcgcccggcaaactgtttaatttcttatttgcctaagccttcttaattttttccacaaatatttcctttcactttgctgcaaatataactaccatagattataagtcaacatagtagttgcctaattttaaaatgataccaataacttctttaggcctctttgcttattaataagaaaaaacttttcacatcaagcatgaggtaaattagatcttgattcttaatagttgagatgtaaaataaccatctaacaaacagcacattattacatggaaggcatatttaggtactaatcaaaatacgtggctgggcacagtggctcacatctgtaatcccagcactctgggaggctaaggcaagcggatcacctgaggtcaggagttcaagactagcctggccaacgtggtgaaaccctgtctttactaaaaatacaaaaattagccggtcatggtggtgggcatctgtaatcctagctactcaggagactgaggcaggagaatcacttgcacccaggaggcagaggttgcagtgagccaagatcacgccattgtactccagcctgggctacaagagcaaaactccattaaaaaaaaaaaaaaaacgggtgtggtggctcacgcctgtaatcccagcacttcgggaggccgaggcgggtggatcatgaggtcaggaaatcgagaccatcctggctaacacagtgaaaccctgtctctactaaaaatacaaaaaattagctgggcgtggtggcaggcgcctgtagtcccagctactcgggaggctgaggcaggagaatggcgtgaacctgggaggcggagcttgcagtgagccaagatcgcaccactgcactccagcctgggtgacagagcaagactctgtctcaaaaaaaaaaaaaaaaaaaaaaaaggtatttacacctggatgtggtaagacgcacttatagtccagatgctctggagaccaaggtgggaggattgcttgagctcaggagtttgagtccagcctggacaatatagtgagaccccatatgggaaaaaatatatttaacacaattatagggtttccagactgtactgaagaaaaaatttaaattgccatctaggtgtcttaaatgttctctgcagaaaaactatcttcaaattttaatatacagacatgggaggattgcttgagccctggagttcaagaccagcctgggcaacatgctgagaccccatctctgaaaaatcaaagaaaggacgggcacggtggctcacgcctgtaatcccagcactttgtgaggacgaggcgggtggatcacgaggtcaggagatcgagaccatcctggttaacacagtgaaacccggtctctactaaaattacaaaaagaaattagccgggcatggtggtgggcgcctctagtcccagctactcgggaggctgaggcaggagaatggcatgaacccgggaggtggagcttgcagtgagctgacatcgagccactgcactccagcctgggtgacagagcgagactctgtctcaaaaaaaaaaagaaagaaagaaaaatcaaagaaaaaaaatttagaatgcagtgttcatgccttaaagttcatgtataatagaatatgaaattatagttgcatatcagtgtagccatttgtattctggaggactttctgcctttgtatcttaacctgaaatataaattaggttaggccaactatgcgtttcttttttccttttttctcgccacctaagtcatgaacccaactttgtactgtctgaaccgcagggtgtcttcagttgtacgcgtagcgggtgagacttttgcctcagcttcataacctacacatttgattatgcttttacccattccaccagaatgtgctattcgggctttaaagtcaacctattctgtgaaaaaccctctttatatatttatcttccttgatagttgacaaaacacaatatccatgtaagtaggctgaaacttcatgagggacttcctgttactgtttttcatttctgctttctgtgtaaaatttgtcaactgggccaagcgtgttacctcacccctgtaatcccagcactttgggaagccaaggcgggcggatcgtgtgagcctgggagcttgagaacagcctgggcaacatagggagacccctgtctctacaaaaaatacaaagattagctgggtgtggtggtgcatgcctgtggtcccaggtacctgggaggttgaggtgggaaaatcttttgagcccaggagagctgcagtgagctgagatcttgccactgtgctctagcctggatgacagagcgagaccctgtctgtataaaaacaaaaatctgttagctgtcagatcatgagttctctctctctctccttctcccaaccaacctatattttatattaatgtatttttgtgtttggggccctggtctaggcctcagacattccacagctacctagaggacatcatcaactaccgctgggagctcgaagaagggaagcccaaccctctgagggaagccagtttccaggacctgcctcttcgcacacgggtggagatcctgcaccgactctgtgattaccggctggatgcagacgatgtcttcgatcttctaaaggtatgcttaactggcgaacctttccctgtagctgtgaaaagccagcaatcagaaatgtagtcagaacgtaaaacccaaagatactaagccagagtttggcttgtggtactagtcttggtactattcattgccaataacactgtatggaaaaccatgactgctgtagccacggagatgcaagatgtacatccctatggaagtacgttattttggtctaatttctagtctggtttcatcttcctttacgtgcactgagtcctatctgcaataggtacaaccagaggaccctgtttgttctgtcatcagccaaacctgcaactaaatccgccactgagttttatttttcagggtgtaaatttgattgaaatatttactgaaatctccaagaacttgaaaccgtatatgttagtgaaggtcatcctctacacacatccacgttacaaaaaatgtgttgaaggaagctgtggccatctctctgtcccccttggtgtggttatctgtttagaagtatatcctagagggggccgggtgctgtggctcacgcctgtaatcccagcactttgggaggccaaggcaggcagatcacgaagtcaggagatcgagaccatcctggctaacacggtgaaatcccgtctccactaaaagtaaaaaaaaattagccgggcgtggtggcaggcgcctgtagtcccagctactcgggaggctgaggcaggagaatggcatgaacccgggaggcggagcttgcagtgagccgagattgcgccactgcactccagcctgggtgacagagcgagactccgtctttaaaaaaaaaaaaaagtatatcctcaagggagagtgtgggttattgctttcactcatagggaagtcagtttctaatcctgttccatcatcagtgattaaatgtggtgatgacttctcagttgagctctggttatgggcacattataaaaaaatcattgtgtaatttagcacggtctttgctgaggactcaaggacttcagtagcagtgagaaggccagtacaggtcagcccccgaggtaaattgggagccctgtcactggaactcagctggagtgagaggtcacaggaggttatgccggaactgccacagaggatcccatggggcaaagcttgccccgtgcctgatccacccggttgtacttgtctttcttttcgtgtgtgctcacataaaacaaccgctcccagccaaatctgtaaactgttcatcaggattgctgttggattctctcttttttgaaaagggaacaatggtggggatagggagcattgtaatatttccatctcttgttcctcaaagtaggtaccaccttcccattatatccgtgtttcttatgctgattgaaaattacataagatacttggacatttttatttatttatttatttatttattgtttgagacagagtctctctctgtcgcccaggctggagtgcagtggcatgatcttggctcactgcgacctccacctcccaggttcaagcgattctcctgcctcagcctcccgagtagctgggattacaggcgcgcgccaccacgcccagctgattttttgtatttttagtagaggtggggtttcaccatgttggccaggctggtcttgaactcctgaccccatgatttgcccgcctcagcctcccaaagtgctgggattacaggcgtgagccaccacgcccagcgatacttgggcatttttagatttgagttatgcttacgtgtaaatttggaatcctcgttctggttttttcctggtgcgttttgttccccatttccccaaaccccttttccgtgctctgtgtagggcctggatgcagacagtctccgtgtggagccattgggtgaagacaattctggggcactatattggtatttctatggaacacgaatgtacaaagaggacccggtgcaaggaaaatccaatggagaactctctttgagcaggtatgttcttcagtgttagggcatgatagctactgtattaaaatgtcattaagattaaatgcatcagaattctacagcacaatttttttttcctaatgaaggaattctctaagcatgcctgcaaagagatggtaaggagatacttcatgcaaaaacaaaaaggaattaattctctgctaccagaggggttaaatatacttttttaatctgaagttcttgataggaggtttctgagaaatgccactcctcttgccacaggctattttaatatagcaggtttcttctcagcagcacaatcatttcactgcagtaacaatttcatcttgcatcatcagtccttgagatctccttatttcgactagaattaatgatgtagtttatgccaggcgcagtggctcatgcctgtaatcccagcactctgggaggccgaggcgggcggatcacgaggtcaggagatcgagaccatcctggctaatacggtgaaaccctgtctctactaaaaatacaaaaaattagccaggcgtggtggcgggcacctgtagtcccagctactcgggaggctgaggcaggagaatggtgtgaacccgggaggctgatcttgcagtgagccgagatcgcaccactgcactccagcctgggcgacagagcgagactccatcaaaaaaaaaaaaaaaaaaagaatttaatgatgtagtttatgaacgttagtatccatcagtttaagaacagaaggaatttaaatgatgcctgaaacataagctttactaagtaaggaagaggccgcatttccatagcatcccaaaacaatgctaacctcttatttaggctttcttactgctaggagaatgcttactcttcggaaggtgttagttagatcttaagcacattttagtattgcaaaatgttagttttcctcagatccacagtctaataatgaagactggaagttgctgttcccttttcctttcactgctacatttaatcctttttggtaatctcatggccagaaatactgttttaaaatcatatgtagcaatgccaatcctgtgccagaacatttctatttaatattatttattagggaaagtgaaggacaaaaaaatgtctcaagtattcctggaaaaacgggaaaaagaagaggaagacccccaaaacggaagaaactgcaggaggagattctgttgaggtaagaaaatcttgttagttgtggtcatagaccatggcagaagggaccttaattcatttattcctttttctttattttgcctgtgccatgggaagcacattattatagcaacctgaaactgagtccttatgaaattaccacatgtgcagtacagtcaggaagcccttagtgtgtgacatctggcaagtcacctcccctctctaagcgagtcctcttactagacgatggatgtgcacttaatgaggattatattgaacaagacagtttttttcattcttcaattttatatttaattttagcaaagaaagatacttgggggattttcttttatatgtcattatcttctaggaaatttcaccatgtgaatcttgctataggacttttcaaaatctgacctatgctgtgtaaatacactttttacttaaggatcagctctatcactaagcctattgaagtgaggctgtattcttaaaaattctgataactcaggacaagtggcttcttcccttcctacttaatctaaatgcttgagttaggctgaatttcaccctgtcactttttaaccactaagaaatatttctgggaaatcagattaagaatatagatcactcaggagatcgagaccatcctggctaacacggtgaaaccccgtctctactaaaaatacaaaaaattagccagtcgtggtggcgggtgcctgtagtcccagctactcgggaggctgaggcaggagaatgacgtgaacctgggaggcagagcttgcagtgagccgagattatgccactgcactccagcctgggcgacacagcgatactccatctcaaaaaaaaaaagaatgtagatcactcagatcctgattttaactcaatcagcatccacttaactttacagaagttcagcttcagattgcagctgcctatttcttgcttatccgtttctgtgacaaatgtcctgtaattacttaacgttttatgtatcaacacctgtttccgggtttgttaggatttcacacgtccttcgatattcagaaagctgcatgatacctgtctccgtttccccataagtatcaagaatcacagtagcttagggttgggactgtagaatcattttaacaagcatccatggacttgtgctaccctctactggtgacttttttcctttagagctgtgtgtgtaagccagtatttaaatattttttcattaaatttaaaattcagtttctggttcacgctggccacgtttcagatgctcagcagccacatggtttattggataatgccaatatagaacattttcattctcatagaaactttaatcgaaaacaagcgaaaagtccacagagtgtcctttctgtttcagggatacaagtgaaaatgatacttcatcctaatgcgttatacactttgcattttgtcatttaatctccaacgtccctgtgaggtaggcactattaatagctccattttgggggaaagttaattaactttcctgaggtcacattgtaagtggcacagcttgaatagaggcattcccccttcggagcccatgctcttaaccctctgccttaggtaaggatcaattataataaatacacctgtcttcagtgcggccctgaatcagggaggaggacattggaatccctacagttcttttttcttggcatttaattattaacagttgcatctctctcttgactggagcagtgataaaaaacaagaacaaacaaacaaaaaaaacagtgcatctgtttgatttccaaaaaaagctttaaaagttactgttttctggctgggcacggtggctcacgcctgtaatcccaacactttgggaggccaaggcaggcagatcatgaggtcaggagttcaagaccagcctggccaacatggtgaaatcccgtctctactaaaaaatacaaaaattagctgcacctggtggcgggtgcctatagtcccagctactcaggaggctgaggcaggagaatcatttgaacctgggaggcggaggttgcagtgagctgaaatcgcgccattgcactccagcctaagtgacagggcaagactccgtctcaaaaaaataaaaataaaaaataaaagttactgttttcttatgcattgatactgttgccataacatagggtagctgtatgtcagtacttccctcctagaccagcatgcctgcatcttagtgttcatttattcagcgttccgcctccaagccttgtccccttaacacacacacatacactctctttgtgttaaattaatgggttctaccatcctggggtggcacagaacaattttggacctgtctttgttttaattggcacctctttttcctgtgtttcagtgaaaagcaggaagaaaattccttggcatccgagccacagacaagacatggtaatgttctttactggcatttagaaagaattaaataaatatgattcatttatgctagggtgttgactctttttctagagtcatacaaagtaaaggttattgcaatagccttttacctaccccctgtactcttcttcagttctcctcctcacaccttatcctgtgcccagctcatcatctgactaaggattaagatcagaactagatcttttcactagtgccctgtttactggggacagtgtaatagacaccttaacgttggagtgaataaccagcttctcaaagagaggtctttttaatgtcagtgcttcatgacacaatggtttccttataggtttactacatactggtttcctacctagattttaattttgtaatccaaataacataaaaatgggaggcacataccagtttgcacagtgtagttgaggcagggtagactcagcaaagactcaaaatcaaaaccatttctgtcaatatatttaatcatttctagactgtgaatatctatcttgttaaattcacagtagttatatttgtattgcctttagacattacatttttttttagttgttaacaatgactttaacaggaaaaccagaagtatacattgtcaactttaaagtcaaaaagaggccattgtggcggctcatgcctgtaatcccagcactttgggaggtcgaggtggatggatcacttgaggtcgggagttcgagaccagcctggccaacattgtgaaaccccatctctactaaaaatacaaaaattacctgggcgtggtggcaggcacctgtaatcccaactactcgggaggctgaggcaggagaatcacttgaatccaggaggcggaggctgcagtgagctgagatggtgcccctgaactccggcctggacaacagagcaggactctgcctctaaataaataaataaataaataaataaataaaatttaaaagtaggccaggtgcagtggctcacacctgtaatcccagcactttgggagttcgaagcaggcagatcacttgagctcaggaattagagcccagcctggacaacatggcaaaaccctgtctctacgaaaaatacaaaagtttagctggatgtgctggtacacacctgtagtcccagctacttggggggtgctgagatgggaagatggcttgagcccaggaggtgtaggttacagtgagctgagatggcaccactgcactccagcctggacaatagagccagacgttgtctcaaaaaaaataaaattaagtaataggtctcttttttgagttccttattttattttttttatttttatttatttatttatttgagacggagtctcactctgtcgcccaggctggagtgcagtggcgtgatctcggctcactgcaagctccgcctcccgggttcacgccattctcctgcctcagcctcccgagtagctaggatcacaggcgcccgccaccgcgcccggctaatttttttttttctatttttagtagagacggggtttcaccgtgttagccaggatggtctcgatctcctgacctcgtgatccgcccgcctcggcctcccaaagtgctgggattacaggcttgagccaccgcgcccggccgagttccttattttagtcatgacccacagtagaaacaaaattgagaataaataaggaaaggtcctcatgggatctcctgtagtgaatccgttcctttattttctagggtcccaagggccaggccaaggtacttggtggctcctgtgccagacagaagaggaatggagacaggtcaccgagagttttcgcgagaggacctcccttcgagaacggcagctctacaagctcctcagtgaggacttcctgcctgagatctgcaacatgatcgcccagaaggtgcgccacactctctgctctgtcctcctcagtgttaggcctgatgctgcattatttaaggattattcatgagaccttccccatacaccccactgtcctggaaatagtgcagtcttccatcctgtctgaactccagtgttagaatgggacctcatgccaccccctctccttcactgtgggtcctatcatgttctccttcccccagaaagtcctcagtgtctaccacccaccaatagtgacggtggcttttcacagcctggaaccaactttccttctcccatacactcctcaggaaacattccttgagtccctgtgtaatgctttaaaaaaaaaaaaaatcttgtgggtttgtctttgtccttgtagctccattgccagccctttgcctggctctacctgattgtgtcctcttcaccaaattcagggcaagctatagtctcataaaccatatgccccatattatcatgcatgtacaccctacttcatgcattttcaaacatccttcatcctctttttcctttttttttttttttttttttttgagtctctctctgtctcccaggctgcagtgcagcggtgcaatctgagttcactgcaacctctgccttccaagttcaagcgattctcctgcctcagcctcctgagtagctgggattataggctcacaccaccaccacgcccagctaattttttgtgtttttagtagagacagggtttcaccattttgaccaggctggtctagaactcctgacctcaagtgatataccgcctcagcctcccaaagtgctgggattacaggtgtgagccactgcacccggcttttttttttttttttttttttttaaggacaagctctctcactttgtcgcccagactggaatgcagtagtgtggtcacagctcactgtagcctcgatttgccaggctcatgtgatcctctcatctcaacctcccaagtagctggggacacaggctcgtgccaccacacccagctaattattttttattttttgtagagacgaggtcttgctctgctgcctaggcttgtcccaaactcctagcctcaatctatccttctgtcttggcttcccaaagtgctgggattataggcatgagccactgtgcccagcttttattgctttaagacagggtcttgctctatttcccaagctggagtacagtggtgcagtcatagctcactgcagcctcaatctcccaggccgaagtgatcctctcgagtagctgggcctgcaggcacatgccaccacgcctggctaatcttttaattttatctgtgcgtagggtttccctatgttgcctgggctggtcctgaactcctgggctgaagcactcttcctgtcttggcctcccaaagtgctgggattacaggtgtgagccaccacacctggccccctctctacttccttacccatttaaatactactctctcaaaagccttacttaaatgtcactacgtccatgaactgtccttgtttcccccagccttttgtcgcttaacatgtttctttatgcttattttatatctttgtgagttcaggcttcttcatctcaaggaccatgtcttatctttttaacagccacgacacttaatgtcatttcttttcatgtttttttgtttgtttgtttgtttgttttgagacagagactcgctctgtcactcagggtggagtgcagtggcacaatcttggccccccgcagcctccacctcctgggttcaagcgattctcatgcctcagcctcccaagtagctgggactataggcgtgcgccaccatgcctggctaatgtttttatatttttagtagagatggggtttcgctgtgttggccaggctggtcttgactcctggccacaagtgatccacccaccttggcctcccaagtgttatgattacaggcgtgagctaccacgtttagcctgccttgccttttctatggtggttggttgataattattcagtttgcttatttcatatcgataataatatttctgattattgatacatgttaatagaggaccagaaatatttgaccacttgccagtgaaatatgaagagaaagtatttgtaaatcatcactgcagtacctacagggaggcaaacatgtcaaatgtattatttaatttattgtagatctggtgctgtgtctaacccttaagcaggttgatgctttagggaaagtcctagaaattacctttctctaataacgggaacttacaaacagtgcttcaagacttccgccgtcctggatgatccagaaaacctccgtttcaccatcggtgtacttaagttcatgtacgataattgcattctgtttttgtgatcagcaattcactgcaacaatttttctaggaattaaaatatataatctaattttcttaaagtaacaatgatgtaaagagatagtttttatgactttgtgtaaccttgcatatgactttattgatatcatcagtcatggcacattaaattatctggaaatatacccagtcaccttaagccttcttttatcatttctgcttttttactgctatattcagcctaacattttgggggatagaagaattaaggggaaaaaaaacttaaagcataaaactgatgattttgattaaaaatttcaagcattgattcttttcaaaaggagaaaaattcaaataaggtaacccttaaatagggtaatctttaaatacaattttcaagaaccatggagttgcagaccagaaagaaataatggatttgatattttcaaagaaatagatagtgcttttaagttcaaaaacctcaatgaagtcctattaaccagaagaatagtatagtaagaaaaatctaaattgggaagtagaaaatcttagcagactaataattagggagttctcacagaaggatcgatttattcacaggtaaagttttctaaaccttcaaggaaaagataacttccaaacatttccaaaatgaaagaaataactggaagctactctgttcgttctgatatagatatctttgaacgccatacctgataaaattaaacatactctcctcattccatagtatatacaataatgccccaagtaaccatgttttggtcaatgacaaaccatttataccactgtggtcccataagattataattgagctgaaaatttcctatcgtcatagcctttatgacactgtagcacaattccatttctttttataaattgagtgcagcctgaatgcattgtgtttacaaggtctacagcagtgtactgtaatgtcctaaccttcacattcacaccactcagtcacggactcagcagagcaactgccagtcctgcaagctccattcatgataagtgccctatctcggtgtgtcagttcttaaatcttttatactgtatttttactgcaccttttctatttatgtatgtttagatacacaaatactttaccattgtgtgtctgggattgtaagtagtaggctacaccacctaggagcaataggctatatatcctgtagtctgggtgtgtagtcggccctaccatctagggttgtatatagtagactacaccatctaggagtaataggctataccccataacctaggtgtgtagcacactacatcgtctagggttgtagtaggctataccatctaggaccctcaggctgtaccccatagcctagctgtgtagtaggctatgccatctagtccctgaattctatattgttgaaaacataacaaaatcacctaagaatgtggtttctcaaaatatatcctcattgttaagtataacacatgactgcgtgtcagattgttaatagcgagaagtaaaagctgtcttgttaccaaaagagtaatgtttgagactatcttactggtaatactgttttgcagtcttatccagtgtaacacaataaagaatagtaagatgcaacatttaaaaatgttgacctggggccagggacgtggtggctcatgcctgtaatcccagcactttgggaggccgaggcgggtggatcacctgaggtctagagttcaagaccagcctggccaacatggcaaaaccccatctctactaaaaatgcacaaattagtcaggcatggtgatgggtgcctgtaattccagccactcaggaagctgaggcagaagcattgcttgaactcaggaggcagaggttgcagtgagatgagatcgcaccactgcactccagcctgggcgacagatggagaaaaaaaaagaaaagaaaatgcagtgtgtaatggaggcacaagaaacggggcagtggaagaggggttaatgtggtatgtggaagagtcaggagcttttctttcaaacctgcttaaattatgacactcccctgtcctgtcccttggataagtttcttgataccattccatttcaccttgtttcttttcttttttttttttttaaacagagacagggaccttactctgttacccaggctggagtgcagtagcgtgatcatagctcattgtaaccttgaattcctgggctcaaacgattctcctccctcagcctcctgagtacctggactataggcacacaccaccacgcccagttaattttttaattttttgtagaagtggggtccatttcagttttcttattagtaaaatgaaatgctatcacttgacagaagtttttgtttaattacaaagaacccatgtcaatgtacagagcatagtatttggcaatcaaaagacactactcggtcctctcccattgtttatggtagtggataattgatgagaaaccttgatagaaaactaaacccacattttatagtaacataaaggcaataatggatgacgttaatccttctctgtccgccatcagaagatttgatacatctttgttgaggtattatatgatcgtcctctaaactttgaaataattaacagaaggtaagtcctgctgtgatggccatataaaagtttacttaaaccttttttttgtttgtttaaataaaaggcgatgtagatactggtagagcttgttgctcatgttacagaatatacagctttataaactttaatttctcaacaaataaattgactaagggtatagatggtttacagatgcggcgatgggaaagtgcgtagggaaacattcacgttctgtatcaagaatagcatttttctcattcgtagcttttatctgatttggcagggttgaagtgaagctggcattgtcatttttgcaactatcatggtaaactggcataatccctttggaaggcagttccctgataagtttttactgtacttaaagttgaagagatcttgttagagtcttgaggcttataaaataatcgctatctcagtgctttgggagtccaaggtggtacgattgtttgaggccagtagtttgaggctgcagtgagttatgattgcaccactgcactccatcctcggcgacagaacaagaacctatgaaaaaaaaaaagagcttataggtatatttcaggaaactgctgggctaggtttttcgggacaagtacttaaagaaggtcatgacagcgtttgataattgggcttgcatttgcattaggcactagtcattctctttttctttctttctttttttgagatggagtctcgctctgtcgcccaggctggagtgcagtggcatgatgtcggctcactgcaagctccgcctgccaggttcaagcaattctcctgtctcagcctcctgagtagctgggactacaggcacgcaccaccatgcctggctaattttttgtgtgtgtgtttagtagagatggggtttcaccatgttggtcaggatggtcttgatctcctgacttcgtgatccgctcacctcggcctcccaaagtgctgggattacaggcgtgagccaccccacccagcccgaaacagaaaagctttctaaagttgctgactcactaaatgtacccccgtggctttgcggtatgtttaagttgtataaaccaccccttcttgtcattttctatcctataattccttacctaatggattaagtggtgccagaactgaccctggagaatgcagatttttgatgcggaagtcacggaagttatgttatcttaagggaaggcctttgcttgttaccttttagtagtaggttacagttggtgatgccatggggctcattcctcacaaattgcaaaacttacatgtgctaataaaccttggccttcaaaagtagtaacctagatacaagtagttctccatgctctttctttgaaatttcctataaggactgctttccagcctggtgcatttccttggcactcaccgcattctgctcgctgagcccttttcccacccctgctctctccctggcttcccctcctgggcaactgctctcacttctcactgctgccactgtgctgcctttgcccggcggcccacctccggctgctcctgatgccccctcccagagccgccccttcagctgaaggtgataaagcatggctttccctttgtaatttgggaagataattttttttttttttttactgtttaaactgttaagggagttttttgccagtgatacatattataaaagacacttgtttgtctccaagtttttgtttttattttttcaagagaataaactggcttctgtccctacacagctgagcagtggttcctgattgtcctaaggaagcctttggccctaacctgtgtgcctcattggccacttttttactggcggcagcagcagcagcagcatcagtagttgagaacaccctaatctatcttttcctttctcttcttcacttctaactatagggaaaacgtccacagcgcacaaaggcagagttgcatcctaggtggatgtctgaccacctgtccatcaaacccgtcaagcaagaggtgagtgtgggtgagagtagcgaggaggagctttcctgatgaaagagacggatccttttcatgtacttccattcctgcctttttattttccttcattttttttcctaaaccccaaatgtttatttagcaatcttatgcttaagatacatttctagaaagagaaagaattagaagacgtgaggccacactctggttctgacaatctcctgggatggtaggcatgtccacatttaataagaatacgtactgcaataggtgcatgtataggagcagttcacaaatgcaaagatgggaggatgtagagctgggcaacggaaggagaatttgagtaggcagagccatatttgacctgaatcctgagatggctgggattgatggaaggggagcaaagagggtgggagaggtggggcagaaggcatcccacactacaggagtagtagaaacaaaagcacagagacaggaaattatataaatttatataaaatgatataaatatatatggtcaaaaaacagcatatattagagccaagcacaggtagctcatgcctgtaatccgagcactttaagaggccaaggcaggtggattgcttgtactcacgagttcaagaccagcctggccaacatggcaaaaccccatctctactaaaaatacaaaaattagctgggtgtggtggcgggcacctgtaatcccagctactcgggaggctgaagcaggagaattgcttgaacccaggaggcggaggttgcagtgagctacgatcgcaccactgcactccagcctgggcaacttcagagtttcactctgtctcagaaaaaaaaaaaaaaaagaaagaaagaaaagaaaacctgagagtttgtggcaagtttgttgttttgtttctaattggagatgtagcatggacctgaaaagggtccaggaatgagagagcgtggatctggctgatctgtggggagatgaaattcttaggtgtcaagacctcgccatggagggtagataatcacatttcttctaagacacaaagcaaaacaacataaatgggagggcagggaaatgtttaggtcacatgaaagagagagggcatcatgtgggagtttgagatataatgttaggtgaagaaagaatatttggtgcaaccactaattaaaagagttgtccaaggagcattctggagctgactgtgtttcggcattttcattctgtaatgtagctcaggagcctgaagcaggagatttacttgagcctaggagtttgagaccagcctgggcaacatagcaagaccccacctctgaaaaaaaatagttaaattactttatcacatcacatcacactgtaggaagggacaacactttttaaccgtttatcctttgggcactctttcatcgaatatttaaacagttcagtgatcgtagagagttttgagttaagggacagtagttttactctggaccatgtctttgaattgttacgttacggagccttccttttgcctttcagtaacattttcatggatcttaaatttgagtgacgacacgatgttctattacagagatcttgtcagtaactaaacacattctaccttgagccctgaaaagggaaagctaatttataaatttgtatttacttcagtatattttgatttcacatctgtctctttttaactcagagatgtgtcttgcccgatgtttaattacctgggggttgacaattctattcatgattgacctcccttctccagtatcctcttcctcctagcagtcactaatttcagagtggcctttggtccctggtattcagccatgttctcaaatggttttctagcctggccttgttgggctctctctgctgtctttattaccttgacagttcacacctccttgcaagctcccttttctgtttactgttcactgctctgagtattcctagatgccataacttaacacttcagactgcatagcaggctgaatagactgaaacgtccttcattgctccaagcaaaactttggcatcaaacactaaaatttctttttattcttggcagtgtttgagctttcttttattctactcttcagttcgaacaaaaagaaaccacagtattacagagactgtaaactatctgttgtggtccccgatatcctggagaaacccttagtggtgacatgactttttaagcatggaggcagggtttctggcctctattggtcactcagcagtccaaacttattgcctgataaaagactttgagttgtgacttcttggggaaaatatcagtgaggggagactgtctcgctgaactcagggattcgggatgcagtggttatttttgtccggacactttggtcattgctgttgctagggagctgtttgttgggtgttcgtctcaaatgtgctgctaacgggagcaagggtgccagcaagtctgatacctgccctcagagaggggagcgtgtaagggcacagcatgttgggcattgcttaaaccaggggttctgttgaatcgtccttgactggattttaaagtgttgtttctcattagcttctcattaaaaacccccttgattctagcaggactcttatctgtaaagcattcctacaccaacatctctaccatttgcaactgaccccaccttttaaagaaaaaaattgcagcctaagacagtatcacatttttgtaactgtgcaggtttatttttgcttggccagttgtcattcatttggttgtactggttctttaatagttaaaacactacaaaaagtgagtcctgttttttagtggtgttttcatcaagacttgctttaccttgcatcagcctagtgctgaaaatcagcagaggaattttaaaacagacttgtgggccaggcgcggtggctcacgcctgtaatcccagcactttgggaggccgagttgggcagatcacaaggtcaggagatcgagaccatcctggctaacacgatgaaaccccgtctctactaaaaatacaaaaaattagctgggcgtggtggtgggcgcctgtagtcccagctacttgggaggagaatggcgtgaacccgggaggcagagtttgcagtgagccaagatcgcaccactgcactccagcctgggcgacagagcaagactccgtctcaaaaaaaaaaaaaaagaaaagcagatttgttgttcacaacatagattttttttttctcatatgtgtgtaatgtcatttaggtaaaattgtaattgttgagaattcacatcagatgggaaactgctaaaatggtaaaatggtaacccatgctgatgaaagaaaaaaggcccagagaaatgtgaggcagacatattcagctaagcaggaggtgtttacaagtgcagggccgtgctggaggagggggcagattgtggagaaagtggtctgagacaggtggagcaataactagggggacagatggcatccgcaagggcaggagccacagctgggcgtggccggtgcaggctcccacctgcccaccatgtctttatagaaaatgtggagactacatgtagaaaactgtaaaagacctggtaatcccacaactcaggaatcattactatttacgtttttacgtatttgcttcaggcttttcctctatgcatttattgcatattgagcattatatttaagatactttgtgatcagtatatcgagacattcatacatttcaagaattgtttaaattctgatacccagatttaagcatgtgaacatgtgatgagatttttaagcatacaataaaagctgtttataatttgctgcactaccaaccttttttttttttttttgagacggagtctcgctctgtcacccaggctggagtgcagtggcacaatctgggctcactgcaagctccacctcccaggttcaagccattctcctgcctcagcctcccaagtagctgggactacaggcgcccgccaccacgcccggctaattctctgtatttttagtagaaatggggtttcaccgtgttagccaggatggtctcgatctcctgacctcgtgatccacccgccttagcctcccaaagtgctgggattacaggcgtgagccaccacgcccggccagtaccagccttaaattagttactttggggggcctaagtcaaatggtttaaactgtgagcctgttgaacatacctaaggaataccttcctatattatatatgtatgtgacttcttcgtgtaaaggttttttcacttgaattcctatgttacctggctctggaagtcactactcaggagcttatggtccaaagaggagagggacagataaccaggattgatcaaaatatagagatatatatatatggatatatatccatacacacacacatatttacagttatgtacatacatatacacatttattatatttatatgtgtatacattttatatgtatatatacatatatacatgtatgtacatgcacctgtgtgtacacatggatggcacagcagaagggaacacaaatctcgaagtgcaagccctcaagaagcagcatattacgataaatcccttctttagaaaagtattgatatggtttggctctgtgtccccacccagagctcatctcaaattgcaatccccacatgtcaggagaggggcctggtaggaggtgatgaatcatgggatggacttcccccttgctgttcttgtgatggtgtgtgagttctcaggagatctggctggtgttttgttttgttttgttttgagacggagttttgctgttgttgcccagactggagtgcaatggcaccatctcggctcactgcaacctccgtgtcctgggttcaagctattcccctgcctcagcctcacgagtagctgggattacatgcacctgccaccacgcctggctaattttgtatttttagtagagatggggtttctccatgttggtcaggctggtcttgaacacccgacctcaggtgaaatgcccgcctcgtcctcccaaagtgctgggattacaggtgtgagccactgcgcccagctgatctggttgtttattgttttttcggggtttttttgagacggagtctcactctgtcgcccaggctggagtgcagtggcgtgatctcagctcactgcaacctcggcctcccgagtagctgggattataggcgcctgccaccacgcctggctaatttttgtatttttagtggagtcggggtttcaccatcttggccaggctggtctcgaactcctgacctcgtgatccaccctcctcagcctcccaaagtgctgggattacaggcgtgagccaccgcgcctggccaagatctgggtgttttaaagtgtgtggcacatcccccatcgcacatgcgcacttgcgctttctggctctatcttgcttcgctgtgctaagacgtgcttcctttcccctcaccttccgccacgattataagtttcctgaggccccccagtcatcctttctatacagcctgtggaattgtgagtcaattaagcctctttgcttcatatatcccagtctcatgtagttctttatagcagtgtgagaacggaggaataccggtatcatttctaccactgataccacaggttaagttatatattatgccatcttcgagtaacacttgaagccacacaataaatgcaaaggcattacaatgaatcccacttaatacaaataactatatagaccaacactgctctacaaatttagcttgggtctttttctaatggccggttaaatacagttttaatttcgtaggttaatggtgaaggttcatacactgaagccagtacgtatacctagcattgcttttcagcctaaacttatccacgtacacaactcagttacaaggcttggccttaaaatgctaggagagcttcttaaagtagtttttacaggtattaaatttcgtcttgcacaccgaagtcatcgtacataacagggcaaagtcagagtttttatcattgcgtttattcttcatttacctttaaaacacttctctagctgaatatttaaagcaataggaagcagtgagcatattatggttacaggccttcactcagtcactgttgcagataaaatgccagcagtgagtgttactcactggcccagttaagggctttgacactgaccacctcttctggggagatggtgttccttgccctcatatgcttctccattgtaatgctgccatctttgctgatttgcctcagagcccaccagttctttttgatcatcccatcagtctcttcttcctttctaccaggtagaagtttttccagcaaagagagtttattaggagagagagccattctgaggagcgtttacataaattaagtgattaggcgacgctttgcatacggtgtgcagtaaattggcattccttcatttagcacacacttgatgtccccgtgcttgacattctgacctggaccatggttcagtcttgaaagcagatgttagcgtttgggagtcacacagtgtttcagccagctgtgtgtctgtacacaggaaaaggtcttctccctgtcaagtaaaaatagcatggtctttctgttctaccccagtggtaatgtttcctggctccagttctggtcttggtatccttcaccacggaatgttatcttctggccatctttcatgcctttgtcaatagggacttctagaatctccttctctgcaactgtcttccttccattgcagctttcacgtctatctttaggacggatggtttccccatgggcttggcactccatgcacacagattgaatttgctgaaccattccaggtcttattgatgaattactgtttgcattcaagcacctcagcagttggcacagcaggatcctgctcccttcttaacacctctgccttcacatttgtcacaaatcatattcttttgcagagccagttttcttttttcaccattggatagatctcctaaggctactgagagctgatgtaggagtttttacctctcctttctcttagtatccttccttctcccccaaaaaaacttagcagagatgtccatgggggaatgagaactgccaccagccccaccctctttaattgcctgtcctcctttgtcatagaattccctattctctgcatcagagagaacttctcaagattgagaaatccatttaacttctctccttcatttagattcttaccagggtattacttcaaagccatttttaagcctttgtcagttcttcgtgggtagcattaggtttgacccccaagatgtcatagtaagtggtttctttcacaattttctgtagccagtgagtgggctgaggctggtggtggggagtggggaggggcctgtagctctatgcagtccgtgcagccactgctcctccacctcacaccaagcatctggaaagttccctcaggtgttttgttttgttttttttttttgagacggagtctcattctgtcacccaggctggagtgcagtggcacaatctcagcttactgcaacctctgcctcccgagtagctgggactacaggcgcccgccaccatgcccagctaattttttgtattgttagtagagacagggttcaccacattagccaggaaggtcttgatctcctgacctcgtgaaccacccacctcggcctcccacagtgctgggattacaggcatgggccaccatgcccggcccctcgtgtgctttatatattgtttgtgagttttgtgttcgtgttccatttgtttgaggggagcactgttaactgattgtgagatattacatattaagaataataagtcatactcattacagaaaaagaattatatattagtaagatttaggttattggcttttgggttttttctctttctccctctccactgacttaacacatgaacacttcctatgtttgtttagattatcaagtcttttttttttttttgagacataatctcactctgttgccaggctggagtgcagtggcacaatcttggttcactgcaacctccgcctcccaggttcaagcgattttcctgcctcagccccccaagtagctgggactacaggcacacaccaccgtgcccagctaatttttgtatttttagtaaagacagagtttcaccatgtttaccaggatggtctcaatctcttaacctcatgatccacccaccttggcctcccaaggtgctgagattacaggcgtgagccaccgtgcctggccagattatcaagtcttgagtgacttaacattacaatttcataagtaattggcttgcatttgctcagtccttattaaaatgttagattctatttaatgtaccctgtactgatgaaagaagaatatttcacaggtttacacctattgtcttttgttgtgggggagagtggccagaatacacataggtaattctgtaaataactttcatgtttgatatatagatatacctgttttcctctcattttggggtctgacatacataaagcatcacaattctctttcaatgaaatcttccctttgacaaggctcaggttttttttttattgtaagtaggatttttaaattattattatactttaagttctagagtacatgtgcagaatgtgcaggtttgttacataggtatacatacatgtgccatgttggtttgctgcacccatcaactcatcatttacattaggtatttctcctaatgctatccctcccccagtcccccaccctctgacagaccccggtgtgtgatgttccccgccctgtgcccaagtgttctcattgttcagttcccacctatgagtgagaacatgcggtgtttggttttctgtcttgtgatagtttgctgagaatgatggtttccagcttcattcatgtccctgcaaaggacatgaactcgtctttttgggttttttgggctgcatagtattccatggtgtatatgtgcctcattttcttattccagtctatcattgatgtccattgatggacaatttgggttggttccaagtctttgctattgtgaatagcgccgcaataaacatacgtgtgcatgtgtctttatagtagcatgatttataatcctttgggtatatacccagtaatgggatcactgggtcaaatggtatttctagttctagatccttgaggaattgtcacactgtcttccacaatggttgaaccagtttacactcccaccaacagtgtaaaagcgttcctatttctccacatcctctccagcatctgttgtttcctgactttttaatgatcgccattctaactggcgtgagatggtatctcattgtggttttgatttgcatttctctgatgaccagtgatgatgagcattttttcatgtgtcttttggctgcataaatgtcttcttttgagaagcgtctgttcggccgggcgcagtggctcacgcctgtaatcccagcactttgggaggccaaggcaggaggatcacgaggtcaggagatcgagaccatcctggcaaacacagtgataccccgtctctactaaaaatacaaaaaattagccaggcgtggtggcgggcgcctgtagtcccagctactcaggaggctgacgcaggagaatggtggagcttgcagtgagccgagatggcgccactgcactccagcctgggtgacagagcgagactccatctcaaaaaaaaaaaaagagagagagagagaagtgtctgttcatatcctttgcccactttttcatggggttgtttgattttttttgttgttgttaatttctttaagttctttgtacattctggatatcagccctttgtcagatgagtagattgtaaaaattttctcccattctgtaggttgcctgttcactctgatggtagtttcttttgctgtgcagaagctctttagtttaattagatcccatttgtctgttttggcttttgttgccattgcttttggtgttttagtcatgaagtccttgcccatgcctatgtcctgaatggtaatgcctaggttttcttctagggtttttatggttttaggttttacatttaagtctttaatgcatcttgaattaatttttgtataaggtataaggaagggatccagtttcagctttctacatatggctagccagttttcccagcaccatttattaaatacggaatcctttccctgttactggtttttgtcaggtttgtcaaagatcatatggttgtagatgtgtggtgttatttccgaggcctctgttctgttccattggtctatatctctgttttggtaccagtaccatgctgttttggttactgtagtgacaaggctcagtattatctcctctctttcccctgcccatgtgagtcaactgataccttatggtgtttttttggcatcagtatacatctgaaaagagcaaaggcaaatagttttgttttactttgctttgttaactgcagtttcatcatatctcagctgggtaaagatgttgctggaacaattaagaacctgggaagtggggtggaagtgagagcagggattatggcaaaatttagggaaggtgcttgacagacatttattcgggaagcagtggccagagttgcagtcttcgggacagtcgtccttgccaagtgtccatagcatccccttttcagaatcaacatccaccatattgaaactggcctgctctggctataggataaagattttatggttgttatttaattctgtttgttacactgagacaccttatgggtacagtgttaacgtatgcagtttttatttttgtccctcctgttcattccagatttttacctgtaaactcttctaaagtcaggctcatagatttttgaatggtgaaaatgacattgagaagtcaactaactgggccacgcgccatggctcacgcctgtaatcccagcactttgggaggctgaggtgggcggatcacctgaggtcaggagttctagtccagcctggtcaacatggtgaaatcccatctctactaaaaatacaaaaattagctaggcgtggtggtacacacctgtaatctcagctactcgagaggctaaggcaggagaatcacttgaacccaggaggcagtgtctgcagtaagccaaaatcgtgccactgcactccagccttggtgacaaagcaagactccatctcggggggggggaaaaaagcctgctatctaggcaagatcgtctctaaatttggagtcaaatgagaatctaaaccggtttgttttgttttgttttgtgtttttgagatagggtctatctcccaggttggagtattacgcctgtaatctcagcactttgggaggctgaggtcagaagttcgagaccagcctggccaacatggcgaaaccccatctctattaaaaatacaaaaattagctgggcgtggtggcaggtaccctgtaactccagttacttgggaggctgaggcgagagaatcacttgaactgggaggcagaggttgtagtgagccaagatcataccattgcactccagtctcacagagtgagattccatctcaaaaaaaaaaaaggaactgtgttctgttgagtgactgtctttcatcctagtatactttttaaaacttcctagcgctttttaaaacttacctttatcggctgggcacggtggctcacacctataatccctccactttgggaggctgaggcaggtggatcacgtggtcaggagatcaagaccatcctggctaacatggtgaaaccccatctcaagtgaaaatacaaaaaattagccgggcgtggtggcaggcgcctgtagttccagttacttgggagtcggaggcaggagaatggcgtgaacccgggaggcagagcttgcagtgagccaagatcgcaccactgcactccagcctaggcgacagagcgagactctatctcaaaaaaaaaaaaaaaaaagaaaaaaaagcttccctttatcagatgttaactctaaagaaacacatctctgaactgccccagtttctcttctctccagtaaattatccataagattgtctcctaaataccacaaattatataaattgttggacacaaaagttttaccattttgaatctcccttatgttttaacatttatgtatatccatgtgtattttacagataacaaaatcagcttttcgtgatataaagtccctagctaatattatttgttgaaaatactgaattcaatgaactgagagcaaagagcttatcttgcatgattgtgtactgaccggatgtgctcattggctcctcacaggagactcctgtgctgaccagaatagaaaaacaaaagcgcaaagaggaggaagaagagcgtcagattcttctagcagtgcagaagaaggagcaggagcagatgctaaaggaagagaggaaacgcgagttggaggagaaggtcaaggcagtggaaggtatgtgcagtgtccgcgtggtctggagaggtgcatgtctgtcgaccagccgtcctgtagccagagccaactcaagctaagtcctgccatgcatccaagttgtttccggcaatttcttttttttttttttttttttttttttttttttttttttttttttgagacggagtctcgctgtgtcgcccaggctggagtgcagtggcgtgatctcagctcactgcaagcttcacctcccgggttcacgccattctcctgcctcagcctcccaagtagctgggactacaggcgcccaccaccacacccagctaattttttgtattgttagtagagacggggtttcaccgtgttagccaggatgatctagaactcctgaccttgtgatccacccgcctcggcctcccaaagtgctgggattacaggcgtgagccaccgcacccggccactttttttctgtttagagttctgcaagcaaaggataataactgtctttagatgttttcttagataacaattgtatttataagttcaacctgataaatcatgtgataacagatcacttggtgtaattgaagatagtccaagatttaccttttaaataagtgtattgaatatttttaatttttcaatacaacagcatagcatatggatttggctttttgaatgcagtgttttgcagggcaagatttcagtaaattttggctaagaaaattgaagtattctggccttatgtacctattaagtaacagaaagttacttaacctattatgtgcacctcattcctaccaagatctttttttttttttctttttttttttttgagactccgtctcggtttgtcgcccaggctggagtgcagtggcacgatctcgtctcactgcaagctccgcatcccgggttctcgccattctcctgcctcagcctcccgagtagctgggactacaggcacccaccaccacgcccagctaattttttgtatttttagttgagacggtgtttcactgtgttagccaggatggtctcgatatcttgacctcgtaatctgcccgccttggcctcccaaagtgctgggattacaggcatgagccaccatgcctggccctttttttttttttttttttttttgatacatagtctcactctgtggcccacctggagtgcagtggcacaatcttcacttactgcaacctctgcctcagcctcccgagtagctaggactataggcgtgccaccacacccagctaatgtttgtatttttagagatggggttttaccatgttgggcaggttggtctcaaactgctgacctcaaatgatcttgccgcctcggcctcccaaagtgctgggattacaggcgtgagccactgtgcctgcccacattaaggattttagaattaataaagaaatgaggggtcaggcacagtgactcatgcctgtaatcccagcactttgggaggccaaggggggcggatcacatgaggttgggttttcgagaccagcctgaccaacatggagaaaccccatctctactaaaaatacaaaaaattagctgggcgtggtggggcatgcctgtaatgccagctactcaggaggctgaggcaggagaatcgcttgaacccaggaagtggaggttgtggtgagccaagatcgtgccattgtactccagcctgggcaacaagagtgaaactccatctcaaaaaaaaaaaaaaaaaaaaaaagaaaggaagggagggagggaaaagaaaagaaagaaagaaatgatggctgggcacagtggctcacgcctgtaatcccagcactttgggaagccaaagtggccgaatcacttgaggtcaggagtttgagacagcctggccaacatggccaaacgtggtagctcacgcctgtaatcccagctactcaggaggatgaggtgggagaattgcttgaacccgggaggtggaggttgcagtgagccgagatcgtgctactgcactccagcctgggcgacagagcaagactctgtctcaataaaaaaaacaacccttagtgcatataatctacaggtttagcctgtgtcatactatgtagtatatctcacttgtaagatcttccataattggctatgtccagtgccacatttaaattcctcaggacataataactggcttttatttgtttatattttttagtggaattgtgtttttttatttaatagggtccttattgggtacacctgtcattttaatttatataggcaggtccaaaactcatttttatggctcagtttctgtaatgtaagattaataatgcctgtattgtagtcccatctacagaagtcacaaataaaattaaatcctaggaattaaccaaagaagtgaaagagctctataatgaaaactataaaacatggaggaaacaaattgaaaagaacacccaaaaactggaaagctttctacgttcatggataacaagaatcagtattcttaaaatgtccatagtactcaaagtaatctacagattcaatgcaatgtctaccagaataccaatgacattcttcacaaaaatagaaaaaaaaatcctttaatttatatggacccacaaaagacccagaataggcaaagctatcctaagcaaaaataacaaacctggaggaattacctgacttcaaattgtatttcagacctgtggggaccaaaacaatatggggatctggcataaaaaccaacacacagacaaatggaacagaatagagaatccagaaacaagtccacacacgtacagcgaactcattttcaacacacgtgctaagaacatacactggggaaaagagtctcttctacaagtggtgctggggaaactggatatccataagcagaagaatgaaactagacccctatctcctgccacatacaaaaataaaatcaaagtggattaaataattatatctaaggccgggcgtgacgacttatgcctgtaatcccagcactttgggaggccaaggcgggtgaattacaaggtcaagagttcaaggccagcctggccaaggtgttgaaaccccgtctctactaaaaatacaaaaattagccgggcacggtggcaggcaccggtaatcccagctactcaggaggctgaggcaagaaaatcgcttgaacctgggcagcagaggttgcagtgagctaagattgcatcactgcactccaacctgtgtgacagagtaagactccatctcaaaaaaaaaaaaaaaaaaaaaagaattatatctaagacctcaaattatgaaactctacaagaaaaaacgttggagaaaccctctaggacattgatttcaagcacaggcacccaaagcaaaaatggacaaatgggatcacatcaagttaaaaagcttctgcacagcaaaggaaacaaccagcaaagtgaagagacaacccacagaatgggagaaaacatttgcaaactgcccagttgacaaaggatgaataaccagaatgtagaaggagctgaaataactcttaggaaaaagtctaataatcggatattaaaatgggcaaaatatttgaatagagatttctcaaaagaagtcatacaaatgcagacgaggccaggcatgttgagtcatgcttgtaagctcagcactttgggaggccaaggctggcagattgttttagcacaggagttcaagaccagcctcggcaacacggtaaaaccccatctctacaaaaaatacaaaaattaaccgagcatggttgttcatacctgtagtgccagctacttgggaagctgagatgggcagatagcttgagcctgggaggtccaggctccagtgagctgagatcatgccactgcactccatcctgggcaatagagcgagaccctgtctcaaaaaaataaaaataaattaaaaaacaagccaggtgtggtggctcatgcttgtaatcccagcactttgggaggccgaggcgggcagatgacttgagatcaggagttcaagaccaacctggccaacatggcaaaaccctgcctctactaaaaatactaaaattagctaggcatggtggcacacgcctgtaatcccagctactcaggaggctgaggcaggagaattgcttgaacctgggagacagaggtggcagtgagcagagatcaagccaagacttcattccagcctgggcaatacagcaagattctgtctcaaaaaaaaaaaaaaaaagcaaacaagcttatgaaaaaagtgctcagtatcattgatcatcagagaaatggaaatccaaaactattatgagatatcatcttacacagttaaaatggtttatacccaaaggacaggcaataacaaatactggtgagaatgagaagaggaaatcctcatatactgttggtaggaacataaattagtcccccgctatggagaacagcttagatgttccttagaaaactaaaaagagagctaccataaaatctattaatcccactgctgggtatacacccaaaagaaaggaaatcaatatattgaagagataactacactcccatattttttgcagctctgttcacaatagccaagatttggaagcaacctaagtgtccgtcagcaaatgaatggataaagaaaatgtggtactgatacacaagggagtactattcagccataaaaacagaaagatgcagtcgtttgcaacaacatggatagaactggaggttattattttaaatgaaataagacaggcacagaaagacaaacattggatattctcacttacttgtgggatctaaaaatcaaaataattgaacccgtggagatagaggggaaaaggatggttaccagaggctgggaacgatagtggagggttggggagaggtaggatggttaatgggtacaaaaaaaatagttattatgaatgaatatgatctggcatttgatagcacagcagagaagtatggctttttttttcttttcttttcttttttgttatttttgagacagagtctcactcttttgcccaggctagagtgcagtggcatgatctggtctcactgcaacctccacttctcaggttcaagtgattaccatgcctcagcctcccaagtagctgtgattacaggtgtacactaccacacccggctaatttttgtatttttagtagagatggggttttgccgtgttggccaggctggtcttgaactcctggcctcaagtgatccatctgcctcagcctcccaaagtgctgggaatacaagcgtgagcacacacccagccagaagtactattttcattccagtggtgagaaggtggagagtagacaaatattgtgggataatagtggtgagtgatctgaagtaaaattaggcaggtttacaggtaaagagtgacatggctgggcgtggtggctccatctgtggtcccagctacttgggaggctgtggcaggaggaccccttgagcgcaggagatcgaggctgcagtgagcgctgatttcccctgctgaacacagcctgggtgatagagcaaaaccctgtctcagacaaaaaagaaagccctctctgaagatttgacatttaaataaagtgaatgaggttgacccgtgagtgcctgaagcggaaggcgcagtgcagacaagagcagaggcacggaggcagggatatgcagcaggaagtccagggcgaggctgcagcggaggggagcaaagcaagcacaggaaggctggctggaagtcccggcgcggctggagcggagcagagcagagcaagcacaggaaggctggctgggcatgaattgagtcctaccaggtagcccagggtcgcattgggatgggctgtgcagaccttgttagaagggttaaatgggctgggcgccgtggctcacggttgtaatcccagcactttggaaggccgaagtgggcgaatcacgaggtcaggagatcaagaccatcgtgactaacacggtgaaaccccgtctctactaaaaatacaaaaaattagccaggcgtggtggcacatgcctgtagtcccagctactcgggaggctgaggcgggagaatggcgtgaacccgggaggcggagcttccagtgagccgagatcgccccaccgcactccagcctgggcgacagagcaagattccgtctcaaaaaaaaaaaaaaaggaaggattaaatgaaaacaggacagtctctgacacacatttaaagtcacaaatgatagttttctttgtttgagacaaagtctcgctctgcctcccatgatagttcttatggaaggaatttttgtaagccataagatacttacaataaccttttccagactttttagtagcttccaactacaaaaaaagagaaataatcaattatgtactaatcagacacttttaaaaattacaacagtttattcagagaaacaagctttgtgtgacattctaagcggattttattctgcaggtccttttaacataatgagtaatatttgtgttgggaatgactgagaagaaatttcataatgatgtgaagatctacctgtaaatagttcctctgtcgtatgctggtatttatattctagcatctcaacagtgctgatggtcactcatcttggagttccctgaattttttttttttttcaaaactcctgtaatgttacattacccatatttttgttgttgctgctgttgttgttgttttgagacggagtgtcgctctgtcgcccaggctggagtgcagtggtgccgcgcccggcacatgactgcatactttcaaggagaggactcagagcttttatttatttaaagaaacttgaaaggaggaaagtggattaagaaaaaaaaaataaggccaggcgcggtggctcacgcctgtaatcccagcactttgggaggctgaggcaggcagatcacgaggtcaggagattgacaccatcctggccaacatggtgaaaccccgtctctactaaaaatacaaaaaaaaaattagccgggcatggtggcgtgcacctgtagtcccaactactcgggaggctgagacaggagaattgcttgaattcgggaggcagaggctgcagtgagctgagatcatgccactgcattccagcctgggcaacagagcgagactctgtccccctcaaaaaagaaaaaaaaaaacaacagaaggcaaaaagtgaaacagccaagtgtccaccagtggataaaaggagaacctgaatgcagtatacacttagaatggggtgttattcagccttaagagggaaggaaattctgaaacatgctacaacatggatgaaccttgaaggtattacacgaagtgatatcagcaggacacacgtggacaaatgttttgtactagaggctgaggtgagagggaaatggggagtcagtgtttaatgttacagactggagtgatgaaaagatactagaaatggataccggtgatggcgccacaacattacttacacacttaatgctactgaattgtatgctcatttgggtgatatgtctgggtaactagaatgagatgaagccggccatgacgaaagaagtaacttgtagttaatcagttggggtccagccttgaaaaccaaaactacactagctacttcagcagggaaaacatcacatgactctttggtaaaatgggagttagaaaacaaaaaaaaaggttaaagggatccccgtggtgacacagacggaggaatcgggattgtcagaggtggggggctgcagccccactgctagcactatgaaggcaggcaaactcccgctgccaagtgcggcttcgcagatgcaggaccatccatcctaggatgagttgaacggcatcagcaagcaaatggaaggaaatcgctgtcttcctcagcgtgcctcccgtggtccctctgatgctccctttggtagaatataaaaccagcagagaagggagttgtatgtgcaggatcccagccccattatcacaaagcagaacatgaaaattggatttgcaaccatcagaaaaggcttcataacagatgcaggtggcagaaaacatgaaaggtcctgtatgtgttcactgtaagttctagaaggaaagaatcagtatagtaaggccaagagaatgttcagaaacaatgattgagtagttttttggtttgataaaaaaccctgatcctcagatacagaaagcaagaagagatataaactggatataaattatatgtgggcatatggaactgaattatagaacattctgttccctaaaacaaccaatgtggaaaaggtggattaccctgagaggatgttcttaatagtgatagcagataggagcaacagcagacctcaggggacgatgggattgatggccaggtgcagtggctcatgcctgtaatcccagcagtttgggaagccaaggcaggagaattacttgagtcctggagttcaagaccagcctgggcaacataatgaggccccatctctacagaaaatcttaaaaattagccagacatggtggtgcatgcctgtagtcccagctactcgggaggctgaggtaggaggatcacttgagcccaggaggtcaaggctgcagtgagccgtggttgtgcacagcactccagcctgggcaacagcaagaccctgtctcaaaaaaaggaaggggtgggtagtgggttgcattttgaatttttttattagttccttagggctaccataacaacctacattaaccaggtggcataaaatagcagaaatttattctctcatagtcctggaagttagaaatccaaaatctagttattgacagggtttcactctctaaagactgtaggtgagagtctgtggcctttccagcttctagtagtttcaggccttcctggggttttctgcaaacttagaataatagaatgaaacttcctcagccaatatcttaataatctaggcagaccttctacttgatggggaaacattagaagtgttccctttaaagtcaggataaacacaaggatttcctctattgtttccatttaatattgtattgtaaggatttagtgtctacaacgaaaaatacataggtatgtatacatatttgaggtggtgtatgacttgaaactccaagaaaatcacccaggaaactattatagctaagaaattcaccaagtaggtatattcattattattcttttttttttttttttttttttttttttgagatggagtctcactctattactcaggctggagtgcagtggtgcgatctcggctcactgcaacttccgcctcccgggttcaaataattctcctgcctcagcctccaaagtagctgggattacaggcatgtgccaccacgcctggcaattttttttgttatttttagtagagatggagtctcaccatgttggtcaggctgttcttgaactcctgacctcaggtgatccactgcgcccagccgctcattattattctataaatgtcaacatgaacaattttattaaaagatagcatgacccggccaggcgcggtggctcacacctgtaatcccagcactttgggaggccgaggcgggcagatcacgaggtcagaagatcaagaccatcctggccaacttggtgaaaccccgtctctactaaaaatagaaaaattagctggacatgttggtgcacttctgtaatcccagctagctacttgagaggctgaggcatgagaatcgcttgtacccaggaggcagaggttgcagtgtgttaacatagcgccaccgcagcactccagcctgagcaacagagtgagactctatctccaaaaaaaaaaaaaaaaattatgatagctgggcacagtggctcacacctacaatcccagcaccgtgggaggccgaggtggacggatcacttgagctaaggagttgaagatcagcctagctaacatgatgaaaccccgtctctactaaaaatacaataattacccaggcatagtggcatatacctgtaatcccagctacccgggaggctgaggcacgagaattgcttgaacctgagaggcagaggctacagtgacctgaaatcacaccattgcactccagcctgggtgatagagtgaggctctgtctcctaaaaaaaaagaatctgtggatctcaacacactgttcctaaaattcatataaaagagcaaagggcctttttttgtttgtttgtttgtttgtttgtttgtttttgagatgacgtttcacccttgttgcccaggctggagtgcaatggtgtgatctcggctcaccgcaacctccgcctctggggttcaagcaattctcctgcctcagcctcccaagtagctgggattacaggcatgcaccaccacgcctggctaattttgtatttttagtagacagggtttctccatgttggtcaggctggtctcgaactcccgacctctgatgatctgcctgcctccgcctcccaaagtgctaggattacagatgtgagccaccatgcccggccgagcaaagggcatgaaaacttgcaaaaacaatacgatagggtcaatcattatgccacataatgagatcaaatctgcagtgattgagagagaatggtattggcatagagatagacaatgagaccagaaacagaccttgagagaaaacatgggtttttcagaaacagtgccaggcgtggtggtgtgtgcctgtagtcccagccactcaggagtctgatgtgggaggatccgttatgcacaggagttcaaggttgcagtgacctatgatcccaacagagcgagacccctgtctcttgggagagaacagtggtaccaggacacttgttcatttatagggaaaaaatttacatccctgctccttatataagttccagatacactaaaggccagaacctttctgaagaagttgtagatgggatagaaaagaatttttaagtacaaaaagcaaaaaccataaggaaagagagagaactgacatatttgattactttatttatttatttatttattttttgagacggagtctcactctgtcgcccaggctggagtgcagtggcacaatctcagctcactgcaagccccgcctcccgggttcacaccattctcttgcctcagcctcccgagtagctgggactacaggcacctgccaccacgcctggctaatttttttttcttttttttttctttttttttgtatttttagtagagacagggtttcactgtgttagccaggtgggtctccatctcctgacctcgtgatccacctgcctcagcctcccaaagtgcggggagctgagatcatgccattgcactccagcctgggcaacaagagtgaaactctgtctcaaaaaaaaaaatgccaggtgcggtggctcatgtctgtaatcccagcactttgggaggtcgaggcaggtggatcacaaggtcaggagatcaagaccatcctggctaacacagtgaaaccccgtctctactaaaaaatacaaaaagttagccaggcgtggtggcgggtgcctgtagtcccagctattcgggaggctgaggcaggagaatgacgtgaacccaggaggcggagctcgcagtgaggcgagatcgcaccactgcactccagcctgagcgacagagtgagactccatctcaaaacaaaacaaaaaaaattagccaggcgtggtgacagacccctgtagtcccaactactcaggaggctgaggcaggagaattgcttgaacctgggaggcggaggttgcagtgagctgagatcgcaccactacactttagcctgggcaacagagtgagactccatctcaaaaaaaaaaaaattctgtaacctctttggaaatgatggacacccctttgacagtgcctgatgaagtttacatatatactttttactcctatctggtcattctgctgctgggttcacatcttagagaatccttacacacatgcttgagaagacatgttttaaaataactttgttgatactattgtttacaaacttctaaaactggaatcaaggagaataatggattgttaagctgtggaataatcataccatgaaatactatattaacattaataagacaaaatgtttaaagtttgacaggttgggtgatacatgcgtattcattaatttacagttttctttatggttgaaatttttcttttttttccagaaaaaaaaaaaatagttggtttagagaactttcttagaagtcgaaaaaaaaaataatttttaaaaatttaaaatttttcttaaaatttggtgatagcaaacttcttttcattgattaaaggagatatagattagcatcacaaatgaaaataatttaggaacaaaaactcaagtcaaatgcaacccaacagggatcgtgtcttgctcacagcagtagtcaggcaaagatcctatcccttgtggaacagaagctagaattggggaagaaagtagaggctcaggccaggcaccatggctcactcctgtaatcccagcactttgggaggctgaggtgggcagttcacctgaggtcacgagttcgagaccagcctgaccaacatggagaaaccccatccctactaaaaatacaaaattagctgggcgtggtggtgcatgcctgtaatcccagctactcgggaggctgaggcaggggaatcgcttgaacccagggggcagaggttgtggtgagccgaggtggcgccattacactccagcctgggcaacaagagcaaaactccgtctcaaaaataaaaataaaaaagaaaagaaaatagaggctcttgctggcttctcctcccttccatctttgtgccttgctgtctggcagtctcatttttctccttgcctcttttctttggcccctacctccttgttccctgcaagtggtaagtgccccatcaggctgggaatggaatgccaagtgtgcttctcatggctgtggctgggagccaggaagaaaatcatcatccctgccttccagctccttgccaatcccagctggcatctttcccctcttcccagccaaaatcccactggcggcagggcctgctgcctgatctgggggtggggtggggagcagaccattgcttgcatggatgccttcataaacgcagaacggcaagagctgggacgtgcgtttaaaatcctgtgtgtgtatggactgagagtctggtcctaaaaaaggatttgcggatgttgctttttttaagtaaaagatcagaatggcctcaagtaatccgagaagatagtcctcattcaaccttgtactttttcctttttcttcgactgccattcttctgttttcttctgccttgctccctcccctcctgcccaccctgtgcctgccctgccaccttcatctcccaccttgagctcagtgtgagtgaggaaacaggttcaattagtttacccttgtcttaaagcattccatctgtagaaacatcctaattaccaaaaagagggtggcacagggagcagaagttgcttcataatcctgctttggtggcctggttcttccttctctcacagtgatgaaggaacacgccatgtcagtgtctggagtgtgcttagctcactcagcctttgtgttcattgtagatcgagcgaagaggagaaagctcagggaagaaagggcatggctgctggctcaaggaaaggagctccctccagaactttcccatctggaccccaattcccccatgagagaggaaaaaaagactaaagacctgtgagtatttagtaacaacaacaacagcagtagcaactggtagcatttatgaagcattcaggcacttgccccatgtcatccttagaacagccctgttgggtaacatggtcaccatgtgtgagtgaacagggcgggccctgcacacacagacacgcctagctaccctggcctctgacactcttgctgccacactctgtgatacttaacactaagctcttctttcttcatcccctcaatttaatgaaatcagaatctgattattatgtaaattagctccttggaaatgtgaatagaagtttattctttttaaagtaattacttcccgtgacagtactaggtaccatttgtcttgactccttactaaactcaagaggcagatacacattcagtgttcctgagctcatttatcatatgattttttggattattctttagatcacaaaaatattcataactaaaataaaccctagttgaaaatgtgctataggccgggctcacgcctgtaatcccagcactttgggaggctgaggtgggcagatcacctgaggtcaggagttcgagaccagcctggccaatatggtgaaacccccgtctctaataaaaattttaaaaaaaattaggtgaggtggcacatgcctgtagtcccagctactcgggaggctgaggcaggagaatcacttgaactcaggaggtgggggttgcagtgagctgagatcgtgccactgcactccagcctgggtgacagagtgagactccgtccaaaaaaaaaaaaaaaagattgtgctataaagcctgggcaacatggtgaaacctcacctctacccaaaatacaaaaactcgccaggcatggtagcacacacccgtagtcccaactattcaggaggctaaggtgacaggattgctggagcccaggaaatggaggctgcagtgagctgtgatcacaccacttcactccagcctaggcaacagagcaagatcctgtctcaaaataagtaaataaagaatgtgcaattaaataactaacattctagaaccataaagttctggatcatccaggccaaccccacattttatagatgaggaaagtgacattcccagttttgctaaggtccactgtccctcattgtatttccagggagtgttatcagtgtcacaggctcatctaaaccacactattaggactattccaaatcttagttcagtcaggtgtgtctgcgatagacctgagagagctcaggagagaaggtggtcagagttactattaatttcttattttgtgatttacagctttgagttggatgatgatttcactgctatgtataaaggttagttcccattctccactgttctgtttgtgatagaagttttcctctgtgagtgtgttaagatctcttctctggctttcagttctagacgtggtaaaggctcacaaggattcctggcccttcttggaacctgtggatgaatcttatgcccctaactattatcagattattaaggtagaagttgtctttgcagtaatgcctactatagtgtgtatatctttcttgggttttgttgtttgtttgttgttaaatatatatatattttgatacgtttttcttttcaactgtcaaaagttcatgtgatgtttctcgttttatctgttattcattacagatcagcattgctgaattctcattatctctctgtctctctctctctatggaatgtttgctctcagcatattttaactataaagagttatgtgtctcgtttaggcccccatggatatttccagcatggagaagaaactgaatggaggtttatactgtaccaaggaggaatttgtaaatgacatgaagaccatgttcaggaattgtcgaaagtataatggggaaagtagtggtaagcagggaaggagtttgtgctagatacatatctgtaatcaagaataaaatgccttctcttttacaaatacacatcctagtgccttttctgtaggacagtgaacagaatgtgtatgaaaagtcatgggattgaccattccagccacttatacagtgtctgccagggattctctcctgccccacaggacaatagagtgcagctggcagctaactggctcatcctggagaccagtctgggtctggattatactgtgtgtgcctctttaaccaccgaggggactgaccctacatagagctgactcttcaaccatctggggaagctggcgtagtagatctgcaatatcaaagtagaaatggctctttctgaacatcacactccggggcctgttgtgaggtgggggaagaggggagggatagcattaggagatacatatacctaatgtaaatgatgagttaatgggtgcagcacaccagcatggcacatgtatacatatgtaacaaacctgcacgttgtgcacatgtaccctagaacttaaagtataataaaaatatatatctatatatataaaaaaaaggaaatggctctttctactttgggtcatttatgcattaactaaaaatgccctgcttaaaaacagcagattcagccattttttatttagtatttctgcagtttagccttaaagaattaaatttttactggcattttttttctttatttactaacctcgaggcaggatttcactctgtcacccaagcaggagtgcagtagggcaaacatggctcactgcaacctcaaattcttgggctcaagggatcctcctccctcagtcccaagtagctgggactatcggcatgtgcgaccatacctggctaatgttttctttttggtagggacgggtgtctcactttcttgcccagtccagtcttggaactcctgggctcaagtgatcctcctgccttggcctcccaaagtgctgggatcacaggcataagttactgtgctcagcctggtttgacttaatagtcctagaggccctgtcccaaccatacaaccttgggcatcttacagatagaaaccacgtcttcttcatcttgcatccatagctctacaatataatgtgccctaaaggtgaattaaactcatagattacccaggttgcatcttctatttattagaattgtcttttgtgacctatagttctgtttctatagtttctataaactatagtttctataaacaatttctgtaaactatacctagaagtcaatcctcctgtcttcctatagagtataccaagatgtctgataatttagagaggtgtttccatcgggcaatgatgaaacattttcctggagaagatggagacacagatgaagaattttggattcgagaggatgaaaagcgggagaaaagacggagtcgggctgggcgaagtggtgggagccatgtttggacccgctccagggacccagaagggtccagcaggaaacagcagcccatggagaatggaggaaagtcgttgccccccacacgccgagcgccctcttctggggacgatcagagcagcagctccacacagcccccgcgggaggtgggcacttccaatggccgaggtttttctcatcccctgcattgtggtgggacacccagccaggcaccctttttaaaccagatggtaaggaatagagtggagactgttgcggtttctcctagtttgtgagttcatagtaatgtagaggccattcagttagtacttcctgcaaaatacttacgtgtatgtatggaatctttttccctgtgagtcctttgttcatgtgattttattttgtttactttttagtagagacacagtgttgctatgttgcctaggctggtctcaaactcttggcctcaaacagtccttctgcctcagcctcccaaagtgctgggattataggcatgagccactgtgtctagccattcctttattctaaatcctcctttttctcaatcacttgaattaggtattctcaatgtgggcaaaaattgggattaaaaaatatgtaatctggctgggcgcagtggcccactcttgcaatcccagcactttgggaggctgaggtgggcgatcacgaggtcaggagttcaagaccagcctagctaacatggtgaaaccctgtctctactaaaaatacaaaaattagtcaggtgtggtggcgctactcagctactcaggaggctgaggcaaaagaattgcttgaacccaggaggcagagtttgcagtgagctgagatcgtgccactgcaccttagcctgggcaacactgtgagactccgtctcaaaaaaagaaaaaaaaatgtaatctttattgtataaagcacaggtatacatgtagtacatgaatgtacagtatatctgcaacattataagatttcatggtagcaggcaactggggagaaacggctaaaatggatccttgggaggaggagtaataaaaaagagattgagaaacactgatttaatcttgtatctcctggagagggaagttgcttcaggctcataggcaagccctgatgcgggtgagcacgtgtgttcacagtctccctgtctccagccgaggtttagtcgtctgttttattttagtagaacgttcatcttcaggaaaacccttgttgtcaacctaaagtctgtgcctttcctttttcctcttcttgctttgttcaatgtgctgcagaggccagcagtaccaggaacatttggccctctgcgaggatcagatcctgccaccttgtatggctcctctggagtcccggagccacaccccggggagcctgtgcagcagcgtcagcctttcaccatgcaggtaagcagcctactctggaggtgcaggtgcagggggtcccacaggtacgtttcagagaaaaagtctctttccaggttaaatgttgttcattgcgtcctttcccaaagagtctgttcccatagagaagcatggcacaaagtgtgccttattctgtgagtctgtaactgtgctgccttttctcgttgccagcctccagttggaattaacagcctccgaggacccaggctaggcacaccagaggagaagcaaatgtgcggggggctgacacacctttctaacatgggcccacaccctggatccttgcagcttgggcagataagtggcccaagtcaggatggaagcatgtatgctccagctcagttccagccaggattcattcctccccggcatgggggggctccagcccggccaccagactttcctgaaagctcagaaattcctcccagccatatgtatcgatcgtacaagtacctgaatcgagtacactctgccgtctggaatgggaaccatggtgctacgaaccaaggacccttgggcccagatgagaagccccacctggggccaggaccctctcaccagcctcgcactctcggtcacgtgatggattcccgagtcatgagaccacctgtcccccccaaccagtggactgaacaatcaggcttcctacctcatggagttccttcctcagggtacatgcgaccgccctgcaagtctgccggacatcggttacagccacctccagtgccagcacccagttctttgtttggagcacctgcccaggctcttcggggggtgcagggaggggactccatgatggacagcccagagatgattgcgatgcagcagctctcctcccgcgtctgccccccaggtgtgccttaccacccccaccagcctgcacacccccgtttacctggcccttttccgcaggtagctcacccaatgtcagtcactgtgtcagcccccaagcctgccctgggcaaccctgggagggcaccggagaacagtgaagcacaagagcctgagaatgaccaaggtaatttacactgtcactttgggctctttaagctcttgtttcatgagtaatctttttacacagcatatcaaaccaagtgtaatctggttcccagcctctctttctttgtttattttttggttttgttttgttctgttttgtttttttgagacagagtcttgctctgtcgcccaggctggagtgcagtggtgtgatttcggctcactgcaagttccacctcccgggttcatgccattcttcggcctcagcctcccgagtgtctgggactacaggcacccgccaccacgcccggctaatttttttggtatttttagtagcaacggggtttcaccgtgttagccaggatggtctcaatctcgtgaccttgtgacctgcccccgtcggcctcccaaagtactgggattacaggcccaccgcgcccggccttcccagcttctctttcttgaacttctcagatttgggccaatcacagtccttctcttggtccgtcgatcccatttctggtcataattttgactctgcgcaggtgggcgcttgctgtgccaggcactcctcctgagacttttttttttttttgagacagagtcccactcttgcccaggctggagtggagtggcacaatctcggttgactgcaacttctgcctcccaggttcaagcaattctcctgcctcagcctcctgagtagctgggattacagatgcatgccaccacacccggctaatttttatatttttagtacagacaaggtttcaccgtgttggccaggatggtcttgaacgtctgacctcaggtgatcgcctgccttggcctcccaaagtgctaggattacaggcatgagccttccagagacttttatacattaattcatttattctcagaacaagccttcgagatagctactgttactatccttgtttttacagatgaaaaatccaaggcatggaaatgttagattatttgctctcagccagctagtaagtagcagagctgagatttgggcccagacagactagatccagcatctgtgctttacccactgcatcatcatagttcctctaaaaaagtactgtcagccgggcagtagttttggtggctcatgcctgcagtcccagaattttgggaggccaaggccaatggatcagttgagcccaggagttcgagaccagcctgggcaagagagtaagactgtctctactaaaacattaaaaaatggccaggcgcggtggctgacgcctgtaatcccagcactttgggaggccaaggcaggcagatcacaaggtcaggagattgagaccatcctggccaacatggtgaaaccccatctctactaaaaatacaaaaaattagccgagcgtggtggcaggcgcctgtagtcccagctactccggaggctgaggcaggagaatggtgtgaacctgggagggagaggttgcagtgagccgagattgtgccactgcactccggcctgggcgacagagcgagactccatctcaaaaaaaaaaaaaaaaaaaagttaaaaaattagccaggcgtggtggctcatgcctgtaattccagcactttaggaggccaaggcaggcagatcacctgaggtcaggagttcaagaccagcctgcccaacatggcaaaaccccattctacttaaaatacaaaaattagccaagcatagtggcaggtgcctgtagtcccagctactcagggagctgaggcgggagaatcacttgaacccgggaggcggaggttgcagtgaaccaagattacaccactgcactccagcctcggccacaaagtgagactctgtctcaaaaaaaaaaaaaaaaaaaaaaaaaggttcatgcctatagtcccagctacttgggaggctgaggtgggaggatcacctgaacccagggaggtcaaggctacaatgagctatgattgcaccactgtactccatcctgggcaacagagcaaaaccgtgtctcaataccatcttgaaagttatcaagtgaatttctgttccttggatacatacctggatttattaagaatggccaatagtgagatctagcaaatcttgaagcagtttcttagaaataccatttaggccaggcgcagtggctcacatctgtaataccagcactttgggaggctgacgcgggtggatcacctgaggttgggagtttgagaccagcctggccaacatggtgaaatcttttccctactaaaaatacaaaaattagccagacgtgatggtagaggcctgtaagttcagctacttgggaggctgggtcatgagaatcacttgaacccgggaggcggagcttgcagtgagccgagatcacgccactgcactccagcctgggcgaaacagcgagactccgtctcaaaaaaaaaaaaaaaaaaaaaaaaagaaatgccatttaagaggaataaacattaaactaggggagaaaatggaaaaaaaaatactttccaattaatgcttatttctaggataaatatctagcatgcatgtaattttcttcagtacctggcaggagaatggacacacttggacttaagataatagattcctggctgagcacggtggctcacatctgtaattgcagcactttgggaggccacagtgggtggatcatgaggttaggagttcaaaactagcctggccaacatggtgaaactctgtctctactaaaaatacaaaaatcagccgggaacagtggtgggtgcctgtaatcccagctcctcgggaggctgaggcaggagaatcgcttgaacccgggaggctgaggttgcagtgagccgagatcacatcactgcactccagcctgggcaacagagcaagactccgtctcaaaaaaaaaaaaaaaaagataatagattccacattaaattgatggtagggttagaactcatttaaatttttgtgtttctcatacctgtaatcgcaactacttgggagtctgaagtggaaggattgcttgaaccctggagttcgaggtttcagtgagacacaatcacaccactacactccagcctgggcgacagagttgaaactccgactcttttaaaaaaagaaaaaaaatggttaggggaaaaaaaccttttagtatttcttttgtggaaagtcctactttgttaacaccacctctagcagaattttctaatattgatttcaagtgagttctggaattcagagctttacaagaatcctgtttaggccggcgcgatggctcacgcctgtaatcccagcactttgggaggccgaggcgggtggatcacgaggtcaggaaatcgagatcatcctggctaacacggtgaaaccccatctgtactaaaaatacaaaaaattagccagcatggtgtcgggcgcctgtagtcccagctactccggaggctgaggtgggagaatggcgtgaacccgggaggcggagcttgcagtgagccgagatcgcgccactgcactccaacctgggcgacagagcgagactctgtctcaaaaaaaaaaaaaaaaaaaaaatcctgtttagttaagtctagttgctaagtttaatgttggctgaataatgaaaagtacggtttttcactttcattgtgtaatttgtaccattgacctttagggccagcttcaagtagcctgagctatgttaatagctctttaaaagttgttaagaatctctaaccttgtgcttcagatctgttaccaggatggtaatttcatcacacctggacaactgtcctcctagaaagataataaaaagattattttggctgggcgcggtggctcacacctgtaatcccagcactttgggaggctgaggcgggtggatcacctgaggtcgggagtttgagaccagcctggccaacatggtgaaatcttgtctctactaaaaatacaaaaattagccgggcatggtggtgcaggcctgtaagttcagccacttgggagtctgggtcatgagagtcacttgaacccaggaggcggaggttgcagtgagccaagatcacgccactgcactccagcctgggcatcagagtgagactctgcctcaaaaaaaaaaaaaaaaaaaaagattattttatatagatatatacacacacttacacactattgtatattgtagtcttagttaagaccttatttttaggtcgaatagtaagttaaagaattctgagaatgtaaacaagcataggagtctaattaatttgattgggcttagtaaatttccataatatgttaaaaatgcctcttttttttttgagatggagtctcactctgtcgcccaggctggagtacagtggcacaatcttggctcactacaatctccgcctcctgggttcacgccattctcctgcctcagcctcccgaatagctgggactgcaggtgccggccaccacacccagctaattttttatattttttagtagagacggggtttcaccgtgttagccaggatggtctcaatctcctgacctcgtgatctgcccgcctcggcctcccaaaatgctgggattacaggcgtgagccaccgtgcccggcccctaaagatgccttttgagtttcatgttgtaggcgtcttgtcttcaagacatgcagacaaaatgaatgtattcattcaacaaagtgattgagtctgtgtgcatgaactgagaggacagtgagacggagaagtccctcctgtggagcttttattctcgtggagcagaaaccaggcatttggccttcctgagcgcccgtcatgccctgttctttctggttgcatcccattttagagcttcccagcatggccagtgattctgatgacaaccatcccctcccagtgtgtttcacgtgcatctgcctagagtccgtgagccacaagccgtctctcagcctcttacgaatcgggcaacccacggttaaggacatttccattctccggcccactgtaagagtgaatgtagaggtgctaggttttacctttgtgtccgtgaaaggagtgaaaggaagtgtacagggaccccaatgtcctgccctctttcagggactcaaacaatttccaggtggggcttgaatcaccacacatccaccttaatctgactcaggcatgttcttcacattaatactgtcatttcagctactgagttattttttctcctcttttttttttttttttgcagcagagccgttgcctggccttgaagagaaaccaccaggtgttggtacttcagagggggtctacctcacacaactacctcaccccacacctcccctgcagactgactgcaccaggcagagctcaccacaagaaagggaaacagtgggcccggagctcaaaagcagctcctccgaatctgcggacaactgtaaagcaatgaagggcaagaatccctggccctcggatagcagctaccccggcccagccgcccaagggtgcgtgagagacctctccacggtggcagacaggggcgctctatccgagaacggagtcattggggaagcatctccttgtggatcggaggggaagggccttggtagcagtggttccgaaaagctgctctgccccagaggcagaacgttgcaggaaaccatgccatgcacgggacagaacgcagcgacaccgcccagcacagaccccggtttgacgggaggcactgtgagccagtttcccccgctgtatatgcctggcctagagtacccgaattcagctgcccattaccacatcagtccaggcctgcagggtgtgggccctgtgatgggagggaagtccccagcatcccatccccagcattttcccccaaggggctttcagtctaaccacccacattctggaggctttccccggtatcgccccccacaaggaatgaggtattcctaccacccaccgccacagccttcctaccaccactatcagcgaactccttactatgcctgtccacagagcttttctgactggcagagacctctccatccccagggaagcccaagcggacccccagccagtcagcctcccccaccaaggtccctcttctcagataagaatgccatggccagtctgcaaggctgtgagacactgaatgctgccttaacttctccaacccgtatggatgcagtggctgctaaagtcccaaatgacgggcagaatcctggtccagaggaagagaagctggatgaatctatggagaggccagagagtcccaaagaatttttagacctggacaaccataacgcagctaccaagcggcagagctcgttgtcagccagcgagtatctctatggaactcctccgcctctgagttcaggaatgggatttggttcatctgcatttccaccccacagtgtgatgctgcagacggggcctccctatacccctcagcggccggccagtcactttcagcccagggcttactcttcccctgtggctgccctcccacctcaccacccaggggccacccagcccaacggcctctctcaggagggtcccatctatcgctgccaggaagaaggcctgggtcactttcaagctgtgatgatggaacaaattggcactagaagtggaataagaggacctttccaggaaatgtacagaccatcagggtaagattgcattcaggcttttccccctaaagagagaacagatgtttattttatgtatttatttttgagacagagtctcactttgtcacccaggctggagtgcagtggtgtgatcatggctcacggcggcatcgacctcccaggctcaaggatcctcctgcatcagctgtttaagtaactgggactacacacatgccaccacacccagctaactttttgtttttttttttttttttggtggaggtagggtttcaccgtgttgcccaggctggtcctagtctcctgagcgcaagtcatcctcctgcctcagcctgtcaaagtgctgagattacaggcatgagccagcacacctggcctggatgttcattttaaacagaaaaatggccttagagatgaagataacagttcatggtctaggaacaaaaaaaatatgtgaattattgatgttgtacactctgtaggaaggtattaaacttagagcccaactttatctttgaaattttttccactcatgaaaatgaactggcatttaaatgactgacttagattttgatattgtaaactttatttatttatttatttatttatttatttttgagattaagtctcactctgtggcccagggtggagtgcagtggtacgatctctgctcactgcaatctctgcctcccaggttcaagcgattctcctgcctcatcctcccaagtagctgggattacaggtgcccgccaccacacctggctgagttttgtatgatactataaacttaataaccacagtttgagagctgtaagcaagcctgtgtcaacattgctgccatgtggagacactctgaccaaggtaaaaaaaaaaaaaaaaataggcctacccaggagtagaagaggagatcatgtagtattgaagttttactacatacctctcatttcttaccctatcattgaatgagaaaaccaggtttatccagaatgcaaacaagtccccatgagacttctttcacacatgcttgtgtagtgttgttctccagatccagttaggtgatctgccatccaggaagttttcaaatcgatagatacaaatgaaagttatgaagcggccaggcgcggtggctcacacctgtaatcccagcacttcgggaggccgaggcgggcagatcacgaggtcaggagattgagaccatcctggctaacacggtgaaaccccgtctctactaaaaatacaaaaaattagccgggcgtggtggtgggcacctgtagtcccagctactcgggaggctgaggcaggagaatggcgtgaacctgggaggcggagcttgcagtgagccaagatcatgccactgcactccagcctgggcaacagagcaagactctgtctcaaaaaaaaaaagttatgaagcatagtcttgaaaccagtaccattcagcataaaaaccagtgttcccctcctcagtgccatcctgtcatcttattgctagaccctctctactatttaacattttgtcgtgtttgctttatatgtctctaaatacctgttttctttgctttgctttttttcctaagctgttggaaagtaaattgtagacatcatggcccttaacccctcaatacttgagcatgcatctcctaagaatggacatgccttggagcaccatttcaaaacgattaccacactcaaggcaaataacagtatctaatagagtttttgtttctgtttcctcagttgtccccagagtgtcttttagagtcgtttctttgtgttctatttttattgtttttttctgataaaggatccaatgaaggctcatggatttgcatttggctgccgtgtctgtttagtctcttaatttatagcagttgtcatatctttgttttgttttccaaagagtccaggccagttatcatggagagtgttccagattccagattcatcacacagtctccttgtgtgtagatgaaactcttgtgccaggtgcagtggttcatacctataatcccagcactttcgggggctgaggcaggaggattgcttaagctcaggagttcgagaccagcctcggcaacatagtgagatcctgtctctagtgaaaataaagaacttagccaggcatggtagcacacactactcaggagggtgaggcaggaggagcacttgagcccagaagattgaggctgcagtaaaccatgatcctgccactacattctaacagggtgacagagcaagaccctgtctctaaaagaaaaaaaaaaatagattaaacacttttgtcaggagtgcagtaggtggtgcgtgtgcatgccacttactgccccagggggcacagaatgtcgagttgtcccagtatggatgattccaggcctgatcaccggggtgatgaaggcagtaccctcgtgactacagtgtcttgtttcttctgtcgttaacacgtcttcattaattcttcattgcttctttctcgtggctgtagaatgcagatgcacccggtccagtcgcaggcctcgttcccaaagacccccacagcagcaacatcacaggaggaggtgccgcctcataagcctccaacacttcccctggatcaggtaaggatcactaaaaattagagctgttcttcttcctccaggtggtaggaagtaagtatatgacaaccttgctgttctgaaaaaatgttttaaggtatcctgtggatacaggaactttgcctgtatcgtgcttccttggcacttggaaaaagagcaagaggcctcggaagtcacctctcacatgtctctttttcttattgtgatatggaatgcatacctatttggtgagtatttaaacctcattttttccaagccatctgcaaacattttttctgccatgatcccttgtctgttttatgcttcccacctttctcattggagagagactagttggtgggttttaaagtagtaatagctgcctctgagtgctgcttctctcccatgcgttgtctcgtgcaatgcttctctcccatgcagtctttcccttgacccccacaaagtagttctcattggctgcatcatcatcatttcccagtgtgcaagtcctactactgttaagcactgggactgggatctgaattgagaagtccaggactctagaacctaccctctggaagtaaactgtaactgatgaaacagaatcaagccattttcacacatgaggagcttggacattctttggcttacttaagttttttttttttttttttttttttttttaacaacccaatttttatttttgtttaaaatgtctttgtttctttcagagctagtccaaggaggaaatgagccccaagcaatggaaagctgcacacgaagactggaatgtggagaactggggagtgccctgtcagctctattcccatcacctgctccaccccttcacggcgacccactcgtgccatacttgagctggagccagtcacgggccctaaaaggacactccttagatgactgacacacagattgcaaaggtcctcggccagggatctcttgcacagctgatgtagacagtcaggcaaaactaatgaacgtggagttaatgatgacttttccaaatcctgagacacttttcagggaaaatcactttaaacttgggggagggggtatactcaagaatggagtggtgcttttaaactttgatgagcagctaaactcaggtatatatttggggaagggactactcttagtattaatggttttggagctgggtccagtttacagaattttcatgttgccttttaaaataatttttgttggtggtgaatgtattgtacataaagtgggaagggtgggtggggatgcggaagaaatgggggtcctaactggtgggcacacagcactggagtgatttttatctgtttacaatcatgtcacactgaatacttatgggagccggagatgagggtaggaaaggtttgatcttgtaatgtgtcactgtgtttccttagtggccagccagccttcagaatagctaaaggccttccttccttccagtcagcctgagagagaacacctgtcccctaagcacctggtgtctccattggaggcagactgctctcaggagactactagaagcttcagcccggaagacaggctgctctctcatgctggtggcccaaattgagaaagtggtgtcccttcctgattttgccaccagccctaccgaatagttgtaaaccagtatcaggaattgggatcgctagagtgtttcacgtattagaagatgaatcgtcctcatcacagacctccctgtcaggactgtgatctagaaggcatcacacacagctttctggcacgaatcacattttgtggaagtgactactcaggtttgtatattttagtatcaataaagaattgcacaggtttgaataggaaaaatgtattctatagatttacagtttgaatttaggaatatttcagtatatatagtttttattcgttttaagtgaatcatagtaaaatcagtcatggtgatttaaaatagctatcaagaacaagttcttggaattatctgttgtatctgtgataggaaaccattttacagtattaaattactttattacagttgtagagtt

SEQ ID NO: 1730 - DNA, 20064 bp, Homo sapiens
actagtccctcctcatggtgtagccctggatcatgctgttgaagtaggcgggcgtgttgcgctccgggtagaagaggatcatgtagcacttggggccgaagtagcccaggctgatggccaggaggttgagcacagtgaccaagaggtccacgatggtgaccagcaccccgctgtaggcagacatgaaggtgcagagggagacggatgaggtgaaatagaaggtcatgctgagggtgatgaacttggcctcgttgtagttggtgggcagctctttgcccatgtaggcgaagctgaaacccaccactgagagcagcaggtccaggctggtgttgaacagcaggctgttgcggtagttggggttacaggagacaattgtgatcttggggtcatcggggtcagtacgggtggtgggactgaggcccgtggccagcatgccaattaccacaatgaccattttgagtaccgtgataaatgccatagagacgtagggcccctggtagcggacccagtagctgtaggcgcgtgggaagcggctggccatcttgaaggcgcagacgatctggaaagaacgcacggcgatacaggagatgcagattgtgaagcagaggggaaagagggcctggcggcagaggcaggtggagaccttgggcggccccacgtacaccgggaccaccatgtatgccaccagcagcagtgtcagcatcaggaagcacatggggcccccagccgagcgaactatgggtgtctggaagtgcctccagaatatcaccaggatggccagggtgctgaggaagcccagggcggccagcagggccacagcgatggtgggtgcctcatgccattccaggaagaccagctgccgcttgaagcaggaggtctcactctggtaggaccactcgttattcgggcaggcctggcattcatattcatctgcaaaagccacagcgactcccattagccaagcccatcttccaagcacctgcatcctcccagccctgcacagggccaggctccagggatgaagagagagcaccaagggcaacccttgcattcacagccagtactcctcaagtctcatgtgcattggctcatcaaatcctcacagcaactgcatttcacagatgaggaaaccaaggctcagccaggttaagtaatttgcccaaagccagtaagttagagaggcaggacttgaatccaggtctccttgacccagagcctaccaactgcagttcctcccttccaagacctcaccctctggtgtgagaggcattcaaccactgactcaaagaatgcattcaatacacgtgtttttgagcaccatccattgtgacagggacctggggtggaaggccacagagagatggataaaacccagccctcacctcgccgctattgactgactgtgggaggaaggccaatgaaatcattccacaaacttgttcaccacctgctctgtgtcctgtgctctgctaggcacatattaaatacttgcattggtaaatgtcatcatccatttaatttacatgaagtcatgaaaaagaattgagctccaaactctgaactgtgctaaacactaatgtggacagagatgacgttgtctgcatgttcctagattttatgttctatagggagaaatgatcattcttctcatcaaggaagtcattcaacaagcacccactgagcaactatgctatgctttgagctacgctaggcacttgggaggccagagggataaatgagatggtgtcttccctgtctgccagaaactttcctcctattgcaaataccattcattcattcattcattcatccagtgggtgttccccagcctgactccctgggccctgggctatgtgtgtgtggagtgggatcagctgcagtccagcgtgggggagtgtcgtcccttcccttctccctccctctctgaagcagcctgtatggaggattttgctctacactaggttttgggaggatacaagaggaatcagatctggtccctggcctttggacactcacaccccctgtggggtactccagagaccctgccaaggaggacaagccctagagactccaggggcagggcaggggcagggcaggggcagggcaggagtgctaggcctgtgaatcataccttcagtgtggttgaggaaggtgccgggaaggcagtcgatgcactcgaagcagcagacgtggatgcccacaggcttcttcttttgccctgactggcacctcttggaacacatggacatagggatctggagggaggagggcaagagaccctgagtcctcttttcccacattctgggggccccctcccctctccaaccagcaggatgttcaggggaggaagcctagaagccccctaggttttggggtggaaactgtagaaaaaaaaaaaaaaactctcatgcttctagcaggggataaggaaagcagccattctgaaatatgctcagagcattctgttctccttaacaaatgcctttcctcaagggaaaccattttaccagaacccaactgatgtgaattttaccagagcttaactgacatggaaagagaaattctgaactccagccctctctagccttcttgtcttacctaagggggtggggtgagaagcacttatgaaggtcacagttctggggcacaggcttactgaaagattgagacctaatcacaggattacagaacacttcccctctatctcaccaccacatcaatcaaggcatacaaccgaaataactgcaaggctgagactgcatttaagaaggaatatctagggaaacccaaagataaaatgggagacaaaaaaggacactggagaaaattttggcctctgacaccattgctatttatttatagcaaatagtaagcatagttttaataaacttgaaaggactgaaataataacaggtatgttccccaacaacaatgtaatgaaatagaaatcaataacagaaggaagtttggggaattcaaagacatgtggaaattaaacaacatacccttaaataacaataggtcaaagtagtattcacaagggaaattagaaaatactttgagattaatgaaaataaaaacacaacataaccccacaaaaagacaaatactgtatgattctacttatatgaggtgtcttaggtagtcaaactcatagaaacataaagtagaaggatggttgccagaggctggaggaaggaagaaatggggagttgttcaatgggaatagagttagaaatttgcaaaatgaaaaagttctagagatctgttgcacaaaaatgcgaatatacttaacattactgaaatgcatgcttaaaaataaacaaattggtaaatgttatgttatatgtcttttatcacaaaaataaaaaattttaatgtaccaaaattaatggggtacagtgaaaacaatacttaagagggaaatttattattataaacatctgtatttaaaaagaagaaagatgttacatcattaacactcactatcttatcaaatcactgacattcactatcttatcgtagagtttactctttcactctcgatctcaatgtagtccacatggaagttgttcatcttgacattctgcagaatatcacgctggtctatgatattcatgacaccgtggtaattggacctggttagtagaaagtagcaagcacttttatatccaagtaagacctatgaatgccagaggattggagataaaccttgtaaagattcaaaacttggggttgggggtgctgttacattggtgatgtttttaggaggccaaaggtacagagaatgccaggacatccattctaagataatagacaagtcatccaccctacacctgctaccatgaaagtatggaactttataaacctctttagatttgcgggacaacataaattgctcctggaaatactactgcaacccgtttatcaggtgattcagaaggctttcagtttcaaggcagagggtaacaagtccagaaaatgactctgaagaaggccctggcttctgtataagcgatcctgccactggggccacatgatcgaggagatctgatgatgtttgagttatctatgcttataagaatgggcaagcccaaagagagagatgcaacaatgccatgccttctacaacaacatgctactcactacttgaaaatcaactcttggagtcctgctgggccatcatggaaattgagtacctgaccccaggacatcaagtgactatcagattcacagagtcttatagagaggcaggaataaaaacaagtcttcatataagggaaatggtatccaagaagcgccagtgggtccaagtaaatttcttaaatcaattattgtgactcctgtatctatttctgttgtaacaaatgcctctccctcaaatcatacctaagacctcagggagagattctttatgacaaataaatagaggagaacattcaggaatgattcacaagtaggttggtttgatatattaatgtgagctgacagtggactgctgccatactaagcttttttcagggatacaaagcttttttcagggtgaattctgaaggacagtaatgatgggagatactgcttgtatgtggagatgcaagcaggacacttggttgtttgctttgtgtgaatggagagatgtcctgaaggatggatattcttgagatcctggacatatggaatggcttggctggttgttcaggggcctggaaggagcaagagtggaagaatggagacaaagttgcttggggaaaggtatatgtatggatccatgagagtgagcacaaagcatgaagatctctgtgtctcatgttaatgcaaaccagagagcaaacacagagtaatagaaaccagattaaaaggttgacttgtcccagccaggcaccgtggctcatgcttgtaatctcagcattttttgggaggccaaggtcggcagatcaattgaggtcaggagttccagaccaacctggccaacatggcgaaatgctgtctctactaaaaacacaaaaattagtcaggtgtgatggtgcatttctgtaatcccagctacttgggaggctggggcaggagaatctcttgatccctgggggcggaggttgcaatgagccaagattgtgccactgcactccagcctgggcgacagagcgagactgtctcagaaaaaaaagaagaagaagaagaagaagaaggttgacttgtccaatgaaggtcagctggcttttgtcctcagccaccccaaggcctgcacagagtggccatgatgtcagggatggaggctacagatatgaacccaacagcttgagcttcctctcatcatggctgacctagctactgccattgcagaacacctaacattccagcatcagagacccacccatgctgagcccttgacttgatacaattcttcaaaaagaccagccaaccaactgctgaaagatctattacatcagatcttttcctctctgggaaaattccaggaagggaattttccttccctgatttcaatgcagcatcgccatctgggggcttacagagcaaatgatttattgatgcaggacactgtatcacctcagatcaggagtcaacttcatggtaaaggggtgtgacatgggcatgtgaccacaggctccactgatcctaacatataccacattacccagaagtatcctatctaaccaggtgatgagatgacatactaaaagctcagctaaggtaccatcttcaggaccccctgcaaggtggggacactgccctttaagatgaagttttgaatgaatggcttgtgtatagtgttgtggcctcaacagctagaatatgtgtatccagcaaccagaaggattggctacatgcaccattattctcaggaacccattgcagcattggtgcttctcctctctacaatcttacactctgctggaatagagattctggtccccaaagggggaatacttccaccagcagacactatagggctctacgattaccatgtggtcattttgggttcctcatgccagtgaatgagaaggccaagaaaggaagaagtaactgacctggattcgtgggtggagctgaggtggttgctacacaagtggagtaggaaggagtaggtctggcacccaaggactcaccaggcaaccctgggtgcttcaatcccagtgcacctgcgggtgggaatctgcagcaggcacagcccagaaatgcaaggcaactaagggcccagacaccttggggaagaaggtctggatcaccccccaggcaagtgactgagagcagccaaatgctggctgagagtgaagaaacccagaatggtaagcagaagagagagatgaatatcagtgacaactttgggtagtggctaagtccgccaaactccctttctgttagagactgagctggcggctgctctaaaaagtctgtgactcctcaggctcaaggaaagccactgagtggaacaagaaatgggcctctctgtggcctgcctcatattttctcaacccactgtttattccagccattgctgcagtcaccagtttcaagcaagtgccacctgtcagcacctggcctcggctacacagctgtgtcttgtattctgccctaaggctgcagtatgaaatgcccatgggaggcctctgaagctaacaccccacagagcaacccctgaccaccaggtgatgggagctagtggattactgccaccctcctccctcctctgggagacaatgctaaggtggctcttcgggaggtcccagtaagattgacctccagttgctcagagtagtgtgtggcttgaggttgttctcttggaccaactttccctgttccctgtggaactctccccagtctcccactcctgttcctgtccatgtatcatgtcctggaataaatcttctgcacataaacccttgtctcaggctctgctttctgggagacaccaaagctaagacagtatatgggctgaactatatcctgcttaaagtcctagtccccaggaccccagaatgtgacctcattaagaaatagggtcactgcagtcaacatagtcatataattagttaagatgaagtcatcctggaggagggtgggtccttaatctcatatgagtgatgttctcataaaagggatgaacttggagacagacacatggagaacaccacctgaaggtgaaagcagagatggggtggtgatgtgggtgtccccacccaaatctcatgtccagttgtagtccccagcgttggaggtgagtcctggtgggaggtgattggatcatggggatagagttctcaagaatggtttagtactatcctcttggcactctcctcctgattgtgagtgagttcttgtgagatctggtcgtttaaatgtgtgtgatatctcctccttcactctctcttgctgctccagccatgtaacaaggtggctccccctttgcctcccaccatgactgtaaattttctaaggcctccccacaagctgagcagatgccagcatcatgcttcctgtacagcctgcagaacagtatgcccatgcaacctcttttctctataaattacccagtctctggcatttctttgtaacaattcaagagtggactaatatgggtggtgcatctacagtcaaggaatatcaaagagtgccagcaaaccaccaggagcttggggagaagcctggaacagattctacctcacagctctcagaaggagccaaccctgctgacactttgatcttggacttccaggctccagaacagtgagacaataaatttcatctgtttaagctccctacccaccccagtctgtgatactttgtgaggcaggcctaggaaactaacacagacaccaccctaatttactccacaaaaatccccaaggcactcagaaactcacagcatcaggtacctctgcaactggggatagagtgctgtcggggactggggggaagagggtgcaggctattagcaaaggagagtgatgaagtctcttccagaagcttttagatctctagatcccctccccaactccacaaggcaggtctctatcctttcctactccagcagaattctgatggtctactctctaaagagggtaaaataatggatctttagattgacagatgtcagactcagttgaaggcatagctaccaaactaaaacaagagtatccaatgacaggctgtattagtccactttcaagctgctgataaagacatacccaagactggacaatttacaaaagaaagaggtttaatggacttacagttccacatggctggggaggcctcacaatcatggcagaaggcaaggagaagcaagtcacgtcttaaatggatagcagcaagcggagagagcttgtgcagggaaactcccatttttaaaaccttcagatcttgtgagacttatccactatcaggagaacagcacaggaaagacccaccctcatgattcaattatctcacactggatccctctcacaacatgtggggattatgggagctacaagatgagatttgggtggggacacagagccaagccatatcacaggctttagcctgaatgctgtatatagagaacctccgccacagactagctgtatgctgtatatagagaacctccaccacagactagctgtgtggcctcagacaggtcacacaacctctcggtgccttcagtttcctaacctataaaatggagaaaatggtagcatttatcctctagggttgatatgagaattgaggtccttagcaccaggcctggcacacacatgttcagtgagtgtttactttgcagaggtctctgaacccctcttcctggggagctggaaagccctgaacatgcatagttcccaatcagtgggggaaggacaggaccccagactgtatacccacgaatagaggtcctaccagctattgataaagcagaggtccctaatccccgggacacagaccagtaccagtctgtggcctgttaggaacctgggccacacagcaggaggtgagcagcaggtgagcgagagcagagcttcatctgtatttacaactgctccccatcacttgattaccacctgagctccacctcctgtcagatcaacatccgcattagattctcataggagcacaaaccctattgtgaactgtgcatacaagggatctaggttgcacactccttatgagaatctaatgtctgatgatctgttactgtctcccatcacccccagatgggatcgtctagttgcaggaaaacaagctcagggcttccattaatattacattagggtgagttgtacgattatttcattatatattacaattatatgttacgataataatagagataaagcacacagtgtaatgcacttgaatcatccggaaactatcctcctcccagtctgtggaaaaattgtcttccactaaaccagtccctggcgccaaaaaggttggggaccactgccccagggttgatgtgagaattgaaatcattagcaccaagtcaggcacacacacaaagtgaacgtttaccttgcagaggcccctgagcccctcttcctgggaaaccagaaagccctgaacaggcatagttcccaatcaatgggggaaggaaaggaccccagacgatacacccacaaatagacatccccccagagattgataaagcatctccaggctctgtccctaatgaaaagggccctagccactccagcaagggccccaggccccgccccaggcctgcccacccaccaggccccctggctgaccgtgttgttgatggtgtgccaggagatgtcttggatgttcttcagctgtcgctgcagggggtagtaggaggcgacgctctggaagggattctggctccggtcccattgccactggacaatctccaagtgcagagccacgtccccttgcgggtcgaagaagatttggtggtccaggagagtgaagttgaccttccagatctcctcaagcagctggcggggtcagagggaagggaagtggagctagcatcagaatctgagccagaatttttcctggacctgggaaagattctaccattccattagccttgatttccaactctgtaatatggaggcaataaatctccgaaagggtggcaatttaggagtcagtggctgagagctctgctttggagccagacacatctgggttcaggcctcagctctgccccttgctgtgaggccttgggcctgtttcttaacctctctgaacccgtttcctcttctgcaaagtgggagcaataaaaactctatcttctgggcttggaagcaaaaaataagttcatctatgttagagacttagagcagagcctgagacaggaagcactcctaccaaggtgctgatagatttccttttccctggaagtcacctcagtcatccctcttgaacccaatacatgagatgaggtacagagtccactgtctctgtcacctgcaaaggccaattggggtctcccctgatccctgggtccttcctacctccccagaccttagggtcagctctcattccagtctctccccacctcccaaccccccatcactctcagtaggcagcagctgggacaaactagagcacactttgaactgggcatcctccgacctaaagtccagtcccagttctgttcgcaatttgctgtgtgactctgagcaagtttctgaaccttgctgggctaacgctgaaaggacttccagctcaaatatcccatggacctggctcctagattttccctccataaatggtagtgtccatttggctatatctttagggctcacctggcctcagggactgatacacacagacaggtagccaagggagtcgggccctggccttctcccttccctgcctagcacgtgaggtcctgactcagaaagactctttggaatgtgcacaggttgctaagcccaagggcaatggtcctttgagccaagaaggaggctccaaccaggtggtcggcctgaggatgaggatcaggatggcggaggcccctgggaatcaggtcctgggtgcccatgttgcacctctgcaatgacctgcccaagcagggttgagcacttgggacttgagggatccaagatatcacccccaaggggtcggaaagcactggccttgtaattgtcctgagtgggtgggagcctagactattattggcagggacttgggcaccttggggttccctcatcaggttgaaccccgtttccccttccccatctagccctacccctatcccagcataagctgtacatttaaggcagactcaagtccacctctccaaccccacactctctcctgaggccagcactcggtgtcagagaagaggaagaggaggagtacattcagcctcttcgctgccccaggtaatttgcatcatgattgcacatcccctcaataactcagcagggcacatatgattccttccatttaacagatgagaaaatcaaggctcagagatattaaatttgcccaggtttgcacagctagtagtggcagcactgggattccattccaggtatgatagctaagctctgcccagctcaccgccacctgccttacaatgtacgaacaggtgggccatatccgagatgcccgaggggtggagaaatgtggagagagctgtgtggggaagagccagaccagtgccgagggccccatttgtgaaataaaaggattggaccagaacctgagaagagctcgcaaccctgaccctcctgattcaatgactggctgaacattttgttttgctttttttttaagacggagtctcactctgtcgcccaggctggagtgcagaggtgcgatctcagatcggactacaacatccgtctcctgggttcaagcaattctcctgcctcagcctcctgagcagctgggattacagacgccctccactatgcccagctaattttttgtttttttagtagagatggggtttcaccatgttggccaggctggtctcgaactcctgacgtcatgattcatctgcctcggcctgccaaactgctgggattacaggtgtgagccaccgcacccggccaacctgctgaacagttttgctgtgatggccacaaatttgccagcctggatttacccaacctcccactgatctgaccccaccaccaccatcagcacgggcagcacatctacccagtgtcatctccaactcttctcatcgcccctgagtcctgtctctctacctcgcctctcatggggtgcccatccccactaccccagcactatttcatcaccatcccttaccaccacccctggccactccctagctgggtgcctgtcacttctttgaacctcagtttgacctgtgtatgggacagcaaccgtgtagtaacagtatctgctcaacagtgtctgtctgggggtgactgagaattcatgtaaagaggtgaacaccgtgtccggcacataagtgcccattcattcatccaatattcactgagaatcaacgcgaagccagaccagtgctagcaacttgggatacagcattggaaaggattggcagggtccctgctctcactggcctcggtttgggaggtgtggggaatagccaataaacaaacaaaggatatcaacacaatcacaacttgggatacctgttatgacaaaaataaacagagtgccgtggtgtgacccagcaaggagggtgggaggtagtaaggacaccacataccattttgcaggttgagcccttcatgagggggtccatttaggacaactgggaggaacagctggagtccagcccattcaggccacaaagccatgtgcctgccacaggtctgcgtgcatccaaagccaaagagcatcttggtctaacttgtctgcacaaaagggcatcattttctaattctcccaaggacgctgtttatgccagcagagaccctgggtgaagcctacatagggtgggctgggctccctgcctcttgactgcatcatccccagccctaaattggcttgttgggctgtctcaagaatgtcatctcagtgcttggaatgctctatgaacgcctgctgcctctagacaaagccgcctctccttcggggcactagatgccctccagtaacacctgcagttcccgtcgcctctcagtcttcaccactcaagcccagtcacgtggccaggccaccactctcccactctcctcctggaaggtccagtgcctgttcactccctacttcagtcctgccttccctgaccctctcccaccatgatgatgcccctgctctgtgcacaggtgcaattctgacttcttgctgcacttggcagacagatcttattaactgtcctcatctcctcctaggttgggggtcccccaggcctggcacatagtaggtgctcaacaaaagggatgggacatcctggttgctatgattggtgccctttggtctccgctgctgggagaaggaaaaagtcaactgtctttcatcatagctcctgccagttgcagctgggaggatgcccagaaggtgaagtgggaaaaccacagcagaatgggccagacctgggttcaaaagcatggtccaccacttaccactgagcgatcacgggctagtcacattgacttcctgcccctcagcttttctacctgtagattatcctcacaggagggtcatgagttagatgtgatgtatactaggcattcagtgcctagtaggcactcaaagaggagtaaagcacccatgataattatgtatattattaatgtaacaggacatacagcaatacacagtatttttaccaactggcaccagaattccttttaaagaataactgcaatcttttaaaagaaaagtgtttaaggttgcaaggttaggatctgagattatgggatagagaggtacaattatatagaatgagagagagaatttcttcagagcaaactaatttgttctgttaaggaagtgaacagttatttgaggatgggagagggatctagcaagggggcgaaaggggagaacaaagaggggagttggacagggtttagggaagtggctaaatagcagggtgggaggctggccccaaactgtgaaaaagccaaggaaccatttaagaacagagatctctaacagcaaagtataaagtgtgcgtctctaatgtaaatcccccctgctcctctgatcctcagtaaaaccttctatatcccagaaagcttcgtggtgggaggtctctgtgtgtgcctgtggatgtggatgtgtgtgttaagccagaagaacagatttaaagtctatgtctgaaccagggtgatagagaactagggtaatgaagacccacaaaagcaattcaaggcctttagagggtccacgcgaaaacacaagcccgtcccaggctctcaaccttggagagactgggggaggggggcgctgccgttcccactgcctgtgggatttccttctggtgaattccacctgaatctcccaagaacagactactatcttgaatggtgagtgttcaattaatttaaaaagcaattttgttttggcaccaggaaggactagtgctatgtgtctggaagaatgggatactcatgccctttcacacccatttgcccagaaccccaggggaggaggatggaggtgccctgcagactctatggcagccaccccctcacctgccaggggtagaccaccctcttggtgcaggtgcttttgtcacagccgaggaggctgtgcagggcatgggccacagcatagaccgcagagtacacgctgtagacgacacgctccccagagagcctgagaatggtgttgaaggacaaggtggcgttcaggcagttgtcgcactcctggttgcaggtatagctctggctggtcctgctgaggggtggcggcccagcctgtgggccccactcgcggaactcactgaagcccgggatgggcacgctctggatggtgatgcccaggaaggtgcccaagtggcgcagctccgtgaggttgtgcaggaccgggtcgatggcccaggactcggaggcgatccacacggcgccagtgaagttctggcgcagcacctcattgaagaagtggtacagggtcaggtcgggcgagaacacgaccacgacgcgcgctgtgctctgctgcagcttgtccacaatggtcaccaggcgctggcgctcctctgacgtcatgttctggttgggctgcagtgtgggcagcgtctcctggaaggcgatgcagatgtcgcgccgggccacgcgctcgccaagcagctggccattgtcgcggccataggtgtcgctgctcaccagcacaatgatccagttccagcggaagtgcagcatcagctgcaccatggcctcgatgtggtggtcggcgctgggtgtggtacgcagcaaagccgggaagcgcaccttgtctcgcagctcatcgctgatggcgctgtaggtgatctgcaaggggaagggctgtggcatgagcgagtgccccgctgggtgctctgcccccaccccagggctctatccaccatcatcatctgggaagcacctagtgcaagccaccccaggggtaggtggtttacaccatcgtcaatcatcatggtccccaggtagccccatgcaataagaacctactgtgtgccaggccctaggccaggtgccttatctcagtcttatcacgattattgagcacctactgtgtaccacaccctgggccaagccacatacaccatcatcctcatggtcatcagcacactggcttttattgagaaccacatcctgggctaggtgaatgacatagccatcatccccatcatctagaaactcttactaagcacagcgctttcctcctccccctcatcaccgtcaggctcatcaactagccacatttcttccctccacctccagggctccatggtttccttcccaactcactgggagttccatctcctttcctggttccttctcttctctatgacctcttaaccttggaggaccctgggctcaggcctcagtccctgccttttctccagctgctctccccctcccttggtggtcccatccagcctcatggcttaatatcccatttccacgtcaacaactcccagtggatagccctggccgggacttctctcctgaacttcagatgcataccacaactgcctgcctgacatctcaaacttcacagatcgaaactgaaccctgttctcctctgagcctgctccatccacaccctcccccatcttggctggtgatgaatccatcattccagtgactcagggcaaaaactctggagtcgtccttgactcttctttcgcacacaggtcacactggatccatcagcaaatcctcttggctctacctttaaaatgtatccatccagtgcctaccagctccccactccctcctgtccagccaccatcatccccggcctgcactgcaacattacccatccacctttcccctatagtctatgcttaacatggcagcccagtgaccctgctcacacacatgtcaggtcactttactcctcttctcagaactcctcaacagctcctaacgtcacccaggaaaagccagtccttgaatggcccctaagggctccgtcatttatctgcacaactctcgcctgtctgatttcatctccttctcctctccctctggttccagttctgctcatctagttccgcaaacataccaggcacctcctggccttggcacttgctaacccctcttcttggaatgttcttctgctaggtccctcatggctccctcactccttcacctccctcaagtcttcgcccaattgtcagtgacacccacctgaccaccctgttgaaaattgcaatctccttctaccaactcctcctttccactgacatgccagacacccccaccctgcccacatttttattttattcattgcacttctcacctctaacatcctgcatcacctattattgtttacatttattttctgtctctctccactagaagagaaactccatgagggcgatgatttctaagttgttgccagctgtatcccagcacctacaacagtacctggcacatagtaggtgctcaataaatatctgttacatgaatgaaagaatgaattcagtcctcagctagatgcttcatgtaaaagtactaacattaaacagtaacaatcacaatatttgtgactacctactgtgtgccaagtcttttgctagctgatctttaatgaatatatagcctgtaccagtactgcacttggcactttcaatcatgattatgataatagttataataatagtagtaatacaaatcacccttttgtgaggacctactacgaggcagaccttgtgctaggcagctgtacagaataatactaagcacttcaagtttttattcctgtgcaagatgctttataaaacaacattatttactacctactgtgtgccagaaatttacacaggttgaacactaaccttcagacagtcctgggatggaacgcttatcatcccactttacaggtgaggaaactgaggctagaagagtcaagagatttgccaaaggcttcactgtggccaaggctcggtgccaagttgcacaaccagatctgcccgcttccaaagcctgagcccttactccataagctgggctaccttctcaagatttgggctgatgtcctgaccctgcttctggtcctatcatcacctcccatgattgatggaggaagtggcttctgaggcctctagacagccattcctctgcccccctccccaggtccttctccagggcccaggggcctcacctgtggaaggagaaatagggagaggaagttggccacagtcatgacagactcggagttgtcagggccaatgacagccaccacacgggaaatgtagttactgtagtcctcttggatgggaaggaggttgtcctcgtgtgccaggaagtagagcaccggctggacattgttggagatgtagcacacatccacgatctcatagcccagcagcacaccaggcagcaggctgctgtcattgttgatctcctccaccgcaaagcgcatggcctgcatgaggttgtagcctatcaccttcacttcatacctggaggggccacagcatcatgaggtggaagcagatccagaatgaggaaggaagagataagagaaccagcccactcctccttcctgccacaggaaagccaaggcattgactgagaagagccactccagaagactcgggcattttcaccatgtcattgtcaccataccacatctctagggtcaccattgcccatatggccaccactgatactgttatccatgtggccatcatcactactatccctataacctccatcaccactctaccaatgtccaccaatgtgaccatcattatccactaagacttccatcaccaccatcaccactatcaccatcatcacccactacccatattaccaatatcaccaccagggccatcactgtcaccacaaccttgtgaccatcatcaccaccatcatcaccgtcaccaccatcactatcagcacgaccattatcacagccatcatcaccaccatcaccaccaccatttccaccatcaccaccaccaacatcatcatcactaccatcaccaacgccatcagtaacaccctcaccaccatcaccatcatcagcaccatcattatcagcatcaccatcatcaccacccccatcaccatcatcactaccatcaccaacgtcatcactaacaccatcagcaccatcatcagcatcactacgatcaccaccatcaccaacaccatcactaacaccatcaccagcatcactaccatcgccatcatcaccaacaccatcaccaccatcagcaccatcttcagcatcactatcatcaccaccaacaccatcatcactaccatcaccatcatcaccaacactatcgttaaaaccatcaccatcatcaacgcaaccatcaccattatcactaccagcaccatcactgccaacactattaccaccactgccatcatcatcactaccatcaccatcatcaccaccattaccactatcatcatcatcatcaccatcatactttttatcattgtcatcatcaccagtattactgttatcaacattatcagcatcaccaccattactttcatcacaactatcaccatcattatacaccccaccatgatcacaagcattagaaaacccagcatcatgcctggtgccatcaccttcaccattctcaagccagcatataatcttccccagtgtcataaatgatgcatttctcatactcaacccttaatcatcttttgcactgttcttcctttctccttgtctcccgcaataccttcaccctctctgcaagaggtcactcttttttagtcccaggctggctccatgtccttcgtgcttgcatgcagatgcacacagcccccacaatctccaagtgatgctgccaccccaaggggctcagggaggaggtgggggaagaggaacttccctctcggcccaaaagcacccctacccaccacagaacctgctacagaaaaatcacattctgcctcccaaaggttttcagaatgggctttgacatggacccattgggagtcccccagttgccaaagtgggtgggagcagtcttgatggcctctaagagccctctaggctcaaacattctgtaactctatttaaaaaaaatggcactgagatgaccccagtctcagtgtttcagagcacagtcgccaaagattttggtaacccatattatacggggcctccctgaggactaggggcatggatccagaataagggggttggcaatgaatggggaggagtgctttaagcccttggtcctggtctggctcccaaggacccacaggaccaggcctggcctcccaccccatccccactgccacttccagccccacactggagactcactccttgcacatgggcacctgcaggaagttaaggtgaacaatgcccttcatgttggcatggagggagaagaggccacccaggaggtaatccccaggcaggtagaagtccgagttctcagccggctcagccaggacccataggaggaagaacagggaggagatggtctttgccctgggccccatg

SEQ ID NO: 1731 - DNA, 78948 bp, Homo sapiens
tctggacccagctgagtttttattttacagatcataaaacggatgaaagtatatcacagtaattaatgaagccgttctaatttagcttgaagagatttaaaattcccagtgatggcttgtactgctactgacgagctcatagactggagctcaacaaggtaaccacaaacagcatccaggcagagatttgtaaatcttctcctacaacgaaaaagacacatgattaattatacatttacaaacatttcctcctgcaggacttcttccccaccaacttctggcaactttaattctcacaggagaggaaagaccatgtgattaagtaaataagaaataaagtaaaaaagaaaacttgggtgtaggtgggttccatttgaagattttttttttttttttgagacggagtctcgctctgtcactcaggctgcagtgcagtggcgccatctcggctcactgcaacctctgcctcctgggttcacgccattctcctgcctcagcctcccgtgtagctgggactacaggtgcccgccaccacgcccagctaatttttttgtatttttagtagagatggggtttcacgtgttagccaggatggtctcgatctcttgacctcatgatccgcccatctcagcctcccaaagtgctgggattacaggtgtgagccaccacgcctggcctgaagatttttacaatgagaagaaagcagtaagagatgattcctgctaatattctttttcaaaagaatatcccttaaatggccaataatatcacaaagacataattgaaatgttttggtcctagatcactaatctaaagtagaagaaatgaatacattatgtatgttcagctgtagaaaggatttaggacaagggttgaaaatggaaaaaactcctatttttcatacatggtgatcaatatcattcaaatagttattgctaatatacacaagaatcttcccatcttctcttcaaattttttacccaggtatttattagaagcatttaaaagcttttgctgatccaatatttaattcataagtacctttcacaatttaaaacttggctgggattctcaacatatcttatcaataatacatgtatacaatccaaaaggtgcagtggcttcttcattctgttccagaatggatcctatgaagaaatatacataatgaaatgtgaggcaaattgtgtcaattgattatttaaatcatttatactaaagtagacatcaggatccatgcaaaacttatcgctattaaaaagcatttaatatcacatggctactaaattatatatctgattatagttaatatttcaaacaacattaaaaacttattaattaacaacactatgatattacttaggaggcatatttgatataccaatctactttgcagagcatgtaaatgtcccgcttaggaatctgagataagagaaaaatctttctttctatgggttgtgacaccacttttactttgaacctatgcagatttagtctgacatcataaagagactaaactagcagtaacagaaacttaattctaggtctggcttcaccagttactagccatgtgacttaagcaggttatttaacatctctgctcttgttttttgcaatataagatggagatactacagttacctgctcatttccatcacaggctaatgttgtaaagcactgtgtgatgctgctataaaagacacaatctactttgacaagtttttatttggatcttttatccttagcataaaaattacaaaacatatagtctgataaggttcagcagggtgagaaggatctttaagcactgatattttagatgaggttatagtaaataaatacaatgtaatcttgttcttttaaagcaaatgatgattcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcaacagagcgagacgccgtctcaaaaaaaaaaaaaaaaaaaaaaataaagcaaatgatgattcttaatgtaatgagtttagcccacaccttggtttagcctctttcaccaagagtaaagcatatttattaatattcaaaaataatatttcattttaatcatgatatacaggaaagcaactctcattatcagtttaaaaagtcaaaagcataatttccaagactcaaccaagtgtaattagactaagtgataggatacaaaaatgcaatcaaaataccccactctatatctacaaagttactttaattaaagaaaataattttatgttatttaatattttccttacccgtgatttgaacaactgatcataaacttctagtagtctaggtaatggtactccaatttcattcattgtctgtattacgaagcccacatcccagttcaaagtacaaacctgctgttctaaaaactgtacaataaaatctgggaagaaaaaaaaagatcggaaatttggatttttagctcttgatactaaaaggtaggtcttattcataactgaatagtttctagggggatatcttctgaaatccaattgcaattttttggggcggggggttttttttgctatgttgcccagactagaaatagtggctattcataggagcaactacagtgcacgacagccttgaaatcctgagctcaatcctcccacctcaacctcccaagtaagctggggctacaagtgtgcaccatcactctcagcttaaaagaaaaaaaaagttttttttaaataaaagtaagatatataccagaacaggcaaatctaaagtagattagtggctgcctagggctggagggtgtgaaggaatgggaagtgacaactaatgagcacagagtttctttttgggatgatgaaaatgtcctaaaattaaaattacagaacctagaaaactcagaaagatataagaagaaaacagagacgattcacgatcccaatattgaagaggacttcactgataattttttttagtaacagtatttaaaaaaaataggtttcctgtccctgtccctctccctgtccctctcccctctttccaaggtctccctctgatgccgagccgaagctggactgtactgctatctcggctcactgcaacctccctgcctgattctcctgcctcagcctgccgagtgcctgcgattgcaggtgcgcgccgccacgcctgactggttttcgtattttttgggtggagacggggttttgctgtgttggccgggctggtctccagctcctaaccgcgagtgatccgccagcctcggcctccagaggtgccgggattgcagacggagtctccttcactcagtgctcaatggtgcccaggctggagtgcagtggcgtgatctcggctccctacaacatccacctcccagcagcctgccttggcctcccaaagtgccgagattgcagcctctgcccggccgccaccctgtctgggaagtgaggagcgtctctgcctggccgcccatcgtctgggatgtgaggagcccctctgcctggctgcccagtctggaaagtgaggagcatctctgcccagccgccatcccatctaggaagtgaggagcgcctcttcccggccgccatcccatctaggaagtgaggagcgtctctgcccggccacccatcatctgagatgtggggagcgcctctgccctgtcgccccgtccgggatgtgaggagcgtctctgcccggccaccccgtctgagaagtgaggagaccctctgcctggcaaccgccctgtctgagaagtgaggagcccctccgcccagcagccgccccgtctgagaagtgaggagcccctccgcccggcagccaccccgtccgggagggaggttggggggtcagccccccgcctggccagccgccccgtccgggaggtgaggggcgcctctgcccggccgcccctactgggaagtgaggagcccctctgcccggccagccgccccatccgggagggaggaggggggggtcagccccccgcccggccagccgccctgtccgggagggaggtgggggggtcagccccccgcccggccagccgccccgtccgggaggtgaggggcacctctgcccggccgcccctactgggaagtgaggagcccctctgcccggccaccaccccatctgggaggtgtgcccaacagctcattgagaacgggccatgatgacaatggcagttttgtggaatagaaaggggggaaaggtggggaaaagattgagaaatcggatggttgccgtgtctgtatagaaagaggtagacatgggagacttttcattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagacgcttgaaggcagcatgcggcagcatgcttgttaagagtcatcaccactccctaatctcaagtacccagggacacaaacgctgcggaaggcagccgcagggtcctctgcctaggaaaaccagagacctttgttcacttgtttatctgctgaccttccctccactattgtcctgtgaccctgccaaatccccctctgcgagaaacacccaagaatgatcaataaaaataaataaataaataaataaataaataggtttcctcactttaacagcttttcagaaaagggcaactgcatcctgatttcagaaatattaaatgtgttttttaatgccccacccctagatttatttgacagttctaactgtggcctcattcttacttttaactgcctatcttatcataaacagtaacagccaaatttatagttatggccaggcgtggtggttcgcacctataatcccagcactatgggaggccaaggtgagcagatcacctgaggtcaggagttcgagaccagcctggccaacatggtgaaaccctgtctctattaaaaatacaaaaaaattagctaggtgtggctaattcaagactagcttgggcaacaccatgagatcccttctctatcaaaagaaaaaaatatatatatataagtaaaacatagaaatcctcctaactcagcctgattagctaggactataggcacgtgctaccatgcctagctaatcttaattttttttgtagagacggggcttgctatgcccaggctggtctcaaactcctggcttcaagcaatcttcctgcctttgcctctccaaagtgttgagattacaggtgtgagccaccacacaaagcccacatgattatttctaaattaaaatgaaaattccttaaaaagaactatgtacaatacagtgttatttatttatttattgaaatggggtctcactgtgtcactgaggttggagtgcagtggttcgatctcagctcactgcagttttcacctcccaggctcaagtgatcctcccaccatagcctcccgagtagctggaaccacaggcgcatgccactatgcctggataattttcctatttttttgtagagacagggttttgccatgttgcccaggctggtctcgaactcctgggctcaagcgatccatccgcctcggcctcccaaagtgctgggattacacctgtgagccaccatgcccagccatggtgcagtgttttttaaaacaactatcaaaagtaccagtttcacacacttataaacatttatataaagtatgtatttgctcttttatttctctttatttttaggatcaataaaatggtatggaaagggaaccgtttccatattatacctacaaaagtaagggtatgaataaaatggttttatttctgactatgtccagagggaatagaccctaagtcagagatggtctgtaaacaagtttgaatgctcatttgaaaaaaaaaaaaaaaaaattaggctgggcacagtggcgaacgcctttaatcccagcaccttgggaggccaaggcaagcggatcacctgaggccaggagtttgagaccagcctagacaacatggggaaacctcatttctaataaaaatacagaaaattagccaggcgtggttgcaggcacctgtaatcccacctacttgggaggctaggcaggagaactgcttgaacctggaaggcagaagttgcagtgagccgagatggcatcattccactccagcctgggcgacagagaaagcctctgtctcaaaaaaaaaaaaaaaagttatattgtgaggattttcatgtctctcaatatttttaaataacacaaaagtagttgatattctaatttatggatgtatttatgttgcttctattgttttaccactgaggaaaacacttgtaggttggcaaatagctcataattagctaccttatttaaaaattatagccaccatatctcattaagaaagggattcaaacactaagttttaacataattatttgctattttaaagaaaaacatgccctcaacataaaaaaagaacagttgaatcaatcacagattacctatgcacaaaaacatcaaccgtttttcttttctcttcagaaacttgtatagggttaccaacaatataatcatagtttgtcagtcagcacaatcctaagacaggtaatataaacttggaaagttagtcacagaaagtttcatactcaactcttcattaacaaattctgccattctttggaagtctttccggagaggcagaattaaagtgctgaactaaatagcaaagaaactctttattttactcgaaagatcgttatttgtccatatcaacggagaaaaccatcagaacagaaaatacgtgactgcacctaagatcacagcttacctaaaggaaagaagcgtggtgtgccagcataaattttgccaaggagaacaatcttgagactaagagcatgcattctatccgaggagctcaatgtcacactgtcactcaattctgtaacaaaaagacatgtcatttgaaacccaaattacttttaatgtgaaatgtttacattggttatttaattctgtttcaaggttcaaaatactttagaacagatagtcacattaatatgattaacagatttggtgtttctgttattgtctgagatactctcatgtcttaccaggttatactggttattagattctgaggtgagtgtctcagtatcttttataaggcagcacaaataatataaattaaataaccttttcactgagtattctcccgaatattcacttgggtcattctgtgtatgatcatcctccaccatacccaggtgacttccacttactctcttcttaggtatacacaattttcatgagccactagcagcttgcattatattagttactagcagcttgcattcctccaccaagtcactacataacgtatgctaacatacctataactgaacacttacctttctctatgatatcttgccaaagtgtctgcaccaatatagggtctgaataaccggcacaatgaattattgcaagtttgcactctgcaagtttaaatgggtcagcaaattccccataaagctgtgagagaaaatcccaaaattaacatccaactagagatcaacattcagagattaatagtgaagcactccttgaaaattaaaaaataaccaaagattttacataaagtttctgaaatatgatataaagatgtgatgatgtatgtagctggttataactccatatttaaaaagttaagggtatgggccgggtacggtgactcaggcctgtaatcccagcactttaagaggccaaggtgggcggatcacgagatcgggagatggagaccatcctggccaatatggtgaaaccccgtctctactaaaatttaaaaaaaaaaaaaattagctgggcatggtggtgcatggctgtagtcccagctactcaggaggctgaggaaggtggaggttgcagtcagctgagatcacgccattgcactctagcctggtgacagagaaagactctgtctccccccgccaaaaaaaaaaaaaaagggtaagggtatggtaaatacattcaaacacattttagcatgtagagcttttttcttggctgggaagaagatgttgcaacgacattctatttattaattttaaaattcattttttcaaatttctgtgggtacacagtaggtgtatgtatttatggggtacatgagatgttctgatacagtcatgcaatgagaaataagcatgtcatggagaatgtctattcctcaagcagttatccttttgagttacaaataatccaattacattctctattttaaaatatacagttattattgactatagtcaccctattgtgctatcagataggtcttattcattttgtttttgtacccattaaccatccccaccttccctacaaacctcctgcaatggtattttagaactagtgttgtataaacaatgggttgaagaatcacaggaatactgacaaatctcaaagtgtttcagggtacctggaactatgtctaagaataaatgaagaggaaggaactgctcagaaaattacagagagagaaagaggtttagagagttaagcaaagataagttagtttttccaaggcaagaagcgaggccataaataagatggttttggttttttagtttttttttctttttgagacagggtctcactctgtcactcaggctggaatgcagtagcaccatcgaggctcaccacaacctgggcctcctgggctaaatcaatcctcccacctcagactcctgagtagatgaactacaaccacacaccaccacacctggctaattttttttttttttttttgatggagtcttgctctgtcgcccaggctcctagactgcagtgccatgatctcggctcactgaaacccccacctcctgggttcaagcaattctcctgcctcagcctcccaggtagctgggattacaggcgcatgccaccacgcctggctaatttttgtatttttagtagagacagagtttccccatgttgaccaggctggtctcaaactcctgacctcaggtgatctgcccgcctcagcctcccaaagtgttggattacaggcgtgagccacagtgcctggccttttttgctatttttttgtaaagatgaggttttgccatgttgcccaggctggaaataagctggttttaacacagctctcatgcgaggatgataggttctttgtagctactggcctggaaagagtagcttagcctttttctaggagtcagatgaagcagtggtgatctgtcagcccagtgacaagctgccaaagatgccttatcttatttgtggagataaggtaattttccccatgaaacaaaaagcaaaataaaaaacaaaaatttctcattattaggtaactactataaaaatttcacttgcttttttattaccttagttatgtccatcagctcagaatccagctgagaaactgcatcctgtacagaagaatgatgggaatactgcctttgtagtgtctcctgtatctgaagttggatcctagcaacctagtttgggcagaaaacaggatgtcttaatttatttatgataaatcaacatacgtttgaaagaacggatcctactatctgactttaagtttgctaaaataatgtataaatgaagatttctatcataataggctaatattatcataacagacatcaactaaacataatagatttcacaggaagtatactgtggcagactccttgctgcccaatacttataccttccaagactgtagccaaatggttagactatacagctcagcctcctctgtaggggaggtatggccatacaaccaagttctcttcaaaggaatgtgagtagaagtagtgtgtcatgtcagggctatagtttttaagacagtgaatgtgttctttcttttccttccaccctctgctgaagataaagcagaggccctagggaatggtagtgccagaaaatagaacttgggttcctaaatcaaccacacggaggaaagccagctgccaatcaggaagactcaccttggatttttgtgaataagaaacaaacttttgtatttggacgatggtatgtttttgattctcttagttagggaattttagcctactctacttcatacatctacttatttgcttccaaaataaatggtgaatgtgatgtaatccacttgctgttgaaacagttgggaaaaacatttattttttattattattattttttgagacagagtctcagtctgtctcccaggctggaatgcagtggtgcaatctcagctcactgcaacctccgcttcctgggttcaagcaattctcctgcctcagtctcccaagtagctgggactacaggtgtgtgccaccacccccggctaattcttgtatttttttaagtagagacaaggtttcgccatattggccaggctggtctcgaacttctgacctcatgatctggctgcctcggcctcccaaagtgctgggattacaggcgtgagccactgcacccagctgggaaaaacctttcgaagtgccaaagagaaaacttctaaattatagcaatgtttttatgacccaagtgcatccttaaaaatctttaagatttatatctaaacataaaaataaatataaacagacaaaagcaactagaataataatgacttctcagacctattacttaccaagggaagaatggaatgtggaataactatgtggctagtactcaatgtggacacagcttaagatctttagcacttacctccattttttcttctaattcatgaagaaattcaccatcggcagctattgatgaaatggcagtggaacttttggcactaagaatggctcgagcaatgtactctagtcgctgctgaagtgaaatttctgtgctagaagggaaaacgcttatttttagttacacaatttcttaaggattgatgatacaaatacgtcaattagtatgtactgtttcataccaaacacacataaaaagccatctgaaacttgaaaaaaaatcattagatttaaaaaaaaatctattttagatttctcataagagagatccacaattttagacaacacataaagaaatacatttatgactaaaaagtaacatcctatttaaaaaatttaggtcagtatattaaaacttagattcttctaaaattaaagaaaactgaatgtaagtacatatagctcagttttgaatcattcttcacaataagaatattatgccatacctatgcatgtcagccagtctggacagtacacgagcagcattactgaaacttctgttcttctcgtaataccgccagagtaaatccatataacgaactctgttttgatcaactttggccattcggactagatgtggctccagaaatggagaagcaacctagaaattatatagttattcagaaaaattttctaaccacctacagataatgttcctgataaggaaaatatagtatttttaagtcaactacaactttgccttgttttatgaaaacaagcaaaattataatccaatactaacagataaaagagagggcaaattttcttattataaacaatttttgttttaccacagttagcataagagtttccaaaacaattctattaggttgataacaataatttagtaggctgggcatggcgactcatgtctgtaatcctcgcactttgggaggccgaggtgggcagatcatgtgagctcaggagtttgagaccagcctgggcaatatatggcaaaacctcgtctctacaaaaaaattagctgggtgtggtggtgcgggcctatagttctagttactcaggagggttaggtgtgaggatcacctgagcctagggaggtcaaggctacagtgagccattatcgtgccattgcactgcacttcagcctaagctacagattgagaccctgcctcaaaaaagaaaaggaaatttggccgggcacagtggttcatgcctgtaatcccagcacttcgggaagctgaggtgggcagatcacctgagctcaggagtttgagaccagcctggccaacatggtaaaaccccgtctctactaaaaagatataaaaattagctgtgcgtggtggcgggtgcctgtaatcccagctacttgggaggctgaagcaggaggattgctggaacccgggaggcggaggttgcagtgagctgagatcatgccactgcactccagcctgggcaacagagccagactccatctcaaaaaaaaaaaaaaaaaaaaaaaagggaaatttactataaaattacaaatttttaaataaactttgataacacagctattgattcctagacattgagctcaaaggcattattgaaattatcaaatgctatgtattcattaaacagattgaggaacactgaaacttagggtaggtaaaaggacatatctgaagtcacagtgacttaacagcagagttaagataagatgacctacaggactcatattcataatccagtgatttctaccccgcaatacaaactatcccaatcagcttcgaattaacaagaaaattggagcagtagcctactttgccccttaggaaaagatactgcattactcagctttatactaacatctaatagcaggcatgggatgagaaactgaattttttacatctatatatgtgcttaaatcattgagttatgctccttaagaataattaacacaactgcaataaaaaaagatttacctgtagcagcttatctgcaaggtcgacttgtattagccaattataaagggcaatactaaagagctcatccttggatcgctgtgacaatttaagcatttgttcaaactaaaataaagaaaatagtaaaaattagcagttaaaggctctgtttctgggcatcacaaccctttagccctataaactccagtaagaaatcaagaatccttacatgataacttctaagaactaccacctttccccaagatgactgtgctaccattaccatggagaacttctaaacagtgtattctcagaatgaaaatatactatgtcccttacatgatgtcctgcttcttcattactcagcatatttggatcagatgacaacactggaggaccaggttttttgggtacactgggagactgaggagcggccttactttgatttaccagttcttgaagtgtgtctgtaatgcatttgtaactgtttaatctgaaagaaaatggaaaaggaacaattacattatttaactagaaagcaaatgatggtaagtgtggtgactcacgcctgtaatgccagccatagggaagtcaaggtaggaggacggcttgaggctgggagttcaagactagccagggcaacagagcgggaccacgtctctacaaaaaatacaaaaaaattggctgggcacagtgcctcacacctgtaatcccagcactctgggagacgaaggcagggggactgccagaggtcacgaatttgagaccagcctggccaacctggtgaaaccccgtatctgacaaaaatacaaaaattagccgggcttggtggtgcatgcctgtagtgccagctattcaggtgagtgaggcacaagaattgcttgaacctgggaggcagaggttgaggtgagctgagatcatgccactgcactccatcctgggtgacagcaagaccctgtctcaaaaaacaaacgaacaaaaaacaaaacaaaacgaaacaaaaaattaaccaggcgtggcggtgtgcacctgtaatcccagctacttgggaggcagaggcaggaggatcgcttgagcctaggaattcaaggctgcaagtgagctattatcatgccactgcactccagctcaggcaacagaatgaggccctgtctcaaaaacaaaaaacaaaaccccccaaaaacaaaacaaaacaaataacaaaaaagaaagccattgatttaccttacctaagtatatacaaggatttcaagactatttggcagaatagatgtacatatttggcatttaaaataatacaaaccatatactttttcaataagtttgagaagtgtttggttaaacattaaaagggtaaagtcattaaatatagtaataaaaaaatatgttttcgccagatgtggtggctgacacctctaatctcagcactttgggaggctgagaagaaaggattgcttgagcccaggagttaaagaccagcctgggcaatatagtgaggccctgtctctacagaaattaaagagaaaaaaaaaattagccgagtgtggtgacatgtgcctgtagtcccagctactcaggaggctgaggtaggaggatcactggatcacttgagcccaaaaggtcaagagtacagtgagctatgatggtgccactgactccagcccaggagacagagtgaagctttgtctcaaaaacaaaaacaaaaacaaaacaaaacaccctccatatatatatgttatagaaaggttatatatttcttctttgttccgagacggagccctgctctgacgcccaggctggagttctgtggtgcaatctcagctcactgcagcctctgcctcccgggttaaagcaattctcctgcctcagcctcccaagttgctgggattacgggtgtgcaccaccacgcctggctaatttttgtattttagtagagacagggtttcactatgatggccaggctggtctcgaactcctgacctcatgatctgcccacctcagcctcccaaagtgctgggattacaggcgtgagccactgtgcctggcctatatttcttttaaggacacacatttcctttttaacagtctcaacaaatttgggaatacttaaaaattatcctttaaaatgaaatcctactggacatggtggctcatgcctgtaatcccagcactttgggtggtcgacctttacacaaagaggccagacacggtggctgatggctataatcctagcactttgcaagactgaggtgggtggatcacttgaggttaggaattcaagaccagcctggccaaaatggtgaaaccctgtctctactaaaaatacaaaaattagccaggcgtggtggtgtgcacctgtaatcccagctacatgggaggctgaggcacgagaatagcttgaacctgggaggcagagattgcagtgagccaagatcacacgactgcactccagcccaggtgacagagcaagactctgtctcaaaaaaaaaaaaaaaacataaaacaaaaaacaaaaaacattatgcaaagaaaagtctgtatccataaagatgacaatctgctaacgtaatggaatgcacctttcttggaaggcctgaagtccaactatgtcttcttctggttctccatgtttatagaaatgaagcccaagaccttgaggatcttttttctctgcagccgtaagagaaagttccaccacaccctcataaaatctcactgatgggaaagaaaagaatgaagacctatgacttactactaagttggatacatttttccttagctggcacatgaaaataatgatcaaggttatgtctctactgtacaatagtcaccctgctaacataaaatatttctgataggtcttcagaaggaaaaggtcttaatatgcctaaaaggcaactgttaaatatatttcttcattgggggccaggtgtggtggctcacgcctgtaatcccagcactttgggaggctgagagggggcagatcacaaggtcaggggttcgagaccagcctgaccaacatggtgaaaccccacctctactaaaaatacaaaaattagctgggcctggtggcatgcgcctgtaatcccagctactcaaaaggctgaggcaggagaatcacttgaactagcgaggcagaggttgtagtgagctgagattgcaccattgcactccagcctgggtgacagaacaagactctgtctcacaaaaaaaaaaagaaaaaggaaaaaaaaaaatatatatatatatatatttcttcattggaaaaaaaagatcctatttcaaataacaaaaaggaaagttttagttccctactggggggaaaaaaataccttgggattcaaaataatacctgtgcaaatagttatggcctttacattatgttagatttgatttaaagtaattttttaaaaagtaagcagattataccttaaaactcaataaaaaattttaaatatctgaaaaataaatgtaatccagaaagcaatgtaaaacatacagtaattgaactggacaagaactgaaactctaatgctaaaaagttatacatttcggctgggcgcagtggctcatgtctgtaatcctagcactttgagaggctgagatgggtggatcacctgaggtcaggagatcgagaccaccctggctaacatggtaaaaccccacctctactaaaaatacaaaaattagctgggcaatggccgggcgcggtggctcacacctgtaatcccagcgctttgggaggctgaggtgggtggatcatgaggtcaggagattgagaccatcctggctaacatggtgaaacccatctctactaaaaatacaaaaaaattagccgggcatggtggcaggcgcctgtagtcccagctacttgggaggctgaggcagaatggcgtgaacctgggaggcagagcttgcagtgagctgagatcgcaccactgcacttcagcctgggtgacagagcaagactctgtctcaaaataaaaaaaataaaaaaataaaaaaataaaaaattagctgggcgtggtggcgtgcgcctgtaataccagctacccgggaggctgaggcaggagaattgctggaacctgggaggcagaggatgcagtgagctgagatcgtgccactgcactccagcctggctgacagagcgagactctcaaaaaaaaaaaaaaaaaaaaaaaaaagtacatttcaaaaaatagaaagaacattacagcttctgcaggtcagtgtagtcatcaaatattgcaacacaatgataccacattcctacgtcctttcactcggcctctgatgctgaaagaagatttgcatctggaaagtggcttttcatcattagcttgcttcattcatacactattgtttgtcttttgagttgagtaaaagatacaagaaacattttatttctcaccttgtctatactgagcacaaacattggaaaggtccacttgattgctaattttttgatattcctttaatgattcccttaacattctttctttttcagtcttattttgaacttgtcgggaacgctggagaagctcatttgcctagaagaggagataacaagaacttaaaaatatataaaatcaagcagacagatgatgctgtcaactaagttttagtctatgtctaaatttatatatggttattaccattaaaatgaaaacaactctacaaacttacttcttaattttaggcagaaaagtttttgaccaaagattcctagctattcttaattcctctcccaaatatgttaagcaagagaacttttgtctggtaattctcttgcctagtcaatacattattgggcagcaggcagtccatgtgacactgatttatttattttttccacctgtaggaaaggatcaataaaaatgcccccattaactctaattcactaaaagatttacttgaagttttagtacttttccttaagctaaggagataaattatcccctaaatttccttaatttctaaatttagtgatttttcttaatttctcacctttggttttttaatatggcctagaaacactatcaaagattctttatgggccaggcgcagaggctcatgtctataatcccaacactttgcaaggctgaggcaggcggaggtcaggagttcaaaaccagcctagacaacatggtgaaatcctgtctctaccaaaaatataaaaaattagccaggtgtgatggtgcacacctgtaatcccagctatttgggaggccgaggcaggagaatcacttgaacctgggaggtggaggttgcagtgagctgagatcgtactcagtcttaaaaaaaaagagagaatattctttatgaaaaacttaaaggagggctgggcatggtggctcacacttataatcccagcactatgggaggctgaggcaggaggatcacttgaagccaagagttcaagaccagcctgtgcaacaaatcagaacttgtctctataaaaaacaaaaaaattggctgggtgtagtggtgcacacccgtagcccctagctacatgagaggcctgcttgagtctaggacttagaagctgctgtgagctatgatcacagcactgcactacagcctaagcaacagagtgaaaccctgtgtcaaataaataaataaaaatatttttaaaaagaaaagctaagcttaaaagagtatacactggttttaagaagccacatattccaacccctttcttagatgaggattctgaggctaggagaggttaagagatctaactgactgaggtcctatattaagtgaaacaagatggttcatcatacatgatacctcttataacaaacaatgaaataggtaataaagtatcataccttagaacaaattgcatcatcagtgctatatagaagtgggcagatatcctgtaaatgtaaactaatgccatcaacagcggcattatctctgatgtagcagttgataagagaagcaattaatgcccctgtgagttctttgtccctgattacaagatctttaaaggtggtgatcttcagctgctcttgaagttcctaggagcataaaacttttctatcacaattatagaaataccatatttctaaacataatgaaattattttaataaattaaaataacctaaatattaatagactctataattgaaaagcgaaaatatactaattagtagaaacaaatttttgcgaacttacataaaatcatagagagttggaaaagaacctacagtagatctagtccaaaactctcactttccaaatgagaaaagtaaagcttaagtagagccaaaactagagtcagatctcctggctttggttataaaatggaaaaaacaatcacttggctatatttgaaaatcttgggcttacatattactccttcctaaacactgttagaattccattattctaggccttataataatattggagtttaatctgtattgtgaacaaatctgcttgtccaaatgaagctctaaagtattgatttatactatagtaaaagattctgttagtgatgtgactgctatctcttttttctaaattcaaggaaatacccaaactgtgttaaaattcttgaacaaatctttaatttgcattcattgagcatgccattggtgatgtaaggaagagagctttgaagatggatcacaaaaacatacccaggataaaaacctacctacaatatatttatcactctataaaactcaaaattattattctacttggtatgaaaaagataagtttcataattaaatatattagcttgaatttttaaaaataaaaaacagtatgtatttaaaagaaacaaaaccaccaacaaaagccacactattcattggacactagtggaaagaatgaggagactgccttccaacgttgaaaaatggtatacgagagtcaaaaagtaagtgtttcagagtaatgaaatatccatacaggacaaggaaaaagaatttttttttttttttttacagaattgcagctagtaactggggaaggaatcacagatttaaaatattatccttttggccgggcatggtggctcatgcctgtaatcccagcactttgggaggccaaggcaggtagatcacctgacgtcaggagttcaacaccagcctggccaacatggcgaaacccggtctcttactaaaactacaaaaatcagccaggcgttgtggcacatgcctgtagtcccagctactcgggaagctgaggcaggagaactgcttgtacccgggaggtggaggttacagtgatctcagattgctccacagcactccagcctgggtgacagaatgagacactgtctcaaaaaaaataaaaaacaaacaaacaaataaataaatattacccttttgtaatcctaaatgaaataataaattccagcaatgattatcaatggatgattaaaatctgatggagaattccacaatggcagtattaggcttactacttgaatccagcaatttatcttagtataactaaaagaaggacaacgaaaccttttgtatcttctaacagtctgatgaataaaccactacctatgaagtattctattcttcctcaaaaaaggacctgaactgaatcaagcctatataataaactttcattttatagaaaatgcaggagatagaggaagaagctcgctacaaagaggattaaaaaaaaaaaagccttagaatgtccttagaatgctggacattctactggatggatgactggatttctacaaggcaacagcaaggaaaagaaaaagaaggaaagactgctttagactgaaacagatgaaagagaaaaacaaattccatgagcaaaccccttaaactgtttagatcctgatttgaatgaaccaatctgtaaaaagacatttttaagacagattttgctatcaaatattgacagttaatattggtaactatccagcctaggagatacggtgaaaccccatctccacaaaaaaatacaaaaattagctaggcgtagtggtgcgtgcctatagtaccagctactcgggaggctaaagtaggagaatcactggagtccagagaggtcaagggtgcagtgagccgtgatcatgccactgcactccagcctgggtgacagagcgagacactgtctcaagaaaaactggtaactgatcatgacattgttgttgttcaaggaactgtctattttttttagaaacacagtatcttgaaaatgctgaatgagtcaaatgtatatgggagttacagtttttgctctacttttgtatacgtttagaaatgctcacaattaaataaaaggtaggaataaatttcctctatatattctatctaacatttagattaatgttgattatccttatccttagaaaggattcaaatgtgaacatcaaaagaaatatgaaccatttatttcctacagtgataaatatcttcctttaaagtaggagcagttgccgggcatggtgggtcacgtctgtaatcctagcattttgggtggctgaggcgggtggattacctgagctcaggagttcgagatcaccctgggcaacacggtgaaaccccgtctctactaaaatacaaaaaattagctgggcgtggtggcatgcacctgtaatcccagctactcaggaggctgaggcaggagaattgctagaacccgggaggtggaggttgcagcgagccgagattgcacaactgcagcctgggcgacagagtgagactccatctcttaaaaaaaaaaaaaagaaaacataaaatgaagtaggagtggtgtatatgtgtgtgtgtgtgtgtgtgtgtgtgtgtgtgagagagacagagagagacagggtctcactctgtcacccaggctggggtgcagtggcaccatcatggctaagtggcgcctcaacctcccaggctcaagtgctcctcccacttcagcctcccaagtagctgggactacaggcatgtgccaccacacttgactaatttattttttatttttagtagagatgggtcctgacatcttgcccaggatagtcttgaattcctaggctcaagtgatcctcctgcctcagcctaccaaagtgttgggatcacaggcgtgaggcatggtgcccagtcaagagtatttaatttaggttgttgggccctttgaaattataagcaaaagtctgtgtgtccatgtcgatatgcatttctttaagggtagtgagagatagcttttatcagattctcagaagaacctgtagctcaaataaagggtaaagtccactgttttaaaaaatatgttttgtaaagtatgacttcattcacatacccacaagtaaaaacttgcggctttgaaaaaataggtcccccaagttggtacgctttttttgtgccatcttcccataacatactaacttcatcataacttaaatgcttcccaaaataatcccctccaaagccaaaatactcatccaaaaaatccaaacatagtattaatggtataatcataaaaaaataaaaaaaattaccttctgaagttctgccacaatgatagtgaattgatgttcacaaagaagtttccataaagccagagcctgatatgattttcgaaccaactgctgaattgcctgaagtgaaatcttttcacttagttgagcctctaatgagaaaacaaaataaattattataaaataacataggttaagttgctttatttcaaataaaaactgtagttaaggttgaaatccctgttgttttcttcctagcccccattacaggcaaccatgataatcagtagtatttatgttattatcttctccgtgtgtgtatatatatatgcttctgtgtttgtgtaggtacacataaaccatgaaaatattgctgtgtggctgggcgcggtggctcacgcctgtaatcccagcactttgggaggccgaggcaggtggatcatgaggtcaggagatcgagaccgtcctggctaacacggtaaaactcggtctctactaaaaacataaaaaattagctggtgggggggatggcgggtgcctgtagtcccagctacttgggaggctgaggcaggagaatggcgtgaacccaggaggcggagcctgggcgacagagcaagactccatctccaaaaaaataaaagagagacaaaaaatttaaaagatagtaaaaaagaatttacaaaatgatgaatagaaacctagggtcctcagtagggaagaaagtaacttgggacaaaagtaaatggttgagtgttaactgagaaagttctactggccaggcgtggtggctcacgcaagtaatcccagcactttgggaggccgagttgggcggatcacctgaggtcatgagttcaagaccggcctggccaaagtggcaaaacctcatctctactgaaaacacaaaaactagatgggtgtggtggcacacgcctgtgatcccagctacttgagaggctgaggcaggagaatcgcttggacctgggaggtagaggttgcagtaagccaagattgtgccaatgcactccagcctcggcgaaaaagcgagactccatctcaaaacaaacaaaccagaaagttctatcacggccagaaaaagtaactctaaccctaacaatggaaggcaaaagaacttagaaaaaattaaatggcacaaaaagttcatgcaataacttattattgttctaacttgtatctggaataactgaagattatgagaacttttcagttgccttgctctttccttacttgttactacttataattgataaaaagcacaatgaaatatttgattcatatttttagctctataaaaaggcatattactaatcattagggaaatgcaaatcaaaatcccaatgagatgccattccatgttcattaggatggctatatataaaaggacagaaaaatgacaaatgttggcaaagatgtgaagaaattggaacccttgtgcattgctactagaagtataaaatgctgtggctggccaggcgcagtggctcacgcctgtaatcctaccactttgggaggccgaagtgggtggatcacctgaggtcaggagttcaagaccagcctggccaacatggtgaaaccccaactatactaaaaataaaaaaattagctgggtgtggtgacacatgcctgtaaccacagctactcgggaggctgaggcagaattgcttgaacctgggaggtggaggctgcagtgagctgagatcgcaccattgcactccagcctgggagacaagagtgaaactccgtctcaaaaagaaataaagataaacataaacataaaatgcagtagctgctatgaaacagtatggcagttcatcaaaaaaattagtaatagaattaccatatgatatagcaattccacttctgggtatatacccaaaagaactgaaagcagaggctttaatttgtatttgttcacccatgttaatagcagcattattcacgatagccaaaaaacggaagtaactcagtgtccatcaacagatgaatggataaaggaaatgtggtatatgtgcacatatgcacatatacacaatagaaattactcagtcttaaaaaggaaggaaattctgacacgttacaacatggatgaacctcgaggacagtatgctaagtgacataagcctgccacaaaatgtaaaatttgatttcatcctaatagggtacccagagttgtaaaattcaagagacagaaagtagaatggtggttgccagggacctaggataggggaaaaaaatggggggttattatttcatgggtacagagtgacttttggtgtttattttttttaagacagagtcttgctcttgttgcccaggctagggtgcaatggcacaaattcggctcactgcaacctccgcctgctgggttcaagtgattctcttgcctcggcctcccgagcagctgggattacaggtgcccgccaccacgcctggctaatttttgtatttttggtagagatggggtttcaacatgttggccaggctggtcttgaactcctgacctcaggtgatccacctgccatggcctcccaaagtgctgggattacaggtgagagccactgcgcccagcccagagtgacatttttggggaagatgacaaaagttctggagatagatgctggtaatgggtacataaaatgaatatactgaatgccactgaactgtacacttaaaaacagtaaaaacgggccaggcgcagtggctcttgcctgtaatcccagcactttgggaggctgaggtgggcggatcatgaggtcaggagattgagatcatcctgcttaaacacggtgaaaccctgtctctactaaaaatacaaaaaaaaaaaattagccaggtgtggtggcgggcgcctgtagtcccagctactcagaaggctgaggcaggagaatggagtgaacccgggaggtggagcttgcagtgagccgagatcatgccactgcactccagcctgggcgacagagtgagactctgtctcaaaaaaataaataaataaataaaataaagtaaaaatggggctgggcacggtggctcacatctgtaatcccagcactttgggaggccgaggcggacgggatcacctgaggttggaagttcgagaccagcctgaccaacataaagaaccccgtctcttctgaaaatacaaaattagccgggcgtggtggcacatgcctctaatcccagctactcgggaggctgaggcagaagaatttcttgaacccaggaggcagaggttgcagtgagccaagatcacgccattgcactccagcctgggaaacaagagtgaaactctgtctcagaaacataaacaaataaaaagtaaaaatggtaaattttatggtatatatatatttcaccacaataaaaaaaacataatgaaataggtgtgtatcatgttttctggtggaggaaggaacaaaaatgtatatgctaaaagagatagggaaatatacaatatccatattaatatccatattatcctactttcccaatcacactttttttttttttttttgaggcaggttctcactctgtcacccaggctggagtgcagtggcatgatctcagctcactgcaacctctgcctcccaggaagaggtgatcctcccaactcagccttccaaagtgctggtattacaggtgtgagccaccaccccggacccaattacactgatattttaattacaaatatttgtgtacaaagtacatcttactaagaaagtccattgttttctattcaagtaataaaattttactgaggtcatgtacgcttaactgatgagaagcaataatttaccatgaaacttcctctgcagttcctgttgcatttgctggggatttccgttttcaggacgcatgaatcctatcagcctctgctgcactttagcagtagtactgaaacagaaattgcagaatgtgtgtgtttataacagctttattgagatataacacatacagtacaattcaaacatttaatatgtttactttttttaaataattcagaaggttgggcaaccaacaccagaagggctgatggccagaaaaaatttatgacacagactaaacagatgctacttaaaatgactgagattaaatcaattaaatgactgagaacatcagctataaattttcctaacctgtagaaaaaaaaagatcaagtaaaaagagggggtaaaggagagaaaggaaggaaggaaattacggaagagaagaaacaagctagatacaaaagagttaatatgattctccaaagagaatgggacagaagaaacatagattgagtatccctaataaaaaaaaaaactaacatctgaaatgtccccaaatctgaaacgttttgcacatcagcatgatgctcaaaggaaatgcgcactggagcaatttcgatttcaaattttcggaatggggtgctcaacctaagtataatgcaaatatttaaaaatcaaaaaaaacgtgaaagccaaaacacttctggttccaaacagttcggataagggatattcaatgtgtatcacaatacataaaaaacgagagaagaaaactgatcaaagccaagacgttcattcttaaggctcactgagagctgtaaagaagatatacctaaagacatcatgtgacttttgaatttcggtaacaaaaagaaaaaaacacaaaaaaatttcaaagtaaacactaagtcacttacaaaggaaggagaatcatacagataatgtactttttcatctacaacattaaactttgggaagaaaatggtgcaaaatgtatacgaagatctgagaaatggtctatgatcttaaaatcccacattcattgggcaataaaaacgaacaaagcatgaatacatcctaccacataaatctcaaacatgagcccccaaaacacactaagtgaaagaagccagactcaaagaccacacagtatgattctgtttatatgacatgtcaagaataggcacatctacagagatagagcagatcagtaagtgtctggggctaagaagtgggaatggaaagtgactgctaatggacatgaggtatgtctcctagataatggaagtgtgctaaaactggactgtggtgatggttgcacaattctatgaatttactaaaagtcactgaactgaacattcaaaatgagtaaatttagtggtatgtaaagtagatctcaaaaatctgtttaaaaaatttccatagtcaatgaaactaatgttataggaatccaagggttggtcgaaattaggacatgtattaactctattgttaaaggtaagggggaaaatgatatgatcatctctgtaaaatgcagtaaatacatttgacaaactcacttattgaatatggtaagcatattcaatatgttaaatatatgaatatgttaaacatattcaataagggctgagtgcggatggctcatgcctaaaatcccagcattttttgaggccaagacaggaggatcacctaagcccaggagtgcaagatcaacgtgggcaaaacagtgagaacttgtctctacaaaatgtgaaataaaaaaattagctgagcatggtagcatgtgcctgtagtcccaactactcaggaggctgaggtgggaggatcacttgaagctgggaggtcaaagttgcggtgagccgtgatcatgccactgcactccggcctgggcaacagagtgagaccagtctcaaaaaagaaaaccaaaaaacacctcaagtaagggtggatgcagtgggtcatgcctgtaatcccagcactttgggaagctaaggagggagcataacttgaggccaagagttttagaccagcctgggcaacacagtgagaccctatctctgagaaaaataagaaaaaatcagccaggtgtggcagcacatgcctgtagccccagctactcaggcggctgagtctgagattgcagggaataatgatcacatcactgcactccagcctcaatgacagagcaagattgcctaaaaaagaaaaaaaaagagaaaagacagacagagataagtggcagggcgcagcggctcatgcctgtaatcccagcactttgggaggctgaggcgggtggataacctgaggttgggagattgagaccagcctgaccaacaaggagaaaccccgtctctactaaaaatacaaaattagctgggcgtggtggctcatgcctgtaatcccagctactcaggaggctgaggcaggagcatcgcttgaacccgggaggcggaggttgcggtgagccgaggatcatgccatcgcactccagcctaggtaataagagtgaaactctgtctcaattaaaaagaaaaagagagagagagagattaccttgtgcagagaggagaaagcaagtagagctagacaagaaaagatggaaaagatgaaactatctctgtttgcagatgacagaactgcttctgtgacaattcaagaaacatcaatgaaaaaaacatcctgctaaaaactgtaaagataaatgagtaattaagagaaattagaagtagattagaaaatttacatataattgcagatgtaatggtaaaattcaattaacaaaagaccataatgttagaaaaaaaaccaaacaaactaaaaacatctgacaagtaaaattccagataatttggagggagagggatggcagtagaaggcaaggaaacaaaatgtaatagagtttgttaaattattaatgctgactgagatgcatgtctgtcagaatttaagactaacagaggaagaaaaatcatatgtagaacttcttaattggtgtttaaggtagagagaggcctgatcaatccaatacaataaggaaatgggaaagggaagaaaataaacaaaaagcacaaattcaggatggggagaaaaaaatcaaacatttaactagaccagatgcagtggctcactcctgtaatcccagaactttgggaggctgaaggtggattatctgaggtcaagagttcaagatcagccttgccaacatggcaaaaccctgtctctgctacaaatagaaaaattagccaggcatggtggtgtggggctgtagtctcagctacttggaagggtgaggcaggagaatcgcttgagccagggagttggaggttgcagtgagctgagattgcaccactgcattgcagcctgggcgacaaagcaagactctgtctccaaaaaaaccaaaccaaaacaataaaccacatttaactaattccaataaaatgggaaggaggtaaattctcctgcttaaaagataaagacaggccaggcgcggtggctcacccctgtaatcccagcactttgggaggctgaggcgggcggagcacgaagtcaagagatcgagaccatcctgggcaacatggtgaaaccccatctctactaaaaatacaaaaattagccaggcttggtggcacatgcatgtaatcccagctactcgggaggctgaggcagaagaactgcttgagcccaggaggcagaggttgcagtgagctgagattgcaccactgcactccagcctgggcaacagagcaagactctgcctcggcaggggcaggggaatatatatatatatgtatacacacacacacacaaagtatgaataatgttatataaaagtgtacttacttagactctgtttttgcttttaaagaagtgtatatttatgtatgctttattatttatttatgatatttttttttgagacagagtttcactcttgttgcccaggctggagtgcaatggcacgatctgggctcaccgcaacctccgcctcccaggtttaagtgattcgcctgcctcagcctagctagtagctgggattacaggcatgtgccaccacacctggctagttttgtatttttagtagagacgggtttttccatgttggtcaggctggtcttgaaatcccgacctcaggtgatccgcctgcctcagcctcccaaagtactgggattacaggcatcagccatcacgcccggcctatttatgtgtttttgtagtgacaaggtctcctatattgcccaggctggtctcgaactcctggcttcaagcaatcctcctgccttggctttccaaagtgttgggattataggtgtgagccactctgcctggcctacatatgctttaaaaagattatactgtaatacctcgttaacaattctaaggagtgatgtgactcccccaatgccatgtgattattatttttcaacaaaaagtccgtattatattagaggcttaaaaatatccattcttggctgggcgcggtggctcacgcctgtaatctcagcactttgggaggccgaggcgggcggatcacgaggtcaggagatcgagaccatcctggctaacacggtgaaacccagtctctactaaaaatacaaagaattagctgggtgtggtggcaagcgcctgtagtcccagctactcgggaggctgaggcaggagaatggcatgaacccgggaggcggaggttgcagtgagctgagaccgcaccactgcactccaggctgggcgacagagcgagactctgtctcaaaaaaaaaaaaaaaatccattattgctgggcatggtggatcacctgaaggtggtcaggagtttgagaccagcctggccaacatagtgaaactccatttctactacaaatagaaaaattagctgggcatggtggcaggcgcctgtaaccccagctactcaggaggctgaggcaggagaatcgcttgaacctaggaggtggaggttgcagtgagccgagattgcaccattgcactccagcctgggcgacaagagcgaaactccgtctcaaaaaaaaaacccaaatgtccactcttggtcgggcatggtggctcacgcctgtaatcccagaactttgggaggctgaggccagtggatgatgaggtcaggagttcaagaccagcctggtcaacatggtgaaaccccgtctccgctgaaaatacaaagaagaattagctgggcatggtggtgcacatctgtaatctaagctacttgggaggctgaggcaggagaattgcttgaacctgggaggcggaggttgctgtgagccaagttggagccttcgtactccagcacgggtgacagagcaagagtccgtctaaacacatgtccacacaaaaacttgtacaggaatgctcatatcagcattcttattagccaaaaagctgaaacaacccaaatatctatcaactgataaactgagaaatgagacaagtagtaatacatgctacaacaatcaaaccttgaaaacatgcttggggaaagaaacagacaccaaaggttatctgttgcatacttccatttatataaatatttctataaagattccatgtatataaatatgtctataaatattccattcatataaatatttctatattccatttatataactatatttctataaatattccatttatataactatatttctataaacattccatttacatatattcatataatatatttatatattgtgtatcttatgtaatatataaaatataatatttatataaatagtcagaaaaggcagatctgtggagacagaaagtagattagtggttgccagggactgggggaaggtccatgaataataatggctggtcatgggcacaagagtttcttattgctgtgatgaaaatgttctaaaattagatagtggtgatggttgcataaccttgtagatacactaaaaaatactaaactgcacactttaaaaggaccaactttgtagtatgtaaatcatctcaacaaaaaatacaacgaaaagaaaaagatgaattaataaaccctatttattcttactttggatttcctaatggtcctcctgcaaactgggagtttctgtctagaaattcctgcaaaccctttagttcttgtagcactgactctagcagttggcagggaacactactttcaatctgtaaaaatgaaagatttttcaaaagtttaaaaacacaccctctgtatagctataatataaacaattttaattttgaaatgagtatctctatagttatttcttgtatcaattcacacctgttgatccgaataaagtatacctacacacttcctctcctgccagtaacactgatgcataactaacatacaataaaatacaaatactaagaaaacatcttgattacttttatatatttttgtatagtcatcacccagaccacaatacagaaatttccaacaccaaagaaagtttcctatgttcctttgtagccattagtcatcccacctctgaggtaactacttttcttactcctatcaacatagattaattttacaagtttttagacttccatatatatatatggaatcatatactgtgttaggcaaatacactcttattcttagaaacttgaacttttttttttttgagagacagcgtcttgttgttgcctgggagtgtagtggcgcggatcatatcttactgcagccttgacttcctaagttcaagtgaccctccttcccaattagctggaagtaccagcacatgccaccacatatctgactaattttaatcttattttattttatagaaaaggcatctggccgcgttgccctggctggtcctgaactcctgggctcaagccttccaaagcattgtggttacaggcacgggccactgtgcccaactcatgaactttaagagcctcacaattaaaaatatatttggactgggcgtggtggctcacgcctgtattctcagtggaggccgaggtgggcggatcatttgaggtcaggagttcgagaccagcctggctaacatagtaaaacactgtttctactaaaaatacaaaaaatcagctgggcatggtggcgcgcacctgtaatcccagctactcgtgaggctgtggcagaagaatcgcttgaacccaggaggcaggggttacgatgggccgagataatgccattgcacaccagcttgggcaacaagagtgaaactgtgccactgcactccagcttgggcaacaagagcaaaaagcagtctgtaaagtatgccaattcatagaaattagtgctgggtccatggagttttcgttcatatatatgtcaaagtattacatagtaaaatttgagcaatattaagttgcttgagttatccctcatgacaaccttatgagggagatatactacgccccttcttttaccatgaggtatcaggctctgaaatgttaagtaatttactcatattcagacagttaatcaatgttagagatgagatttaaacctgaaggtaagcagtttgttgtccaagaatgcaaacatatacataaaagaataacccgccaggcgctgaggccccctgcctgtaatcttagcactttgggaagccaaggcaggtggtttgcttgagtctaggagtttgagactggcctgggcaacatggtgaaaccctatctctacaaaaactacaaaaattagccaggcatggtggcgcacacctgtaatcccaggtactcaggaggctgaggtgggaggatcgcttgaccccagagggcagaggttgcagtaagctgagactgggccactgcactccagcctgggagacagagcaggactctgtctcaaaaaaaaaaaaaaaaaaaaaaataacctttgccatcttatttgtgtaatatcaggaaatgtgaaacaatctaaccatttataccatcaactggctacacaaaaataacaaaataatattatacacacttactgcagtgatctctctgttgccactcttgaatattctctccacaactaagcttgcatcccaaatgtttctggaaaaaaaaaagttttaatgattgtgctgtaaatgaataaaaacaattacaataaatttctttctctaggaacttaatggctttattcagtttttaaaacttgcagtggtttcatttaacattttactaagctatctagaagagtggaatactagaaaattttcatacctgatgtacctaagtttttcagataatgaaatattactgaagaaaaatcaaaaggctctgtataataaattgtaaacaggaaatttataaaggggctctgtactgtttcatacttttaagcaaatgagatgaatgaaatcatacatctcaaatctaagagaaatatatattaggcatgatagctaactaagataacatgatagactgattgcaaaaacaaccacatttctttatccctccctatatctatcccctctgcagtatgatttgatgtctctcccctaaaaggtggtctatttcccaccttttaaatctgagttggccctgtgacttccctctggccaagtgaataaggcggaaaagtgcatggtaagccagttctgagtttagaataaaggttttgcaagtgtctactctttctcaaggaactctgccaccaccaactaaataatctttggctggcctgctgggggatgagaaaccatgtagagaacaaccaagctgtttcatcttgggccattctagaccagctggaaaatataaccttgaacatgtgagagtctagccaagataagcatagctctctttaacttcacaactgattgcctattcttgagttagcccagcaagacaagaactgccctgttgaactgtagacacatgtcactgagttatggggaagtttgtaacactgtacattcatatgtaagtagatatacagttgacctttgaacaatatgggcttgaattgtgtgggtccacttatacacagatttttttcccacctatgctaccccagcacatcaaaaccaacccttcctcttcctactcctcagcctactcagcgtgaagacaaggatgaagacttttatgatgatccattgccacttaatgaatagtaaatatattttctcttccttatgattttcttaattttttttctctagcttactttatggtaagaatatagtgtataacacatataacacaaaatatcagtgttacggctgttttagaatttgtctagcaggttttctggtttttacgagactcccccatactcctacaccatgcaaaagttaaaaaaagaaaacacaaaaaacatacaaaacgtgttaattgattacttatcagtgaggcttctagacagtaggctattagtaattaagaaagtcaaaagttgtacatgaatttttgactacatgaaggttgaggaatggtggttggcatcccctaacccctgtgttaaggaacaactgtattttgatgctacaaaaatagattatgagagagtaagagaaataaaacacagcaatgaatatagttagataacaaaaactggaataatagaaaagttttattgatcaacaagtgagctaaaactaaaatttaataggaataaatgatgtcccaaattcagagttaaaaatatttaactactcaagatgggacaaggtgagcaataattcattatttcatgacaaacttaccccatgatccgagaaaagtaaatgcaaataccattgtgttttccagagtacacaatctctggtccagtcacacaactcatatttgtggcctgagttgctgggtttcccagagcacacactggagttgacatggcaggaggctgtataccttgtacacacataagaaaaacaaatctcttaatcttaatcttagaacccataaatctcttaatcttaatcttagaacccataaatctcttaatcttagaacccataaaattcagaattctcataacccaagtttgtgtatctagacacaaaggtatttacaaaaacaatgaaatacatagatatttaacttggttttccttaataagaagagagatttaaatgtggatgggtactcccagatagacttgcaagtgttcacaatgcagaatgaaaaggaaacaaacttgccagtactgcttgtaatgctgacagtgaaatagaactgattacacagattttagggttcaatttaatcctggtagccaaataatgggctttccaggcttattataagaggagttcctcctaaataaaggcattcacatccaaatgccaaaacttgcttggacagcgcttctaaaattatatttattttcaagggaataaggcaagttcatctttttcacactaagcattaaggttaactcataatgttagcacttcaaaatgaatccaatccaaaacaaagaaaagaggtaccatgagacggtgttcccaaaaaggatggatttggatagggactaccactaggaacaggagaacctaaaaagggaaagaagaatataaagatttagaaaagaacatctcaatcttttgaatgtgatcaaaattaggtaaagaaggtatttcctttttctttttttgaggcagggtctctttctgtggcccaggctggagtgcagtggcatgatctcggctcactgcaacctctgtctcccgggttcaagcgattctcccgtctcagcctcctgagtagctgggattacaggctcacaccaccacaggccggctactttttgtacttttagtagagacatggtttcaccatattggtcaggctagtctcaaactcccaacctcaggtgatctgcccgcctcggcctcccaaagtcctgggattacaggtgtgagccattgtgcctggccacagaagctatttctaagcataaggagttacattgtccacgatatatgcaagaattagggactgatctcctagtaagtttctaacaactcccaccttggaaaacactgatgtgcgagttaattattaaatcattcatctgtttccctctgaatatataccaaatgagttatgtaaatatgattggttacatcttattttgcttccttacattaaggattcaatattaatagatcacttttaagaatcagaatctatagatgtattcatcaattatacaatagcagtaaataaaacataatgaaaaggcttattgataaaaattgctataaaggttctaagattcaaacgattagaaacaatttcatttcaatgttccatactcactagaatagacaggagaccccaagatgggaccaacattacttggaggcggaagagtggttggaaatctcatctgtgcttcaccaccatacctatttttatgacaagaggttgagtttattcagtaaaacaaaccatccatcttaaaaactggaattgttccttttcctgtttagcttccaagtaaatgctttaaacattagagacttcaatgtattgtgctgacagtaaagtatatgcataagacttataataaatatttattcagtaaatgtggacttgaaactgctaccaggaagaattataagggactctgataacttctaagaaaaagatatgcaatgcatagaatttactttgtgagtaaatggcattgtaattttcatactaggttatggttagatagtacttcaaaaaacgtttctaacaaaatcacatttcaaattcttaaatattttctaaatagaaatatctctttggtaccaagtttccttaaagtaattcagaagccttcaatactaatgatacatattaagcagaattggcatagtgtttggggaagtaaaaaagatagatgagacagtaactgaggtagaacaaagtgtagaaagtagacaagaagttacagaacagaatccagagttaaagtaataatgcataaactatgctaatttacttgcttctattaccattataatctctccagatttcacccttttgcaaatgaattttggtaatttgcctacatagtcactcaactgtttggcaaggctttatcacattgataaaatcattttaaaaagtggcccagtaaaaaaacaaataaataaacaagaaaaactttcacatacctaaagaaagcccgagtagcccaggcagatacttctctatcacaggcagcagtggagcaagcaagaataaggcaagttgcacaagcctggtcttcctgtgtaaaaagaggaatattggccttatattaaatacaaattttaaaatgatttgtgtactgctagatgcagtattaaagtctgtatctagcacagagcaggcattcaataaatacttgctgactgaatgaaatcagttagtgttaaaaagacaagtaaacactactggttttaagttcatcataagcactaggattacaggatgttctcttttccttttaacctagattctgacttagtttccggcttatgtctccaattttcttcctgtggtctttctgctttctagaaaataacaattaagtggtaacactgaatacctaccatgtgtcaggtactattttaagagtttagcatatattaatcctcataccacatcctattataatgtataaggaaactgaagcccagagaagtcaagtaatttacctcagtggtggagctgggatttttaacacaggtgctttgaatccagagtctgtatacttaactttgaactactcccaattttaaccgtatcaattccagttgtggctctgaaatactaagatctctacactgttgcctcaggtttcttcctcaggtcattaagccaaaacaaacaaacaaacaaacaaacaaaccaaaaacaacttgtccctaaatgtcttgtgcttttaatgaaaaggcatttatcatataacctgaacaagaaactcttactagcagacttcaataagaatttatcaacaacaggccaggcatggtggctcacgcctgtaatcccagcactttggcaggccgaggcgggtggatcatgaggtcaggagatcgagaccatcctggctaacatgatgaaaccccatctctactaaaaatacaaaaaattagccaggcgtggtgggggggtcctgtagtcccagctacttgggaggctgaggcaggagaatggaatgaacctgggaggtggagcttagagtgagccgagatcacgccactgcactctagcctgggcgacagagcgagactctgtctcaaaaaaaaaaaagaatttatcaacaacagagaataaaaatctgaaagctcactacaagactcatattaatcctgctttcaaatgtcagttcacatacagtgacttaggcaaagaaaggaatattgttaagattatctatttatggctgggcttggtggctcacggcctgtaatcccagcactttaggaggccgaggtgggcggatcacctgaggtcgggagttcgagaccagcctgaccaacatggagaaactctgtctctactaaaaatacaaaattagttgggagtgctggcacatgcctgtaatcccagctactggggaggctgaggcagaacaatcatttgaacctgagaggcagaggttgcagtgagccaagattgcgccattgcactcctgcctgggcaacaagagcgaaactccatctcaaaatatatatatatatttattacagtattccagtcccaatttacataaactatgactcccactgtttgtttaaaatagcatcacattttttaaaagtatatataattacctgatgtaatttaaagaatctttcaatctcttctccatctcctcccacattactcacaagtagatgcctcagttgatctacaggtctaagtttatgaaacataaggctcccctaagaaatttgaagaaagaacatgaacaagagatttaccaagattggctgatagcaactgactctaccttatttgataaaataaatgaaacaaacaaaaaaaaccattcaacaatacaaagtaggctgggtatggtggcccacatttgtatttccagcacatcacggggctgaggcaggaggaatggctgaggtgatataaaaagtacaactggtcaaaaagatcatctacttctctactcaacctccagtagatctatatatctataaagaaaacttaatgcaattgccccggcaaagctgccccttaaaccagagaattaaagttagattattaattaatcatgttgctactatttatatcaatttaggcaaaaaaaaaaaaaaaaaaagctagaaacatagtcataccttataccagagtaaattccaaatagatcaaaagacttaaaggacaaaataaaactatcataatattacgttggtacaaaagcaattgaggtttctgccattacagctttttttttttttttttttttttttttagacggagtctcgtactgtctcccaggctggagtgcagtggcgcaatctcggctcactgcaagctccgcctcccgggttcatgccattctcctgtctcagcctcccgagtagctgtgactacaggcgcccaccaccatgcccggctaaatttttttatatttttagtaaagacggggtttcactgtgttagccaggatggtgtttttgccattacaatcaatggcaaaaacctcaattgtttttgcaccaatcaataaacaaaagcaactaagagtggattcttttataaaccttagtgagtggaagcttttcaactatgacatatttcaaatgatggctgggcagattggctctcgcctgtaatctcagcactgtgggaggatgaggtgggtggatagcttgagctcaagagtttgagacgagcctgggctttagtgagatcctgtctctacagaaaatacaaaaattaactgggtgtggtggcaaacgcctgtattcccagctactcaggaggctgatgtgggaggatcccttgagcctgggaggcagaggttgccgtaagccaagactgtgcaccacactccagcctgggtgacagattaagaccttgtctaaaataaaataaaataaataaaataaaatatcaactgataactgataattttgactaattataagcttgtgtgcctgggaaaaatctcaataaacaaagtcaaataagaaaccaggaaggctgggtgcaatggctcacacctgtaatcccagaactttgggaggccgaggcaggcggaccacctgagatcaggagttcaagaccagcctggccaacatggtgaaaccccatctctactaaaaatacaaaaattagccaggtgtggtggtgtgcgcctgtaatcccagctactcaggaggctgtggcaggagaattgcttgatctggggaggcagaggttgcagtgagctgagatcacaccactgcactccagcctgggtgatgagcgagactccgtctcaaaaaaaaaagaaagaaaattattcaattaagccactacttcagagaacttgacaaaaatattatacatcgcttatttttgtcactaccataacagaatacgtacacacctgtgctgagaggagaacaaatttcttcggaggtaacatgtgctgctgtacaacaactggtgaatcagttattggaatatgatccttgtttaaaggtgtaattattttatctactttcaattcatctatcgcagaaagagcccaggaatgaccatcaacaccagctgtcatctatgtaaaagaaataaatgttttatacatcatattgaagttacataatgcaaaagaaaaaactacagacttaataaagaagtaaatttaataaatagtacattaacatgaatatttttgaaagtattatgtaattttctactatcttttttttaaatcaggtattttctgggtttttgttttttgttttttttttgagacgaagttgtctaggctggagtgtagtggagtgatcttggctcactgtaacctttgcctcccgggttcaagtgattctcctgcctcagcctccctagtagctgggattacagccatatgtcaccacgcccagctaattttttatttttagtggggacggggtttctccatgttggtcaggctggtcttgaactctcgacctcaggtgatccgcccacctcggcctcccaaagcgctgggattacaggcatgagccaccacacctggcctctggggttttttttttttgagacagcatcttactctgtcacctaagctggagtgcgctggcacgatcacaactcactgcaacctcgacctccctgggttcagttgattctcccacctcaacctcccaagtagctgggactacaggagaatgctaccacggccgcctaatttttctatgttttgtatgaacagggttttaccatgttgcccaggatgttctcgaactcctgggctcatgcagtctgcccatcttggcctctcaaagtgctaatcaggcattaccttttttttttttctgaggcagagtctcaccctgttgccaaggctggagtgcagtggcctaatcagagcccactgtaacgtctgcttcccaggttcatgcaattctcctgcctcagccttccgagtatctgggattagagacgcacaccaccatacccggctaatttttgtattgttattagagactggcttttgccatgttggccaggctggtctcaaactcctgacctcaggtgatctgcctgccttggcctctttccaaagtgctaggattacaggcgtgagccaccatgcccagccataagcaggcattttctatactaatacataaatctttttgtactagaggacaagggcaaacttttctcaagataaactataaatactctttaataaaattataattctcttaaccaagtaactaccttctaccatctttccaggatcaactaaatctgctaagatactatctttcctttaaaaagtattttactggctcggcgaggtggctcacgcctataatcccagcactttgggaggtggaggcgggcggtacccgaggtcaggagttcgagaccagccaggccaatgtggtgaaaccctgtctctactaaaaatagaaaaattagccgggtgtggtggcacacgcctgtaatcccagctactctggatgctgaggcaggagaactgcttgagcccgggagatggaggttgcagtgagccgagattgtgccactgcactccagcctggacgacagaacaagactctgtcacaaaaaaaaaaaaaaaaaagtattttaccagcctaggcaatataatgaagtcccatctctacaaaaaataaaaaaccacctcggtgtggtggcgtgtgcctgtattcccagcaactcagaaggctgaggtaggaggattgcttgaacccaggagtttgaggctatagtgagctatctatgccactgcactccactccaggcaacagagcaaaaccctgtctcagaaaaaaaaaaaaaaaaagtattttaatcttctaaaatactttataataaaaaaattcaagcagccaaaaatgttgaatatacagtaaaagtccacatgcccaatacctagactcaacaattgttagcagttcgccatatctgcattctctctctttctgtatatttgttttattgtactatttgaaagtatagacatcatttatcactcttaaatacttttgcacatatctcctaaaaataagaatgttttcttacaaaccatataataacatttaaaaatgttattggctggacgacacggcttacacctgtaatcccaacacattgggagaccaaggcaggtggatcccttaagcttaggaattcgagaccagcaggggctacatggcaaaaccctgtctctactaaaaatacaaaaaaattagacaagagtggtggcatgtgcctgtagtcccagctacatggcggggagggggtggcgggtgctgaggtaggaggatcccctgagcctgggaggcagttgcagtgagctctgattgtgccactgtactccagcctgggcaacagagtgaaaccttgtctcaaaaaaaaaagttatcaattccctaatataatttaacacctaaccaatataaaatttacccagctgttctaatgtcttttatgactatttttgataactaggatttgatcaaagctcatacactatacttgatgagtttttttgttaaaaacaaaagtccacctttgtttgagaaaaactcaaatattaaatcaaattatatgacatgcagcatttgttctaaaaaaaaagttaggtggaggacagtgtctcacacctgtaatcccagcagtttgggaagccaaggtgggaggatcgcttgagcccaggagttcaagactagtctgggcaatatagtcagaccctgtcgctacaaaaaatttaaaaatcggctgtacgtggtaatgcacacctgtagtcccagccacttgggaggctgaggtgggaggactgcttgggcctgggcaacagggtgagatgctgtcttttaaaagagtaaagaaaaaaaaaaagttaacatttatggaatggtgcttcctatgagtgccaggcattgttctgagtgctttacacacatgagctcatttagtctcacaactccatcgtagtaggtacgattataactattatagaggaagaaacagagagccaaaagcatgtcctccactcccccaacacagcatcccaaccaggacagggtttatatcttattaagttctgaatcctcatagtttatcacagcactaggctggtagtacaaagaataaaggaaagaaggcactccttacctccttatcttcctcctgctcctaccccagctctttgaaccttgtcagaaatttggtagagctcaggcagacaatactcccatccctgggagttcagtttttactcctcccacttacacacacctttttccagtcccatctggaagggttcaaatttaagaaccaccaaagaaccactagttttcagtgaaaactagaagcaaaatgcctgtgaagaggtagctctaaagacagagtaccagacattcacaccccactaggggctggtttatctggtttgatcagcagcctctgtgggctatgcaggactattcaggaggacaggcaggagtgagcagaggacaccaaggggatggagacaggtagcctcccctcacctccttatacactggggactaggatgggcagctgggggcaggggcagttcgtgggttcatagcagcctcggtcctcacccaggaagaccatatccacttcatgatgtatgtggtgatttttgtgtttaaatcaaaactgtgtgtttgtgggtgtctctttgtttatgtgggaaagaaaaatgaaatacaataagaaagatgttggcaactcaattctcttacgtgaggttcaattgactcttcaaactttatgtttgaaagtttccataattaaaaaaaaaacagacaaaattacaaagagattgttagaataaaatctaagtcacaactgtaatagatggcctcatatttaaataactaaacgagcaacatatttaaatgaggtaaagatcatttcatatgaacctgacatgttttcagaaaaaaaaagacaacttcaaaaaagatgtatgtattttctagtacattatggaaaatattccgtaagggtccaatgttttctttaaagattttttttgtgattaccacagtaacttctaccctgacagaggaaaacaaataattgacaggataatttctttactttataatttctaataatacgttattagaagcaaacagcaatacatcagaagataaaagtttcttccatattatccttcacttaaaattatataatagttttttcagaattgtcaggataacttacctgggtttccatcattggcttttggaaaggaaaagtatcatggttgacacaccataaaatatcattatcctcattttctgaggctgccatcaatagaatacctaaaagtttaatatacaaaatattattacatcatgtcaaatatgcatcctcaataaccttaataattattaggttagtgcaaaagcaattgcggttttgcaattaaaattataaaaccgggctgggcacggtggctcatgcctgtaatcccagcacttttggaggatgaggtgggtggatcacgaggtcaggagtccaagaccagcctaatcaacatggtgaaaccctgtttctactaaaatacaaaaattagctgggcatggcggcaggcacctgtaatcccagctactcaggaggctgaggcaggagaatggcgtgaacgcaggaggtggaggttgcagtaagctgagattgtgccactgcactccagcctgggcgccagagcaagattccgtctcaaaaaaaaaaaaaaaaaaaattttacaaaaccacacgtacttttatgccaacttaaaactagcatatataaatatacacacacaacatcaatcttttttttttttttttgagacggagtctcgctgtcacccaggctggagtgcagtggcgcgatctcggctcactgcaagctccgcctcctgggttcacgtcattctcctgcctcagcctcccgagtagctgggactacggcacctgccaccacgcccgactaattttttgtatttttagtagagacgaggtttcaccgtgttagccaggatggtctcgatctcctgacctcgtgatccgcccaacttggcctcccaaagtactggaattacaggcgtgagccactgcgcccaaccgaacatcaatctttataaacaaacaagttacaaaataaaataattccctgaaagactatataattatttttaaggtagactccttaagtgttctcaattttaaactgtatttctctcagataaacatttttttttcacattttagcatttctgaacttagggcatatcttgcagtcaatgggtttatcaatttaattattaattttataaaaatatacttagtatataaaaatgccatgactgacaaattcacaatgtaatacaagctaatattcaatgaaatacagtttatatactggttaattcaaacacaccatgaataaaaatgatgaaggtgctagaggaatggcagagataagtgtactatagaagcaattatctgggccaggtgctgtggcttatgcatgtaatcccagcagtttcggaggctgaggcaggctgatcacttgagcccaggagttcgagaccagcctgggcaataaagtaagaccttgtttcaacaaaacatgaggcaggaggattgcttgagccggggaggtagaggctgtaatgagtcatgactgcatattgcactcctgcttgggtgacagtagacactgtctcaaaaaaaaaaaaaaaaaaggcaattatctcaacaaaacttgccaacacggtggctcacgcctataatcctagcgctttgggaggcagaggtggtaggactgcttgagcccaggagtttaagaccagcctgggaaacatggtgaaaccccgtctctacaaaaaatacaaaaattagccaggagtggtggcacatgcctgtagtcccaactcctcaggaggttgagcaaggaggatcacctgagcctggaaggttgaagctatggtgacccaagatcctgccactgcactccagcctgggcaacagagtgagaaccttcctccccaccctcaaatgacttggaaaaatattctgtattcatggatttgaagacttaacatagttaagatggcaacatgccccaaattgatatactgattcagctatcacaatccaacctcacttttttgtgtgttttttgtttttgtttttgttttgagatggagtcttgctctgtcccccatgctagagtgcagcggtaggatcttggttcactgtaaccttcacttccccagttcaagcgattctcttgcctcagcccacaagaagctgtgactacagacatgccccctacacccggctaatttttgtatttttagtagagacagggtttcgccatgttggccaggctggtcttgaactgatctcaagtgatccacctgcctttgcctcccgaagtgttgggcttacaggcgtgagccactgcacccggccccacctcactttttttgcagaaattaacaaggtgattctaaaattcatatgaaaattcaagaaactgagaagagccaaaatcatcttttaaaaaatcaggccaggtgcacggtggctcatgcctgtaatcccagcactttaggaggccaatgcagacggatcacttgagctcaggagtttgagacgagcctaggcaacatggcaaaagcctatctctacaaaaagtacaaaaattagccgggtgtggtggcacacacctgtagtctctctcagctactcaggaggctgaagtgggaggacagcatgagcctgggaagcggaggttgcagtgagcagagattgtgctactgcactccagcctcggcaacagagccagaccacctcaaaaaaaaaaaaagatcaaagttggaatagtcacacttatcaatttcaaaacttattacaaagcaacggtaatcaagactgtgctactgacataaggatggataatatagaccaacagaatagaactgagaatccagattccatacattaacgggtaattcacttcagacagtaagatgaagacaattcaatgggggatataatagtcttttcaacaaatggtgctcagacagctagataaccacatgcagaaggatgaagtcagattcctacttcacacaacatacaaaaattatcacaaaacagatcaaaaacctaaatgtagcagtgaaaactacactttcaacttttgaatttcactacaatttcaaattttattttagattcaggaggtatatgtgcaaatctgttacttgcgtatattgcgtggtgctaaggtttagggtacaactgattccatcactcaggtactgagcataagacccaatagtccgtttttcaacccttgctcccctacttccctgacccttctagtagttcccagtttctactgttgccatagggtattttcaaatacttcacaacaccatataattttaacaattttaagaatataatcttaaatctgatagtatttcagaacttacctttactataaagagctctatgtacttttgaaggcttttccacggttgaagatgctgagaatccaggaggtaagcggacatgaaccagcgtcagtgtattaggccgtgctaatggctgtctgaatggacaagtgctaaaatataacctaacacctgaagatggggtaaaattatgcatcagtaatagaaaacaaggacctgaggtaaatgtgttattgaagcaattacatacagcaatgcaacactctgctaaaaccatacataactttcctgactaatttttatttttggagatggagtctagctctgtcgcccaggctggagtgcagtggcgccatctcggcttactgcaacctccgcctcccgggttcaagcgattctcctgccttagcctcccaggtagctgagactacaggcatgtgccaccacacccgtctaatttgttttatttttatttttatttttttttgagacagaatcttgctctgtctcccaggctggagtgtagtggcgcgatcttggctcactgtaagctccacctaccaggttcacaccattctcctgcctcagcctcccgagtagctgggactacaggtgcctgccaccatgtctggctaattttttgtgtttttagtagagatggggtttcaccgtgttagccaggatggtcttgatctcctgacctcaggatccacccgccttggcctcccaaagtgctgggatcacaggtgtgagccaccgcacccggctcccctgactgatcttaaattaccatatagactatctgctaaaatatatatctaagaaaatgtcactcgaaattgagaggtgaatcaatacatttcattagaaagaacttgcaaagacaaaccaagaaatcttgtgttccaattcaggctttgttacaaaatgtcagccactgcgccttttaggcttggcttttgttttgcttttttactggttttttgagaaaagatcttgccctattgcccagggtgaagtgtagtagcataatctcagctcactgtagcctcaaactcctgggctcaagtgatctttccatgacagcctcccaagcagctggtactacaaggccgtgccatcacacctagctaatttttgtatttttagtagagacggggttacagggtttcaccatgttgctcaggttagtcttgaactcctgggctcaggcaatctgcctgccttgatctcccaaagcgctaggattacaaatgtgagctaccatgcctggcctaggtttggttttatatctataaaatgaagaaacagaattagaaaaatctcccagttttcaaaatcctttattttacaaactatttatatggctttacggcagatatagaaggaaaaatatatttctaataataaatttccaaatctaagaattttcagaagttgtaacagtaatagcagatatgtaaataaaacaacatacctgcatgtgtgacagccaataactgacagtccagtgattcagaattttcaatcactgctatttggacaattggtttaaaaacagaacgatcgatggtcctaaaagaaaggagaaaataaagtgtatttttaaaatgtgtctgctaaattataagaaatatttcccatcagaatgtttacatatttccatattttccttttttttttgagatgtagtctcactctgtcacccaggctggaggagagtggcgtgatctcggctcactgcaatctccgcctcccaggttcaagcaattctcctgcctcagcctcctgagtagctgggattacgggctcgcgccagcacgcccaggtaatttttgtgttgttagtagagacagggtttcatcgtgttggccaggctggtcttgaactcctgacctcgcgtgagcgtgatccgcccgcctcggccttccaaagtgctgggattgggattacaggcgtgagccactgtgcccgaccacatatttccatattttcttttttttttcttttttcttttttttgagacggagtcttgctctgttgcccaggctggagtgcagtggcgccatctccactcactgcaagctccacctgccaggttcacgccattctcctgcctcagcctcccaagtagctgggactacaggcacccgccaccacacctggctaattttttgtatttttagtagagacggggtttcactatgttagccaggatggtctcgatctcctgacctcatgatccgcctgccttggcctcccaaagtgctggcattacaggtgtgagccactgctcccagccttatattttctaaatatgctaaataatttaagactagcttcttaggaaagtaatacaagagcagcaagaactggaaaaactctggaatgtgtattttttacatttatattattaagagtaaccctattttcaaacaaagatcacaaaaaaagactaaaaccattgggtgaatggttggtggggagcagtgttctcagtgtcaaagtatcattactgctaattaaaaaaggagaaaggccaggtgcagtgactcacgcctgtaattccagcactttgggaagccgagacgggcagataacctgaggtcaagagttcaagactggcctggtcaacatggtgaacccccgtctctactaaaaatacaaaaaaattagccaggggtggtagcgcatgcctgtaatcccagctacttgggaggctgaagcagaagaatcacttgaacccaaggtggaggttgcagtgagctgagatcacgtcactgcagtccagcctgggcaacagactgagactctatctcaagggggaaaaaaaagggagaaaatggatctttataatgtagacatttggttaaaatcacctcaatgaagctttcaacagtgagaaaactgctattatgtgtctcttgatataatgtagtaagacatttcacactgcctatgtaatactggctaaaagatatattactgcttggtgaggtggctcatgcctcaaatcctagcattttgagaggctgaggcagtcagatcacttgaggccaggagttcgagaccagcctgctcaacatggtgaaaccccatctctactaaaaaatatataaaaattagccaagaatagtggcgcacatctagagtcccagctacttgggtggctgaggcacgagaatcactggaactcggaggcagaggttgctgtgagccaagatagcaccatggcactccagactgggtgacagagcaaaactctgtctcaaagaaaaaaaaaaaaaaaagaaagaaaatatacatatataaaatacatataaacatcatatataaaatatattactcagaatctaattataaaaaaagatatattcagaaatttgtataattatcctgcccttccttccaaacgtcaatattataaaaaaaaaaaaaggtggccagggggctgttttatattaaagagactaacaaccaatccaattcataaattctgatataactggagaaaaatggaaagaaaaacaactataaaagatttcgaagccaggcgcagtggctcacgcctgtaatcccagcactttgggaggctgaggcataaaagctggccaacatggtaaaaccccgtctctactaaaaatacaaaaattacccaggtgtggtggtgtgcatctgtagtcccagctacccgggaggccgaggcaggagaactgcttgaacccgggaggtggaggttgcagtgagccaagatcgtgccactgcattccagcctgggtgacagagcaagactccatctcaaaaaaaaaaaaaaaaagattttgggggcacggtggttcacatctgtaatcccagaatcccaggactgtgagaggctgaggcagacacgtcatttgagcccaggagttcaagaccagccagggcaacatggtgagatcccctctctacaaaaaatacaaaaattagccaggtggaggtgtccgtgcctgtggtcccagctgcttgggaggctaaagttggtggatcacctgagcctagggaggtcaagcaccactgcactcaatcctgggcagcagagttaaaaaaaaaaagattttggggactactgggcaattttaatatggactaagtatattgttatgtaacagactaaaggcatgtcggtggctcatgcctgtaatcccagcactttgagaggctgagacatgcggattgcttgacctcaggagttcaagaccagcctgggcaacaatggtgaaaccccgtctgtaccaaaaatacaaaaaattagccagatgtggtggcgcacgtctgtggtctcagctactcaagaggctgagatgtgaggatgccttgagcctgggaggaggaggaggctgcagtaagccacgatcgcaccactgtactccagcctgggtatcagagtgtgactccatttcaaaaaaaaaaaaaaaaaaaagtcatgatgtctacaatgtactttcaaatggctcataagacaggcaacaaagaggcaaaatgttaaaattgagataaagagtgtattagttttgccgggtgcagtggctcatgcctgtaatcacaacactttgggaggccaaggcgcgcagataacaaggtcaggagttcgtaaccatcctggccagcatggtgaaaccctgtctctactgaaaatacaaaaaattagccaggcacagtggtgcgcgcctatagtcccagctgcttgggagggtgaggcaggagcattgcttgaacccggcaggcagagggtgcagtgagctgagactgcaacactgcactccagcctgggtgacgtgacagagtgagattccatctcaaaaaaaaaaaaaaaaaaagtgtattagtttttgtcacattgttcttttaatttttttgtggatttgaaaaaaattccagaaaaaaattagagggaaaaacagaaaattatgtgttttcaattgtgtctgccttcagaatttttttcttgtcactgaagaataaaacaaaacaaaaaggctgagcaagatagcaagaccccaggtctactaaaaataaaattaggtgggcatggtggcacacatctatagtcatagctactcaggaagcttaggcatgaggatcacgtcagcccaggaaattgaggctatagcagactacaattgcaacactgcactccagtctgggcaacagagtgaaaccctgtctgaaaaaaaaaacaaaaagttgatttatttcactctgattgtagcaataatctaggcacaatgacaatagaagttgaaaaatttgaggccttcattataaaaagagtgtttgcaggtggggtgcagtggctcacgcctgtaatcccagcacttcgggaggccaaggcaggcagatcacctcaggtcaggaggtcgagaccagcctggccaacatggtgaagccccatctctactgaaaatacaaaaattagccaggcgtggtgacaggcgcctgtaattccagctactcaggaggctaaggcaggagaatcgcttgaacccgggaggtggaggttgtagggagccaagtcgcgccattgcactccagcctgggggacaagagtgagactttgtctcggaaacaaaaaaaaaagagagagagagcgtttgcagcttgaccaaggtagttgggatatgtgcaaatggtaatgcagattgtctgaagacttggcttccgcgttaggttcttgtacttatttaggagttagatctcaggcaaatcatcccttagtttcagtttcctcatgaataaaatgggtactacaactttgaaatattgtgttctgtacttgtgtcaataatcagaccaactaagcttgaaccacacatgtctgttaaaagagtgagtagtggccgggtgcagtggctcatgcctgtaaccccagcactttgggaggccagagcgggtgtattgcttgagtccaggagttcaagaccagtctgggcaacacggtgaagccctgtctctataaaaaatagaaaaattcgccaggtgtggtggcatgtgcctgtagtcctagccgctcgggaggcttaggtgggagaatcgcttaagcccaggaggtggtgattgcagcaagctgagatggagccactgcactccagcctgggcaacagagcgagactccatctcaaaaagaagcaaacaaaaaaccgaaagagtgaatagttaaaagtggggaaactttgagacatgcagtttcctagtcatgatccctatgtaaagttgccaggaaaaacacgtcaagctgtactttacgtagtaaaaccagtctaccttatatttccaactatcaaacataagaataaaagagtctcaagctgggcacggtggctcacgcctgtaatcccagcactttgggaggccaaggcaggtggatcacctgaggtcgggagttcgagaccagcctgaccaacatggagaaaaccccatctctactaaaaatacaaaattagctgggtgtgatggcgcatgcctgtagtcccagctactcaggaggctacggcaggagaatcacttgaacccgggagacagaggttgcagtgagccgagactgcaccattgcactccagcctggacaacaagagtgaaactccatctcaaaaaaaaaaaaaaaaaagtcttggccaggcacggtggctcacgcctataatctccacattttgggaggcgtggtgggtagattacctgaggtcaggagttagagaccagcctggccaacatggcgaaacccaatctctactaaaaatacaaaaattaggctgggcatggtggctcatgcctgtaatcccagcactttgggaggttgaggcgggcggatcacgaggtcaagagatcgagaccatcctggccaacatggtgaaaccctgtctctactaaaaatacaaaattagctgggcatggtggtgcatgtccgtaatcccaactactcgggaggctgaggcaggagaatcgcttgaacgcgcgaggcagaagttgcggtgagcagagatagcaccactgcactcccgcctgggcaacaagagcgaaactccatctcaaaaaaaatatatataaaaattagccaggcatggtggcaggcacctgtaatctcagctactagggagcctgtggcaggagaatcagttgaacccaggaggtggaggttgcagtgagccaagattgtgtcactgcactccagcctgggtgacagagtgagaccctgtctcaaaaaaataaataaataaataaataaataaaggagtctctaacagctccatttcaaacataatgtagagtgtcatctcttcaacattccttgtcttttagagacattttgatgagggaataatatatacttttagaaggctacacacaaatagtataattatgcctgcaaatgaaatgcttaataataaattacatgttacctagcaatgttaccagcagcagagacaatggcattctgtgacacagaggcaactctgctcattccttgtccatcttgtcccaaatcatacacctgtgaatacaaaatcattctcacttaaacatgattatatactatacacatattattaaactctttcttttaagggatcctttaatattggtatttaatacaaacatgaaaacattcagattcgaaatttcatagaaaggggacccttctgagaagtgagttgggctttttttttttgagacgaagtcttgctctactgcccaggctggagggcaaaggcatgatctcggctcactgcaacctccgccgcccaggttcaaatgattctcctgcctcagcctcccaagtagctgggattaaaggcacataccaccacacctggctaatttttgtatttttagtagaggcagggtttcatcatgttggctagactggtctcaaactccagacctcaggtgatccgcccaccttggcctcccaaagtgctgggattacaggcttgagccaccatgcccagcaggctttttttttttttagttacacagttcataggaaaaatttaagaggtgggaattgtcttccttaaaaataaggatttatttgactcttaatggtataataatattaatactaacctgtattactcctttctcagatcgtgtatataaaatatttctagaattatcaattgcaatttgaagaataggatctaaaagtaagacaaaaaaaaaaaagagaaaaaagtaaacccaaggattaacaaagcaaatacattagctagttacaacaaactgttgaatcagaactttgtattcaggggctttctactctcttgctttgtagttaaatcctaggatgtttgcataagatccagtccaaaaagcattttggtcagacaacacatgaaaaaaacacatgctaaatactgtgactgggttatgagcatagaaagtaagttattttgtcctctaaatgaattttaagccaaactgaaaacaaattctaagttattttttcatgaaataacttagaaaataaattctaagttatttaaacattaatgaatgtttactacatcctagaaacacagaataagtatacctggtcctttatgttaagaaacttccagtttggcctaattgattgtgtgaaagaaaataattttaaaattcagtcatattaatctttgggtatacagatcttattttgccaaagcattttaaaaattatttcacctgttgaaatctctcagttcattaaaagctaagatatattctttttatactggaaatttgttctagaccaagcaaacaatgtattagctgtctgaatgtctgtctctctcacatacatacacatattttggtttaattatgtacagctgttttagacgcaagttctttgatgctacatttataggaaataagtaaacttgagaacaaaatccacactttctctaggttatgatctccttaccctttaaaagaccttatgaatatataagaaatgctacttaacataacaaattgtttcaattaagaatgataatttctgaagaaaacgttgagggaacaatgtgttagaaattagttgtacttgccaaatttattgttttctacttaccatcttctgagaacgtgaattgtagcaaggaaggaacaaggaaagaaagtgagctctttgagtggtttattttcctacatctttggctaaaccaccctgcttcagccttaaagaaaaaagtagaaagacgacttataaaagtatgtaactcccttacaataactactgtatatccatatttataaaaaccttcaaatcttcatgaaataccagttataatcactaataccagttataatcaacaaaacgagacatattattcaaaattaactactgagtttagcccataatttaaaatatcaaccaaatactgacaaggaaagaatttcaagacatactgttagatgaaaagccagttatgggctgggcacagtggctcgcacctgtaaatcctagcactttgggaggccaaggcaggtggatcatttgaggtcaggagttcgagaccagcctagccaacatgatgaaactctgcctctaataaaaacacaaaaattagctggatgtggtggtgcacacctgtaatcccagctattgggaggctgaggcaggagaactgcttaaacccaggggatggaggttgcagtgagctaagattcagccactgcattccagcctgggtgatagacctgggtgatacagtgagactccatcacatttaaaaaaaaaaaaaaaaaaaaagcaattacgaattaaatcaataatccaagtgaaaacacatatttgcaaaagtgcattttgtatttgtatatgtgtatatacacacaaacacatatgcatagatatctatagagacattgatgtgtgccttatgttccacgaggacatacatagaataatgacttttacctctgagggctgagttttgtaggcatggtgtagtcatggggactacagcttcaactgtatgcttgaatatttaccataaaaatatattaatgtccttatataattagaaaacaaaataaaggcttatctttccctactccatcaagagagaaaaaaaaacgtttacaaatgtcagacttacctggtaggctacttcatataaacagccatcctttccagccaagaaaattctgccattatcagtggaagttattgttaaaaggtaagtattatcagtaggaagagaatataaaggatctggaagcaactgcattccaccagacaaactatcattaagaactccagaacctatttaagaaagaatacataaatcagtttattagctactccacagtttttaaaaatctttgcattatcatcagaatctatatgtttactcaattcttttttttttttcttgagacagtcttactctgtcacccaggctgggtgcagtggcccgatctcagctcactgcaagctctacctcccgggttcatgccattctcctgcctcagcctcccgagtagctgggactacaggcgcccgccaccatgcccagctaatttttttttgtatttttagtagaggcaaggtttcaccgtgttagccaggatggtctcgatctcctgatctcgtgatccgcctgcctcggcctcccagagtgctaagattacaggcaagagccaccatacccagccttactcaattcttactgacaattaacatagtcaacagcttctataatatacattttaaaattactaaaagaagtctgatacaatttgataattcaagttaaacagaacctgcagagtgtgtgagtgtgtgtgtgtgtgtgtgtgtgcctgtgtgtttattatatagtaagataataaacaagaaactaacccggccgggtgccgtggctcatgcctgtaatcccagcactttgggaggcccaggtgggcagatcacctgaggtcggcagttcaagaccagcctgaccaacatgaagacaccccgtctcttctaaaaatacaaaattaggccgggcacagtggctcacgcctgtaatcccagcactttgggaggccaaggcaggtggatcacgaggtcaggagttcaagaacagcctggccaacacagtaaaaccctgtctctactaaaaatacaaaaaaattagctgggtgtggtagtgggtgcctgtaatcccagctacttgggaggctgaggcaggagaatcgcttgaacctgggaggcagaggttgcactgagccaagattgcaccactacactccagcccgggcgacagtgcaagactcccttatcaaaaacaaacaaacaaacaaaaaaacaaaattagccgggtatggtggtgcatgcctgtaatcccagcaactcaagagactgaagcaggagaatcacttgagcctgggaggcagaggatgcggtaagccaagatcacgccattgcactgcagcctgggcaacaagagcgaaaatccgtctcaaaaaacaaaacaaaacaaaacaaaacaaaaaactaacccaatgttaacttgtggaaaagagcctgaggatttggcagtaataatcattaatgtgagtcaatggaattcaacatttcacccagattagcttttaactgtaatatcaattggccaaaatactattattttaaaaaacgttaacatgtgggttgccatacctgtttgcaaattagcatagctgagtccaagaattactatgtctacaggggtcgccaaaaccaggaggtgtcgcacatgaggttgaaagatgcctaagataaagtagacacagggcaggaatactttcagcatttaagcactaacagagtaagcttttattaccattaaagtgagctactaattaaatggtatatgaaaagtctggatgcagtttagtcaattctgttgttaaaaatattattatgtatgatcatttaaataagtaaattttgaatgtcatcaagataatgaagaggaaaaaaagttaatagcagtggaaaagaaccaccttagaaaacaatcacttcagtatttaatgctattttaaaagtgttatattacaaaatagtttaaatatattaaaatatagagatgtatatttgtatacccatgttcatagcagtgtttttcacaataactaaaaggtgaaaacaaaatccaagtgtccatcgatagatgcattaaaaaaaatgacatatatatatatacacacacacacacaaaatggaatactactgaactttaaaaagtaagaaagttggccgggcacgcctgtaatcccatgggaggctgaggcaggcaaatcacctgaggtcaggagtttgagaccagcctggccaacatggtgaaaccccatctctactaaaaacaaaaaattagccgagtgtggtggcacgtgcctgtagtaccagctacttgagaggctgaggcaggagaattgcttgaacccgggaggcaggggttgcagtgagccgagatcacgccattacaccccagtctggacgacagagtgagactccatctcaaaaaaaataaaaaaataaaaacataaaaggaaaaatgttctgatgcatgctgtaacacagatgaaccttgaggacataggttaaataaaatgagccagtcacaaaatgaccaatatagtaccatatgattccatttatatgaggaaacctagaatagtcaaattcttacagacaaaaagtggaatggttactaccaactgctgagggaaggaggaacaggagtttttagttaataggtacagtttccattttacaaaatacagagttctagatatagatggtggtgaagtttacacaataacgtgaatggacttaataccactgaagtataggcttaaaaacagttaagatggcaaagtttgtattatgtgtattttaccacaattaaaatatatataatagatttcattttgaaatgcaaataaaagctagacaattttagaaaataaaacttacacctatagttatctacacaagaaaagattacaaccttgataatagtatatagcaatatttatacacttaatgcatctcttttagattctatgtaaaggacatacatttgctttgcttttctttttgagacagagtttcactcttgttgcccaggctggagtgcagtggctcgatctcggctcactataacctctgcctcccgggttcaagtgatcctcctgcctcagcctcccgagtaggtgagattacaggcatatggcaccatgcccagcttattttgtatttttagtagagacacggtttcaccatgtggtcaggcttgtctcgaattcctgacgtcagttgatccacccgccccagcctcccaaagtgctgggattacaggcgtgaaccaacgcacccagtgtctttatttcttctttttttttttttttttttgagacagggtcttgctctgctgcccaggctggagtgcagtggcagaatcaaggcttactgcagccttgtcctcctatgctcaagcgatcctcccgcttcagcctcatgaatagctgggactacaggcatgcaccaccatgcctggcttatgtttctgttttttgcagacagggtatcaccatgttgcccaggctggtcttgaagtctcagactcaggtgatctgctcgcctcagcctcacaaagtgctgggattacaggtgtgagccaccacacccagcctgaaaatatattttcaatgcaagtaaataaatagtgtataaaatgtcggtttgggctgggcgtggtggctcacgcctgtaatctcagcactttgagaggcagagacgggcggatcacttgaggtcaggagttcgagaccagcctgaccaacatggtgaaaccctgtctctactaaaaatacaaaaattagccgggcctgctggcgggcgcctgtaatcccagctactcgggaggctgaggcagaagaatcgcttgaacccgggaggcggaggttgcagtgagccgagatcgtgccattgcactccagcctgggcgacagaatgagactccatctcaaaaaaaaaaagaagtctgtttttacttaactgagtatctataattgcaaaatggccataatcttaaaaaatttcacttaggccttgcaaaaaagtaatttttgtctattatttcctcctataaaaaggtacatttggctgcacagtggctcacatctgtaataccaggactttgagaggccaaggtgggcggatcgcttgaggccaggtgttaaaagactagcctggacaacatggccaaaccacatgctactaaaaatacaaaaattagccgggaatggtggcacatgcctgaaattccagctactcaggagcctgaggcaggagaatcgcttaaacccaggaggcggaggttgtagtgagcaccaaggtgactccactgtactccagcctgggtgacagtgagacactgtttcaaaaaaaaaaaagtacggttaaagaatgtgtgtgtgtgtgtatatatatatatatttatttatttgtttgtttgtttgtttgtttttcagaggcgatgtctcactctgttgcccaggctggagtgcagtggcgtgatcttggctcactgcacgctccacctcccaggttcacacaattctcctgcctcagcctcccaagtagctgggactacaggcgaccaccaccaagcccagctaattttttgtatttttagtacagatggggtttcactgtgttagtcaggatggtctcgatctcctgacctcatgatccacccaccttggcctcccaaagtgctgggattacaggctcaagccaccatgtccagccaagaatatattttaaatttaaatcaatcaattctccttcctagtaactctgataagagatttggcattatgctgggcatggtggctcacgtctgtaatcccaaacactttgggaggccgaggtgggcggatcacctgaggtcgggagttcaagaccagcccgaccaacatggagaattcccatctctactaaaaatataaaattagccaagcgtggtggtgcatgcctgtaatcccagctacttgggaggctgaggcaggagaatcgcttgaacccaggaggcggagggtgcggtgagccgagatcacgccattacactccagcctgggcaacaagagcaaaattccatctcaaaaaaaaaaaaaaaaaatagagatttggcattatgagggtgaaagagtaagtcaaacaatgcttgtgatatctacaagatttaatttactctgaactctgttctcacttccatgggctatcaggattatggccagggcatggcagctcatgcctataataccagcactttgggagaccgatgtgggaggatcacctgaggtcaggagttcgaaaccagcatggccaacatggcgaaaccctgtctctactaaaaatataaaaattaggcgtggtgacatgcgtttataatcccagctacttgagaggctgaggcaggagaatcgcttgaactcaggaggcgagactgcagtgagcaccaaggtggctaaactgcactctagcctgggcaacagagtgagactctgtaacagaaaaaaaaagaaaggtacatttaaaggatatattttaaatttaaatcaatcaattctccttctcagtaaccctgataagagatttggcattatgagggtgaaacaataagttaaacaatgcttgtgacgtttctaagatttactctaaactctgttctcacttccacgggccatcaagaatatggccagggcacggcggctcacgcctgtaatcccagcacattgggaggccaaggtaggcaaatcacctgaggtcaacagttcaaaaccagcctggccaacatggcaaaaccctgctctactaaaaatataaaaattagctgggcatggtggcacatgcctgtaatcccagctacttggaaggctgaggcaagagaatcgctcaatcctgggaggcggaggctgctgtgagcggagatcacgccactgcactccagcctgggcaacagagcgagactctgtctcaaaaaagaaaaagactaaaaaaatggccaggtgcagtggctcacaagtgttaacccagcatccctgaggtgggtggattgcttgagcacaggagttcaagaccagcctgggcaacatggcaaaaccccatctctacaaaaattagcctggtgtggtagcacaaaactgtagtcccagctacttgggaggctgaggtgggagggtctcctgagcctgggaggttgaggctgtagtgagccatgatcatgccactgcactccagcccgggtgatagagtataagaccttaatctcaaaaaaaaaaaaaaaaaaaaaaaaaaagagaaagacagactaataaaatgcagacactaaaatttttcttaacattaaattcagcaattaatgaaaaatctatagtgcaaaaccttcaggtatatcaagaaagagcagtaaaaagcaaataaaataaaattcaaaaaattacagtttaacatttttaaaggcagtgtcacttataccattaaagtaaacagttaaacattaataatcactttacatatttctaattagaattcaaaataaaacttcaatggagaatacaattgtttaaaaaagggtgttgtcagccaggcgcggtggcttacatctgtaatcccagcactttgggaggctgaggcgggcggatcacctgaggtcaggagttgagaccagcctggccaacatggcggagccccgtctctactaaaaatacaaaaattagctgggtgtggtggcgcacgcccgtaatcccagctattcgggaggctgaggcaggagaactgcttgaacccaggaggcggagattgcagtgagccaagattgcgccactgcactccagcctactcgatggaacgagactccatctcgaaaaaaatgtgtgttgttgttcaggtctataccatttggagtttacatatacaaacataatctcttccttatagttttatttcttacctgcttttggcttcacaagccccacagcaagaatagtctcactaagtccatcaaaataggcaaggtctcctctgtgaataaatgaagaaaaacatgttacacatataaagcaaataggccagatgtggtggctcatgtctttaatcccagtactttgggagtctgaggcaggaggactgcctgagcccagaagttcaagaccagcctgggcaacatagtgagactgtctctacaaaaaagaaacaaaaaattagccaggcatgggggtgtgaggccactgagttggcaggatcgcaaaggcctgggaggttgaggctgcagtgagtagtgatcatgccactgcactccagcctgggtgacaaagtgagagcctgtctcaaaaaagaaaagaaaagaaaaacagaaaaccaagtattatcttacaatgatctttattattattattactattatttttgagacaaggtccagctctgtcacccaggctgaagtgcagtggcacaatcttggctcactgcaatctccacttcacacctggctaatttttgtattttttgtagagacaaggtttggccatattgcccaggctagtgttgaactcctgaatgctctttattagttaaataaatttagacacagaatataatgaaaagactgggtgggcacagtggctcacacctgtaaacccagcactttgggaggccggggtgggcgaatcacaaggtcaggagattgaggccatcctggccaatgtggtgaaaccccgtctctactaaaatacaaaaaattagcccggcatggtggcgcacgcctgtggtcccagctactcgggagggtgaggcaggagaatcacttgaacccgggaggcagagttgcagtgagccgagatcacaccactgcactccagcctggctagagaacgagactccgtctcaaaaaaaaaaaagactgggagaggtggctcatgcctgtaatctcagcactttgggagggtgaggcaggagcccaggagagttcaagaccctgggaaacacagtgagacttggtctttatgaaaaatttatatatatatataactttttcattttatatatattgaatatataaaaatatttttcattatatatataatgaaaaaataaacaagcaaagaaaactgtttcagttccaagacccagggatccagacctgcttatggctaaggatgaactagaaaaatagggaaatacaaaaatagaaaatgctgctccccattccaaacatctccacaacagggctgcacatcaagtaatagcaatctactgctggggcagggataagggtaagaagagggccatcttacaaggatggaatcacaggaagagcctaagactgaggatgtaagaggaacactgagaaaaaatctccagtaaaccaacttgcaccctaagtacaacaacagaacccaaatccagctcaagtcctgacctggaaaaaggcaattccccatataataaagatctgctataccttagccaaggaaaagacatgcccatttctaagaataaataccacttgctacttacttacagtatctactgtcttaacatgatttctggctttcaataagaaatcatgagacacaaaataacaagaaaaaaaaccccagtgtcaagaaacaaagtaatcaatagaaccagactcagctatgaatccaaactatcagacaagaaatgtaaagtaactatgaactatacatataggctttatataggaaaaattacctaattgactatatgtacaaataggtaaagttgggaggttgagacgtgtggatcacttgaggccatgagttcaagaccagcctggccaacacaatgatacctgtttctactaaaaatagaaaaaattagccaggcatggtgtcccaggcctgtaatcccagctactccggaggctgaggcatgaaaatcacttgaacctgggaggtggaggttgcagtgaggcaagatgataccactgcactcaagcctgggcaacagagcgagactctgtctcaaaaaaaagggagaaataaaacagacaaaaaaaaataggtaaagaatttcgacaaaaagataaaaattataagaagtcagcgaggctgggtgtggtggctcacgcctgtaatccccagcattttgggaggctgaggcgggtggatcacgaggtcaggagatcgagaccgtcctggccaacatggtgaaaccccgtctctactaaaatacaaaaaaaaattagctggccatggtggcacacgcttgtattcccagctactcaggaggctgaggcaggggaattacttgaaccagggaggagaaggttgcagtcagccaagatcttgccactgcactccagcctgggcaacagaatgagactcagtctcaaaaaaaaaagccaatgaaggccaagtgcggtggcttacgcttgtaatcccagcactttgggaggctgaggtgggcaggtcacctgaggtcaggaattcgagaccagcttgcccaacccggtgaaactccgtctccactaaaaatacaaaaattagccgggtgtggtggtgcatgcctataatcccagttactcgggaggctgaggcaggagaatcacttgaacccaggaggttgaggctgcagtgagccgagatcatgccactgcactccagcctcagcaacggaatgagataaaaaaaaaggggggggggtccaggcgcagtggcttacacctgtaatcccagcactttgagactccgtctcccaaaaaacagggagatagagacagaaagtggaaaaacaaaaaacagaatggagcatccaaaatgaggtatataacaaaagtatagctgaaatttctgaagaaagagaatgtatcagaatatttcaagataatggctgggctgggtgcggtggctcatgcttgtaatcccagcactttgggaggcccaggagggcaaatcactggaggccaggagttcaagaccagcctagtcaatatagtgaaaccccatctctaataacaatacaaaaattagccaggtgtggtggcccatacctgtagtcccagctactccagaggctgaggcaagaagtgcttgaacccaggaggtggaggttgcagtgaaccaagatagtccactgcactccagcctgggcgacagagcgagactctgtctcaaaaaaaaaaaaaaaaaaaagacaatggctgaacagaaaaggagagagagagagagaaataaagataacagctgaaaaaaattctaaaaataatagaagacatcaaactaaagatctaagaagctcagagaacaagaagcagaaaaaataccacgaaaaaatatgatctagactttcaagaaagcttccagtcatcctgaaaaggccatccacacaggaacaaaatagctaaatggcaacttatgcggactaggattccccatcctcttacatcatgccattccacagggccctttgataactggcacagcctcttggaactacgatccaatgctgagatatttgggggttagagaacaatgaaatgaccaagattacatttttatcatccaggtggaattaggatttataatagaaagccaattgaatatttaaactaagtataaattttacaaaattgaatttgtggaccttgtgccttgattttttaaaataagtacattcttcaaataatttttctttaaatgaacacacactgctatggatcaaatatctgtgtcctcctaaaattcatattaaatcctaactcttaatgtgatagtatttgtaggtggggtctttgaaaggttattaggtcatgagggtatatctcatgaatgggattagtgcccttataaaagaggacccaaagaactcccctacccctctgccatgtgaggacagagtgaaaagatagccatctatgaacattgaagtgggctttcaccagaccttgatcttggacttccagcttccagaaccatgagaaagaaattcatgttgatcacaggctatggtattctgttttagcagctcggactaagacacacagtaaggtaggactgtttgttccatgagggcagaactacattcatctcattcagtactgttcctaccacaacaacagtgtcagatacataagatcaatatgtatgtgttaaataaatatgttggatgttaatggaaatgtaaaaaatttcattagtgtttttttttttttgagatggagttttccctcttgttgcccaggctggagtgcaatggcgcgatctcggctcaccacaacctccgcctcccaggttcaagtgattctcctgcctcagcctcccgagtagctgcgattacaggcatgtgccaccatgccaggctaattttgtatttttagtagagatgggctttctccatgttggtcaggctggtctcgaactcccgactgcaggtgatctgcctgccttggcctcctaaagtgctgggattacaggcatgagccaccatgcccagccgaaaacatattttaaagaaaacaattattctcacatttatctgttctgtaatatttttgcaatgacttctcttgaaaagatacatacctaaacaaaaaaggtttcattatttagtataaaaatgaatatgttatggtaacataacaaagtggggaacattcagggtacatgaaaaataatcacaatcatacatcactgctattacaactattacatttcaacatgaaaaattgctacgaaacttctagtagaaaaaaatggtttcgtttaagctataggtgttaagctgtcatttagtttcaattttgtttcaataatacagtgttttgttgttgttgtttctgagatggagtctcgctctgtcactcaggctggagtgcagtggcactatctcagctcactgcaacctccatctcccaggttcaagcaattctcctgcctcagctcccgagtggctgggactacaggcatgtgccaccacacttggctaatttttgtatttttagtagagacagggtttctccatgttggccaggctggtctcggactcctgacctcaggtgatccacccacctcagcctcccaaagtgctgggattataggcgtttgagtcagcgtgctcggccgatacagtgtctttttaatgcacgtgtgttcctaaaaagatcattaattactcaggaacaagagtaacatcttaattatatgggctttcctatgtttatcccacacctcatctaaggataatgtaatggacaactggaagtaaaacaaaatctatctctaaaaagtcaacagggagatcaccagaccaacatgctgtatttaagcaaaagtaccttaggctttcactcagaatcatttctatacatataatttacacacgggtcaaattcacaaaatgacaacaaaataaataaatatcacatgcctactccatagaaatgcaaggaaaacagaagtctttaaaaatgtccaatcatctctcaatgaattgccaacatctatttttactacgggctaacagcttgggacccgggctcctgccactcaagaatggcacctaaaccagcagcagcagttggcagcttgttagaaatgcagactcttgagcctcactcaggactactaagacagaatgcacatttgaacatctccagatgactgatactgagaagcactgacccaaaggctagatgaatgaaagataaaccaagcagcttctaatgagaacactagctacagtaaagtttatataaattccaatcacccttaaagcaaaccagccttaaatacatacccatcctcatagttccacatgaatatatcactgtcaattgtgagccaagctctgctgataggagggaacacacccatcatgcaattacactgcatatctgaggtagtgtggatgtaaggcagacagaggtgaatcttattcttctttaacttgtttcaatagcttttgacttaatatttacgtaaaaaatcacaatgtgtccactctttaatacaacatggaacccatatacttaaacgaattttaaataaaacccttaaatgaatatataacacattaattaaacatagaacaagaattataagaatgaaaaataccaattttaacatttttaaaataaatacaaagtaataggatacgtccaaactgctcaacaagttcaggtgggagaggaactcttcggatggaactgatctctggaaggttgggtacggacagcaaaccaggtccttgcaaaggataatccatatctgacatgccagaaacggtgggattatctacaaaaagaaaatgaagtatttataataatgtactgctcatcaaccgggcaaacaaaaggattgagtgccacaaaaaaattgttgtgtgttggttccaaaggtacagagagaatattctagttttgacccaacacaaagtagtcctgaaatattcccttgtgaaggtaggaacagttactggtttcaggcctaaagggaaagtcatatctcaaaaaacttgctctgtaacaaaggaaatgtttattttattttattttttttttttttgagatagagtctcgcactgtcgcccaggctggagtgcagtggcacaatctcggctcactgcaagctccacctcccgggttcacgccattctcctgcctcagtctcccaagtagctgagactacaggcgtccgccaccacacccggctaattttttgtatttttagtagaaacggggtttcaccgtgttagccaggctggtcttgatctcctgacctcatgatccgcccgcctcggcctcccaaaaggctaggattacaggtgtgagccaccgtgcccagctggaaatgtttaaatttgataatttagtgttattttaaaataaaagtggctgggcgcagtggctcaagcctgtaatcctagcactttgggaggccgaggtaggaggatcatgaggtcaggagtttgagactagcctggccaacatggtgaaactccatctctactaaagacacaaaaaattagcctgcctggtggcgtgcgcctataatcccagctactgcggaggctgaggcagaactgcttgaacccgggaggcggaagttgcagtgagctgagattgtgtcattgcattccagcctgagcgacagggcaagactctgtctcaaaaataaataaataaataaataaacaaaatgaaagcatgtaattgtattgtttgtaacacaaaggataaatgcttgagaggatagataccccattttccctgatgtgatcatttcacattgcatgcctgtatcaaaacatctcatgcaccacataaatatatacaccgttgggcgcggtagctcacgcctgtaatcccagcactttgggaggcagaggcaagccgatcacaaggtcaggagttcaagaccagcctggccaaaatggtgaaaccctgtctccactaaaaatacaaaaaaattagccaggcacagtagcaagcacctataatcccagctacttgggaggctgaggcaggagaactgcttgaacctgggaggcggaggcagcagtgagccaagatcgtgccactgcactccagccagggtgacagagcaagactctgtctcggggagaaaaaaaaaaaaaaaaaaaaaaaaaatatatatatatatacacacacacacacacacacacacacacacacacacacacagacgcctactatgtacacacaaaattaaaaataaaaaaatttaaaaataataatttagtgtttttctatcattttgctaatctgaaatgggaaaatataaaactgctttggggctcaaaggtaaaatgactataagcaaacaaaataatgactgggggaaaatactgcctttaccagctaaacatttatagattaaaacaacccatgacttttccctttagatttatccccaagaccactaagacaaatacaaataataccccacaagcagtatcttattggggggataaaaacaaagactgctctataaagtgttctcatgggcaacctttctcttgctctaagactccatcactaaggacaggagtgggctggtctactcagcctacccttgctcccggacaaggcgttatttagacctgactgatgacctacttatctcaggcactttctcaggttctatagagtacaaagatgttaaggaaaactgacatataaaacaatcttgaagtgtattatggaaatttttaaaatatatataagaaaaatacaataaatacccatgtactgattatccaacttaataaccagtaatatccccaatcatgtttcatttttatcattgttcactccttccccaattatctttttatttttattttttgagacggagtctcgctctgacgccaagctagagtgcattggcgcgatctcagctcactgcaacctccaattccctggttcaagggattctcctgcctcagactcccgggtagctgggattacaggcatgagccaccacgcccagctaatttttgtagttttaatagagacaaggtttcaccatgttggccaggatagtctcaatctttttttttttttttttgagacggagtctcacaggctggagtgcagtggcctgatctcagctcactgcaagctccaccacctgggttcaggccattcttctgtctcagcctcccaagtagctgggactacaggcgcctgttgccacgccaggctaatttttttatttttagtagagacggggtgtcaccgtgttagccaggatggtctcgatctcccgacctcgtgatctgcccgcttcggcctcccaaagtgctgggattacaggcgtgagccaccgtgcccggccggtctcaatctcttgacctcgtaatccgcctgccttggcctcccaaagtgctgggattacagatgtgagccactgcacccggccgaactctttttctctttttttttttttcctgagacggggtttcactctgtcgccttggctggaatgcagtggtgcaatcacagctcagggcaacctcagcctcttgggctcaagcaatcttccaccacagcctcgtgagtagctaggactacagtgtcatgacaccatgcctagctaattttttttttgtttttggggtttttttttgggatgggctctcgctctgtcgcccaggctgtagtgcaatggcggctcactgcaacctctgcctcccaggttcaagagattctcctgcctcagcctcccgagatgccaggactacaggagtgtgccaccacacccggctaatttttgtatttttagtagagacaggatttcgccatgatggccaggctagtctcaaactcctgacctcaagtgatccactcacctttgcctcccaaattgctgagattacaggagtaaaccaccgagcccagccaaacagcatttttctttttcctttttttttttttttgagacggagtctcactctgtcgcccaggctggaatgcagtggcgcgatctcggctcactgcaagctccgcctcccgggttcacaccattctcctgtctcagcctccggagtagctgggactataggcgcccgccaccacgcccggctaattattttgtatttttagtagagatgggggtttcaccatgttagccaggatggtctcatctcctgacctcgtgatccgcccacctgggcctcccatttcttttgagaaagagtctccctctattgccctggctggagtacagtggcgcgatctcggctcactgcaacttccgcctccctggttcaagcgattgtcctgcctcagcctcctgaataactgggattacagccatgagccaccacacccagctaatttttgtatttttagtagagacggggttttaccacgttggtcaggctggtcttgaactcctaacctcgtgatctgccacctcagcctcccaaagtgctgggattatgggcgtgagccaccgcacccagccactttttgtagagacagggttttgccatgttgctcactcaggctggtctcaaactcaagctcaagtgatccaccccacttccaggtcccaaattgctaggattacaggcatgaggcacagcgccaggccttttttttttttttttttttttttttttgagacagggtctcactctgttgcccaggctggagtgcagcggcgcaatcacagctccctgcagtctcaacctccccgtctcaagttatcctcccacctcagcctcccaagtagctgggggtccaagtgtgtgtcaccatgccaagctaatttttgtattattgtatttcttttctttaagaggctgggttttgccatattgccaagactggtctcaaacttctgggctcaagtaatctgcccactttggcctcccaaagtgctgagactattgggctgaattcatattaaagcaaatccaggctgggcacagtgggtgacacctgtaatcccaacactttgggaggccgaggcgggcggatcacatgaggtcaggagatcaagaccaacctggccaacacggtgaaaccctgtctctactaaaaatagaaaaatgagccagtggcgaacacctatgatcccagctactcaggaggctgaggcaggagcatcgcttgaacctgggaggtggaggccgtagtgagccaagattatgccaactgcactccaggctgggtgacagtaagactctgtctcaaaaaataaataaataaagcaaatccagacatcccatttaatcctaaaacataactttaataggccgaaggtggcagatcaccatgttaaatggcagtgggaacacagagggaggaatcgataactttagtgaggatgggaatgctacgaaagacttcaggccaggagtgtgacttacatctgtaatctcagcactttggaaggctgaggtaggaggactgcttgatgccaggaatttgagaccagccttgtaacagagtgagactacgtctctacataaaaattaaaaattagctgggtgtggtggcaggcgcctgtagtcccagctactggggagggcaaggcgggaggaccacttgagctcatgagttagaggctgcaatgagctgtgatcatgccactgcactccagcctggtaacagaactagaccttgactcaaaaaaaaagaacaagaaaaagaaagacaacaaagagaaactaaggactttcacagggagtctggaaaaagtttgtcaggcaaaaaaagaacattgcagaaacaataaaagtaagataaaatcctgaggaaatcctgaagatggggcttcttacggaaaatatgctaaattctctgtaatcagagcaacggatgaaaaattggatggaaaagaaggggaagagactgggtgaaagaggaaggtgtgtgtaaaggcatgagatatgtaagagaaggaccagaatgcatgcactgtttttatatcttgttttcacacctaaggaggccaaaatgagtaatgttgttcaagatgataattgctaataggccaatcaggtattataagacacgctcattggtaagtagctgtagggagcaaatactatctttgtttctatcatttctttgattacaaagctatcaatgatttttataaataatcagaagtgttctcggtttacactgcacaaattatcctatttagattactttggttcttgctcaccaacaatcttttctttcttacacttcgctggttttctccaaattccatctcacaaaggggtcactttttctagcaactgatgtaattccataagccgtggggagctggttataacttaaaactgttaaacaaattactttccagtcacctatattgtcaacacatattctgccttactctccctgtacataagcactgtgatttccctgttctctttctttattccactggtagttcttttaagatcctccagcatttcataacacacatctctacacataataaagcgtttcttggccgggtgcagtggcttgcgcctgtaatcccagcactttgggaggccgaggcgggcggatcacttgaggtcagagttcgtgaccagccaggccaatatggtgaaaccccgtctctacttaaaaaacacaaaaattagccgggcttggtggcaggcgcctgtaatctcagctacttgggagtctgaggcagaagaatcgcttgaacccaggaggcggaggttgcaatgagccgagatcgcgccattgcacttcagcctgggcgaagagggaaccgctccgtctcaataaataaacaaataaatataaagcaaagcgtatctttaagataacatgctaaatttccaaattaacttcgtttgctcttacgatctactcaaacactaacaggagaaatgaacaaatttgggacttggatctggagatgcttctcatatggccttagccataagcacttgagagcggcgagaagctcattaaggttgaggtctttgcctctttctgcttcaactgggagcttgctcttcactcttgccctctcaagtatctacaatgaagaaagtgaggaaaggaaaaaacctgaaaagaagctgcttgctgttctccaaaaatgcagccaacagtgccataaatctcagcatatcctcgccgggaccaacgctggggataagtagcaaattaggaagtcaggcgagagtc

SEQ ID NO: 1732 - DNA, 79258 bp, Homo sapiens
tctggacccagctgagtttttattttacagatcataaaacggatgaaagtatatcacagtaattaatgaagccgttctaatttagcttgaagagatttaaaattcccagtgatggcttgtactgctactgacgagctcatagactggagctcaacaaggtaaccacaaacagcatccaggcagagatttgtaaatcttctcctacaacgaaaaagacacatgattaattatacatttacaaacatttcctcctgcaggacttcttccccaccaacttctggcaactttaattctcacaggagaggaaagaccatgtgattaagtaaataagaaataaagtaaaaaagaaaacttgggtgtaggtgggttccatttgaagattttttttttttttttgagacggagtctcgctctgtcactcaggctgcagtgcagtggcgccatctcggctcactgcaacctctgcctcctgggttcacgccattctcctgcctcagcctcccgtgtagctgggactacaggtgcccgccaccacgcccagctaatttttttgtatttttagtagagatggggtttcacgtgttagccaggatggtctcgatctcttgacctcatgatccgcccatctcagcctcccaaagtgctgggattacaggtgtgagccaccacgcctggcctgaagatttttacaatgagaagaaagcagtaagagatgattcctgctaatattctttttcaaaagaatatcccttaaatggccaataatatcacaaagacataattgaaatgttttggtcctagatcactaatctaaagtagaagaaatgaatacattatgtatgttcagctgtagaaaggatttaggacaagggttgaaaatggaaaaaactcctatttttcatacatggtgatcaatatcattcaaatagttattgctaatatacacaagaatcttcccatcttctcttcaaattttttacccaggtatttattagaagcatttaaaagcttttgctgatccaatatttaattcataagtacctttcacaatttaaaacttggctgggattctcaacatatcttatcaataatacatgtatacaatccaaaaggtgcagtggcttcttcattctgttccagaatggatcctatgaagaaatatacataatgaaatgtgaggcaaattgtgtcaattgattatttaaatcatttatactaaagtagacatcaggatccatgcaaaacttatcgctattaaaaagcatttaatatcacatggctactaaattatatatctgattatagttaatatttcaaacaacattaaaaacttattaattaacaacactatgatattacttaggaggcatatttgatataccaatctactttgcagagcatgtaaatgtcccgcttaggaatctgagataagagaaaaatctttctttctatgggttgtgacaccacttttactttgaacctatgcagatttagtctgacatcataaagagactaaactagcagtaacagaaacttaattctaggtctggcttcaccagttactagccatgtgacttaagcaggttatttaacatctctgctcttgttttttgcaatataagatggagatactacagttacctgctcatttccatcacaggctaatgttgtaaagcactgtgtgatgctgctataaaagacacaatctactttgacaagtttttatttggatcttttatccttagcataaaaattacaaaacatatagtctgataaggttcagcagggtgagaaggatctttaagcactgatattttagatgaggttatagtaaataaatacaatgtaatcttgttcttttaaagcaaatgatgattcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcaacagagcgagacgccgtctcaaaaaaaaaaaaaaaaaaaaaaataaagcaaatgatgattcttaatgtaatgagtttagcccacaccttggtttagcctctttcaccaagagtaaagcatatttattaatattcaaaaataatatttcattttaatcatgatatacaggaaagcaactctcattatcagtttaaaaagtcaaaagcataatttccaagactcaaccaagtgtaattagactaagtgataggatacaaaaatgcaatcaaaataccccactctatatctacaaagttactttaattaaagaaaataattttatgttatttaatattttccttacccgtgatttgaacaactgatcataaacttctagtagtctaggtaatggtactccaatttcattcattgtctgtattacgaagcccacatcccagttcaaagtacaaacctgctgttctaaaaactgtacaataaaatctgggaagaaaaaaaaagatcggaaatttggatttttagctcttgatactaaaaggtaggtcttattcataactgaatagtttctagggggatatcttctgaaatccaattgcaattttttggggcggggggttttttttgctatgttgcccagactagaaatagtggctattcataggagcaactacagtgcacgacagccttgaaatcctgagctcaatcctcccacctcaacctcccaagtaagctggggctacaagtgtgcaccatcactctcagcttaaaagaaaaaaaaagttttttttaaataaaagtaagatatataccagaacaggcaaatctaaagtagattagtggctgcctagggctggagggtgtgaaggaatgggaagtgacaactaatgagcacagagtttctttttgggatgatgaaaatgtcctaaaattaaaattacagaacctagaaaactcagaaagatataagaagaaaacagagacgattcacgatcccaatattgaagaggacttcactgataattttttttagtaacagtatttaaaaaaaataggtttcctgtccctgtccctctccctgtccctctcccctctttccaaggtctccctctgatgccgagccgaagctggactgtactgctatctcggctcactgcaacctccctgcctgattctcctgcctcagcctgccgagtgcctgcgattgcaggtgcgcgccgccacgcctgactggttttcgtattttttgggtggagacggggttttgctgtgttggccgggctggtctccagctcctaaccgcgagtgatccgccagcctcggcctccagaggtgccgggattgcagacggagtctccttcactcagtgctcaatggtgcccaggctggagtgcagtggcgtgatctcggctccctacaacatccacctcccagcagcctgccttggcctcccaaagtgccgagattgcagcctctgcccggccgccaccctgtctgggaagtgaggagcgtctctgcctggccgcccatcgtctgggatgtgaggagcccctctgcctggctgcccagtctggaaagtgaggagcatctctgcccagccgccatcccatctaggaagtgaggagcgcctcttcccggccgccatcccatctaggaagtgaggagcgtctctgcccggccacccatcatctgagatgtggggagcgcctctgccctgtcgccccgtccgggatgtgaggagcgtctctgcccggccaccccgtctgagaagtgaggagaccctctgcctggcaaccgccctgtctgagaagtgaggagcccctccgcccagcagccgccccgtctgagaagtgaggagcccctccgcccggcagccaccccgtccgggagggaggttggggggtcagccccccgcctggccagccgccccgtccgggaggtgaggggcgcctctgcccggccgcccctactgggaagtgaggagcccctctgcccggccagccgccccatccgggagggaggaggggggggtcagccccccgcccggccagccgccctgtccgggagggaggtgggggggtcagccccccgcccggccagccgccccgtccgggaggtgaggggcacctctgcccggccgcccctactgggaagtgaggagcccctctgcccggccaccaccccatctgggaggtgtgcccaacagctcattgagaacgggccatgatgacaatggcagttttgtggaatagaaaggggggaaaggtggggaaaagattgagaaatcggatggttgccgtgtctgtatagaaagaggtagacatgggagacttttcattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagacgcttgaaggcagcatgcggcagcatgcttgttaagagtcatcaccactccctaatctcaagtacccagggacacaaacgctgcggaaggcagccgcagggtcctctgcctaggaaaaccagagacctttgttcacttgtttatctgctgaccttccctccactattgtcctgtgaccctgccaaatccccctctgcgagaaacacccaagaatgatcaataaaaataaataaataaataaataaataaataggtttcctcactttaacagcttttcagaaaagggcaactgcatcctgatttcagaaatattaaatgtgttttttaatgccccacccctagatttatttgacagttctaactgtggcctcattcttacttttaactgcctatcttatcataaacagtaacagccaaatttatagttatggccaggcgtggtggttcgcacctataatcccagcactatgggaggccaaggtgagcagatcacctgaggtcaggagttcgagaccagcctggccaacatggtgaaaccctgtctctattaaaaatacaaaaaaattagctaggtgtggctaattcaagactagcttgggcaacaccatgagatcccttctctatcaaaagaaaaaaatatatatatataagtaaaacatagaaatcctcctaactcagcctgattagctaggactataggcacgtgctaccatgcctagctaatcttaattttttttgtagagacggggcttgctatgcccaggctggtctcaaactcctggcttcaagcaatcttcctgcctttgcctctccaaagtgttgagattacaggtgtgagccaccacacaaagcccacatgattatttctaaattaaaatgaaaattccttaaaaagaactatgtacaatacagtgttatttatttatttattgaaatggggtctcactgtgtcactgaggttggagtgcagtggttcgatctcagctcactgcagttttcacctcccaggctcaagtgatcctcccaccatagcctcccgagtagctggaaccacaggcgcatgccactatgcctggataattttcctatttttttgtagagacagggttttgccatgttgcccaggctggtctcgaactcctgggctcaagcgatccatccgcctcggcctcccaaagtgctgggattacacctgtgagccaccatgcccagccatggtgcagtgttttttaaaacaactatcaaaagtaccagtttcacacacttataaacatttatataaagtatgtatttgctcttttatttctctttatttttaggatcaataaaatggtatggaaagggaaccgtttccatattatacctacaaaagtaagggtatgaataaaatggttttatttctgactatgtccagagggaatagaccctaagtcagagatggtctgtaaacaagtttgaatgctcatttgaaaaaaaaaaaaaaaaaattaggctgggcacagtggcgaacgcctttaatcccagcaccttgggaggccaaggcaagcggatcacctgaggccaggagtttgagaccagcctagacaacatggggaaacctcatttctaataaaaatacagaaaattagccaggcgtggttgcaggcacctgtaatcccacctacttgggaggctaggcaggagaactgcttgaacctggaaggcagaagttgcagtgagccgagatggcatcattccactccagcctgggcgacagagaaagcctctgtctcaaaaaaaaaaaaaaaagttatattgtgaggattttcatgtctctcaatatttttaaataacacaaaagtagttgatattctaatttatggatgtatttatgttgcttctattgttttaccactgaggaaaacacttgtaggttggcaaatagctcataattagctaccttatttaaaaattatagccaccatatctcattaagaaagggattcaaacactaagttttaacataattatttgctattttaaagaaaaacatgccctcaacataaaaaaagaacagttgaatcaatcacagattacctatgcacaaaaacatcaaccgtttttcttttctcttcagaaacttgtatagggttaccaacaatataatcatagtttgtcagtcagcacaatcctaagacaggtaatataaacttggaaagttagtcacagaaagtttcatactcaactcttcattaacaaattctgccattctttggaagtctttccggagaggcagaattaaagtgctgaactaaatagcaaagaaactctttattttactcgaaagatcgttatttgtccatatcaacggagaaaaccatcagaacagaaaatacgtgactgcacctaagatcacagcttacctaaaggaaagaagcgtggtgtgccagcataaattttgccaaggagaacaatcttgagactaagagcatgcattctatccgaggagctcaatgtcacactgtcactcaattctgtaacaaaaagacatgtcatttgaaacccaaattacttttaatgtgaaatgtttacattggttatttaattctgtttcaaggttcaaaatactttagaacagatagtcacattaatatgattaacagatttggtgtttctgttattgtctgagatactctcatgtcttaccaggttatactggttattagattctgaggtgagtgtctcagtatcttttataaggcagcacaaataatataaattaaataaccttttcactgagtattctcccgaatattcacttgggtcattctgtgtatgatcatcctccaccatacccaggtgacttccacttactctcttcttaggtatacacaattttcatgagccactagcagcttgcattatattagttactagcagcttgcattcctccaccaagtcactacataacgtatgctaacatacctataactgaacacttacctttctctatgatatcttgccaaagtgtctgcaccaatatagggtctgaataaccggcacaatgaattattgcaagtttgcactctgcaagtttaaatgggtcagcaaattccccataaagctgtgagagaaaatcccaaaattaacatccaactagagatcaacattcagagattaatagtgaagcactccttgaaaattaaaaaataaccaaagattttacataaagtttctgaaatatgatataaagatgtgatgatgtatgtagctggttataactccatatttaaaaagttaagggtatgggccgggtacggtgactcaggcctgtaatcccagcactttaagaggccaaggtgggcggatcacgagatcgggagatggagaccatcctggccaatatggtgaaaccccgtctctactaaaatttaaaaaaaaaaaaaattagctgggcatggtggtgcatggctgtagtcccagctactcaggaggctgaggaaggtggaggttgcagtcagctgagatcacgccattgcactctagcctggtgacagagaaagactctgtctccccccgccaaaaaaaaaaaaaaagggtaagggtatggtaaatacattcaaacacattttagcatgtagagcttttttcttggctgggaagaagatgttgcaacgacattctatttattaattttaaaattcattttttcaaatttctgtgggtacacagtaggtgtatgtatttatggggtacatgagatgttctgatacagtcatgcaatgagaaataagcatgtcatggagaatgtctattcctcaagcagttatccttttgagttacaaataatccaattacattctctattttaaaatatacagttattattgactatagtcaccctattgtgctatcagataggtcttattcattttgtttttgtacccattaaccatccccaccttccctacaaacctcctgcaatggtattttagaactagtgttgtataaacaatgggttgaagaatcacaggaatactgacaaatctcaaagtgtttcagggtacctggaactatgtctaagaataaatgaagaggaaggaactgctcagaaaattacagagagagaaagaggtttagagagttaagcaaagataagttagtttttccaaggcaagaagcgaggccataaataagatggttttggttttttagtttttttttctttttgagacagggtctcactctgtcactcaggctggaatgcagtagcaccatcgaggctcaccacaacctgggcctcctgggctaaatcaatcctcccacctcagactcctgagtagatgaactacaaccacacaccaccacacctggctaattttttttttttttttttgatggagtcttgctctgtcgcccaggctcctagactgcagtgccatgatctcggctcactgaaacccccacctcctgggttcaagcaattctcctgcctcagcctcccaggtagctgggattacaggcgcatgccaccacgcctggctaatttttgtatttttagtagagacagagtttccccatgttgaccaggctggtctcaaactcctgacctcaggtgatctgcccgcctcagcctcccaaagtgttggattacaggcgtgagccacagtgcctggccttttttgctatttttttgtaaagatgaggttttgccatgttgcccaggctggaaataagctggttttaacacagctctcatgcgaggatgataggttctttgtagctactggcctggaaagagtagcttagcctttttctaggagtcagatgaagcagtggtgatctgtcagcccagtgacaagctgccaaagatgccttatcttatttgtggagataaggtaattttccccatgaaacaaaaagcaaaataaaaaacaaaaatttctcattattaggtaactactataaaaatttcacttgcttttttattaccttagttatgtccatcagctcagaatccagctgagaaactgcatcctgtacagaagaatgatgggaatactgcctttgtagtgtctcctgtatctgaagttggatcctagcaacctagtttgggcagaaaacaggatgtcttaatttatttatgataaatcaacatacgtttgaaagaacggatcctactatctgactttaagtttgctaaaataatgtataaatgaagatttctatcataataggctaatattatcataacagacatcaactaaacataatagatttcacaggaagtatactgtggcagactccttgctgcccaatacttataccttccaagactgtagccaaatggttagactatacagctcagcctcctctgtaggggaggtatggccatacaaccaagttctcttcaaaggaatgtgagtagaagtagtgtgtcatgtcagggctatagtttttaagacagtgaatgtgttctttcttttccttccaccctctgctgaagataaagcagaggccctagggaatggtagtgccagaaaatagaacttgggttcctaaatcaaccacacggaggaaagccagctgccaatcaggaagactcaccttggatttttgtgaataagaaacaaacttttgtatttggacgatggtatgtttttgattctcttagttagggaattttagcctactctacttcatacatctacttatttgcttccaaaataaatggtgaatgtgatgtaatccacttgctgttgaaacagttgggaaaaacatttattttttattattattattttttgagacagagtctcagtctgtctcccaggctggaatgcagtggtgcaatctcagctcactgcaacctccgcttcctgggttcaagcaattctcctgcctcagtctcccaagtagctgggactacaggtgtgtgccaccacccccggctaattcttgtatttttttaagtagagacaaggtttcgccatattggccaggctggtctcgaacttctgacctcatgatctggctgcctcggcctcccaaagtgctgggattacaggcgtgagccactgcacccagctgggaaaaacctttcgaagtgccaaagagaaaacttctaaattatagcaatgtttttatgacccaagtgcatccttaaaaatctttaagatttatatctaaacataaaaataaatataaacagacaaaagcaactagaataataatgacttctcagacctattacttaccaagggaagaatggaatgtggaataactatgtggctagtactcaatgtggacacagcttaagatctttagcacttacctccattttttcttctaattcatgaagaaattcaccatcggcagctattgatgaaatggcagtggaacttttggcactaagaatggctcgagcaatgtactctagtcgctgctgaagtgaaatttctgtgctagaagggaaaacgcttatttttagttacacaatttcttaaggattgatgatacaaatacgtcaattagtatgtactgtttcataccaaacacacataaaaagccatctgaaacttgaaaaaaaatcattagatttaaaaaaaaatctattttagatttctcataagagagatccacaattttagacaacacataaagaaatacatttatgactaaaaagtaacatcctatttaaaaaatttaggtcagtatattaaaacttagattcttctaaaattaaagaaaactgaatgtaagtacatatagctcagttttgaatcattcttcacaataagaatattatgccatacctatgcatgtcagccagtctggacagtacacgagcagcattactgaaacttctgttcttctcgtaataccgccagagtaaatccatataacgaactctgttttgatcaactttggccattcggactagatgtggctccagaaatggagaagcaacctagaaattatatagttattcagaaaaattttctaaccacctacagataatgttcctgataaggaaaatatagtatttttaagtcaactacaactttgccttgttttatgaaaacaagcaaaattataatccaatactaacagataaaagagagggcaaattttcttattataaacaatttttgttttaccacagttagcataagagtttccaaaacaattctattaggttgataacaataatttagtaggctgggcatggcgactcatgtctgtaatcctcgcactttgggaggccgaggtgggcagatcatgtgagctcaggagtttgagaccagcctgggcaatatatggcaaaacctcgtctctacaaaaaaattagctgggtgtggtggtgcgggcctatagttctagttactcaggagggttaggtgtgaggatcacctgagcctagggaggtcaaggctacagtgagccattatcgtgccattgcactgcacttcagcctaagctacagattgagaccctgcctcaaaaaagaaaaggaaatttggccgggcacagtggttcatgcctgtaatcccagcacttcgggaagctgaggtgggcagatcacctgagctcaggagtttgagaccagcctggccaacatggtaaaaccccgtctctactaaaaagatataaaaattagctgtgcgtggtggcgggtgcctgtaatcccagctacttgggaggctgaagcaggaggattgctggaacccgggaggcggaggttgcagtgagctgagatcatgccactgcactccagcctgggcaacagagccagactccatctcaaaaaaaaaaaaaaaaaaaaaaaagggaaatttactataaaattacaaatttttaaataaactttgataacacagctattgattcctagacattgagctcaaaggcattattgaaattatcaaatgctatgtattcattaaacagattgaggaacactgaaacttagggtaggtaaaaggacatatctgaagtcacagtgacttaacagcagagttaagataagatgacctacaggactcatattcataatccagtgatttctaccccgcaatacaaactatcccaatcagcttcgaattaacaagaaaattggagcagtagcctactttgccccttaggaaaagatactgcattactcagctttatactaacatctaatagcaggcatgggatgagaaactgaattttttacatctatatatgtgcttaaatcattgagttatgctccttaagaataattaacacaactgcaataaaaaaagatttacctgtagcagcttatctgcaaggtcgacttgtattagccaattataaagggcaatactaaagagctcatccttggatcgctgtgacaatttaagcatttgttcaaactaaaataaagaaaatagtaaaaattagcagttaaaggctctgtttctgggcatcacaaccctttagccctataaactccagtaagaaatcaagaatccttacatgataacttctaagaactaccacctttccccaagatgactgtgctaccattaccatggagaacttctaaacagtgtattctcagaatgaaaatatactatgtcccttacatgatgtcctgcttcttcattactcagcatatttggatcagatgacaacactggaggaccaggttttttgggtacactgggagactgaggagcggccttactttgatttaccagttcttgaagtgtgtctgtaatgcatttgtaactgtttaatctgaaagaaaatggaaaaggaacaattacattatttaactagaaagcaaatgatggtaagtgtggtgactcacgcctgtaatgccagccatagggaagtcaaggtaggaggacggcttgaggctgggagttcaagactagccagggcaacagagcgggaccacgtctctacaaaaaatacaaaaaaattggctgggcacagtgcctcacacctgtaatcccagcactctgggagacgaaggcagggggactgccagaggtcacgaatttgagaccagcctggccaacctggtgaaaccccgtatctgacaaaaatacaaaaattagccgggcttggtggtgcatgcctgtagtgccagctattcaggtgagtgaggcacaagaattgcttgaacctgggaggcagaggttgaggtgagctgagatcatgccactgcactccatcctgggtgacagcaagaccctgtctcaaaaaacaaacgaacaaaaaacaaaacaaaacgaaacaaaaaattaaccaggcgtggcggtgtgcacctgtaatcccagctacttgggaggcagaggcaggaggatcgcttgagcctaggaattcaaggctgcaagtgagctattatcatgccactgcactccagctcaggcaacagaatgaggccctgtctcaaaaacaaaaaacaaaaccccccaaaaacaaaacaaaacaaataacaaaaaagaaagccattgatttaccttacctaagtatatacaaggatttcaagactatttggcagaatagatgtacatatttggcatttaaaataatacaaaccatatactttttcaataagtttgagaagtgtttggttaaacattaaaagggtaaagtcattaaatatagtaataaaaaaatatgttttcgccagatgtggtggctgacacctctaatctcagcactttgggaggctgagaagaaaggattgcttgagcccaggagttaaagaccagcctgggcaatatagtgaggccctgtctctacagaaattaaagagaaaaaaaaaattagccgagtgtggtgacatgtgcctgtagtcccagctactcaggaggctgaggtaggaggatcactggatcacttgagcccaaaaggtcaagagtacagtgagctatgatggtgccactgactccagcccaggagacagagtgaagctttgtctcaaaaacaaaaacaaaaacaaaacaaaacaccctccatatatatatgttatagaaaggttatatatttcttctttgttccgagacggagccctgctctgacgcccaggctggagttctgtggtgcaatctcagctcactgcagcctctgcctcccgggttaaagcaattctcctgcctcagcctcccaagttgctgggattacgggtgtgcaccaccacgcctggctaatttttgtattttagtagagacagggtttcactatgatggccaggctggtctcgaactcctgacctcatgatctgcccacctcagcctcccaaagtgctgggattacaggcgtgagccactgtgcctggcctatatttcttttaaggacacacatttcctttttaacagtctcaacaaatttgggaatacttaaaaattatcctttaaaatgaaatcctactggacatggtggctcatgcctgtaatcccagcactttgggtggtcgacctttacacaaagaggccagacacggtggctgatggctataatcctagcactttgcaagactgaggtgggtggatcacttgaggttaggaattcaagaccagcctggccaaaatggtgaaaccctgtctctactaaaaatacaaaaattagccaggcgtggtggtgtgcacctgtaatcccagctacatgggaggctgaggcacgagaatagcttgaacctgggaggcagagattgcagtgagccaagatcacacgactgcactccagcccaggtgacagagcaagactctgtctcaaaaaaaaaaaaaaaacataaaacaaaaaacaaaaaacattatgcaaagaaaagtctgtatccataaagatgacaatctgctaacgtaatggaatgcacctttcttggaaggcctgaagtccaactatgtcttcttctggttctccatgtttatagaaatgaagcccaagaccttgaggatcttttttctctgcagccgtaagagaaagttccaccacaccctcataaaatctcactgatgggaaagaaaagaatgaagacctatgacttactactaagttggatacatttttccttagctggcacatgaaaataatgatcaaggttatgtctctactgtacaatagtcaccctgctaacataaaatatttctgataggtcttcagaaggaaaaggtcttaatatgcctaaaaggcaactgttaaatatatttcttcattgggggccaggtgtggtggctcacgcctgtaatcccagcactttgggaggctgagagggggcagatcacaaggtcaggggttcgagaccagcctgaccaacatggtgaaaccccacctctactaaaaatacaaaaattagctgggcctggtggcatgcgcctgtaatcccagctactcaaaaggctgaggcaggagaatcacttgaactagcgaggcagaggttgtagtgagctgagattgcaccattgcactccagcctgggtgacagaacaagactctgtctcacaaaaaaaaaaagaaaaaggaaaaaaaaaaatatatatatatatatatttcttcattggaaaaaaaagatcctatttcaaataacaaaaaggaaagttttagttccctactggggggaaaaaaataccttgggattcaaaataatacctgtgcaaatagttatggcctttacattatgttagatttgatttaaagtaattttttaaaaagtaagcagattataccttaaaactcaataaaaaattttaaatatctgaaaaataaatgtaatccagaaagcaatgtaaaacatacagtaattgaactggacaagaactgaaactctaatgctaaaaagttatacatttcggctgggcgcagtggctcatgtctgtaatcctagcactttgagaggctgagatgggtggatcacctgaggtcaggagatcgagaccaccctggctaacatggtaaaaccccacctctactaaaaatacaaaaattagctgggcaatggccgggcgcggtggctcacacctgtaatcccagcgctttgggaggctgaggtgggtggatcatgaggtcaggagattgagaccatcctggctaacatggtgaaacccatctctactaaaaatacaaaaaaattagccgggcatggtggcaggcgcctgtagtcccagctacttgggaggctgaggcagaatggcgtgaacctgggaggcagagcttgcagtgagctgagatcgcaccactgcacttcagcctgggtgacagagcaagactctgtctcaaaataaaaaaaataaaaaaataaaaaaataaaaaattagctgggcgtggtggcgtgcgcctgtaataccagctacccgggaggctgaggcaggagaattgctggaacctgggaggcagaggatgcagtgagctgagatcgtgccactgcactccagcctggctgacagagcgagactctcaaaaaaaaaaaaaaaaaaaaaaaaaagtacatttcaaaaaatagaaagaacattacagcttctgcaggtcagtgtagtcatcaaatattgcaacacaatgataccacattcctacgtcctttcactcggcctctgatgctgaaagaagatttgcatctggaaagtggcttttcatcattagcttgcttcattcatacactattgtttgtcttttgagttgagtaaaagatacaagaaacattttatttctcaccttgtctatactgagcacaaacattggaaaggtccacttgattgctaattttttgatattcctttaatgattcccttaacattctttctttttcagtcttattttgaacttgtcgggaacgctggagaagctcatttgcctagaagaggagataacaagaacttaaaaatatataaaatcaagcagacagatgatgctgtcaactaagttttagtctatgtctaaatttatatatggttattaccattaaaatgaaaacaactctacaaacttacttcttaattttaggcagaaaagtttttgaccaaagattcctagctattcttaattcctctcccaaatatgttaagcaagagaacttttgtctggtaattctcttgcctagtcaatacattattgggcagcaggcagtccatgtgacactgatttatttattttttccacctgtaggaaaggatcaataaaaatgcccccattaactctaattcactaaaagatttacttgaagttttagtacttttccttaagctaaggagataaattatcccctaaatttccttaatttctaaatttagtgatttttcttaatttctcacctttggttttttaatatggcctagaaacactatcaaagattctttatgggccaggcgcagaggctcatgtctataatcccaacactttgcaaggctgaggcaggcggaggtcaggagttcaaaaccagcctagacaacatggtgaaatcctgtctctaccaaaaatataaaaaattagccaggtgtgatggtgcacacctgtaatcccagctatttgggaggccgaggcaggagaatcacttgaacctgggaggtggaggttgcagtgagctgagatcgtactcagtcttaaaaaaaaagagagaatattctttatgaaaaacttaaaggagggctgggcatggtggctcacacttataatcccagcactatgggaggctgaggcaggaggatcacttgaagccaagagttcaagaccagcctgtgcaacaaatcagaacttgtctctataaaaaacaaaaaaattggctgggtgtagtggtgcacacccgtagcccctagctacatgagaggcctgcttgagtctaggacttagaagctgctgtgagctatgatcacagcactgcactacagcctaagcaacagagtgaaaccctgtgtcaaataaataaataaaaatatttttaaaaagaaaagctaagcttaaaagagtatacactggttttaagaagccacatattccaacccctttcttagatgaggattctgaggctaggagaggttaagagatctaactgactgaggtcctatattaagtgaaacaagatggttcatcatacatgatacctcttataacaaacaatgaaataggtaataaagtatcataccttagaacaaattgcatcatcagtgctatatagaagtgggcagatatcctgtaaatgtaaactaatgccatcaacagcggcattatctctgatgtagcagttgataagagaagcaattaatgcccctgtgagttctttgtccctgattacaagatctttaaaggtggtgatcttcagctgctcttgaagttcctaggagcataaaacttttctatcacaattatagaaataccatatttctaaacataatgaaattattttaataaattaaaataacctaaatattaatagactctataattgaaaagcgaaaatatactaattagtagaaacaaatttttgcgaacttacataaaatcatagagagttggaaaagaacctacagtagatctagtccaaaactctcactttccaaatgagaaaagtaaagcttaagtagagccaaaactagagtcagatctcctggctttggttataaaatggaaaaaacaatcacttggctatatttgaaaatcttgggcttacatattactccttcctaaacactgttagaattccattattctaggccttataataatattggagtttaatctgtattgtgaacaaatctgcttgtccaaatgaagctctaaagtattgatttatactatagtaaaagattctgttagtgatgtgactgctatctcttttttctaaattcaaggaaatacccaaactgtgttaaaattcttgaacaaatctttaatttgcattcattgagcatgccattggtgatgtaaggaagagagctttgaagatggatcacaaaaacatacccaggataaaaacctacctacaatatatttatcactctataaaactcaaaattattattctacttggtatgaaaaagataagtttcataattaaatatattagcttgaatttttaaaaataaaaaacagtatgtatttaaaagaaacaaaaccaccaacaaaagccacactattcattggacactagtggaaagaatgaggagactgccttccaacgttgaaaaatggtatacgagagtcaaaaagtaagtgtttcagagtaatgaaatatccatacaggacaaggaaaaagaatttttttttttttttttacagaattgcagctagtaactggggaaggaatcacagatttaaaatattatccttttggccgggcatggtggctcatgcctgtaatcccagcactttgggaggccaaggcaggtagatcacctgacgtcaggagttcaacaccagcctggccaacatggcgaaacccggtctcttactaaaactacaaaaatcagccaggcgttgtggcacatgcctgtagtcccagctactcgggaagctgaggcaggagaactgcttgtacccgggaggtggaggttacagtgatctcagattgctccacagcactccagcctgggtgacagaatgagacactgtctcaaaaaaaataaaaaacaaacaaacaaataaataaatattacccttttgtaatcctaaatgaaataataaattccagcaatgattatcaatggatgattaaaatctgatggagaattccacaatggcagtattaggcttactacttgaatccagcaatttatcttagtataactaaaagaaggacaacgaaaccttttgtatcttctaacagtctgatgaataaaccactacctatgaagtattctattcttcctcaaaaaaggacctgaactgaatcaagcctatataataaactttcattttatagaaaatgcaggagatagaggaagaagctcgctacaaagaggattaaaaaaaaaaaagccttagaatgtccttagaatgctggacattctactggatggatgactggatttctacaaggcaacagcaaggaaaagaaaaagaaggaaagactgctttagactgaaacagatgaaagagaaaaacaaattccatgagcaaaccccttaaactgtttagatcctgatttgaatgaaccaatctgtaaaaagacatttttaagacagattttgctatcaaatattgacagttaatattggtaactatccagcctaggagatacggtgaaaccccatctccacaaaaaaatacaaaaattagctaggcgtagtggtgcgtgcctatagtaccagctactcgggaggctaaagtaggagaatcactggagtccagagaggtcaagggtgcagtgagccgtgatcatgccactgcactccagcctgggtgacagagcgagacactgtctcaagaaaaactggtaactgatcatgacattgttgttgttcaaggaactgtctattttttttagaaacacagtatcttgaaaatgctgaatgagtcaaatgtatatgggagttacagtttttgctctacttttgtatacgtttagaaatgctcacaattaaataaaaggtaggaataaatttcctctatatattctatctaacatttagattaatgttgattatccttatccttagaaaggattcaaatgtgaacatcaaaagaaatatgaaccatttatttcctacagtgataaatatcttcctttaaagtaggagcagttgccgggcatggtgggtcacgtctgtaatcctagcattttgggtggctgaggcgggtggattacctgagctcaggagttcgagatcaccctgggcaacacggtgaaaccccgtctctactaaaatacaaaaaattagctgggcgtggtggcatgcacctgtaatcccagctactcaggaggctgaggcaggagaattgctagaacccgggaggtggaggttgcagcgagccgagattgcacaactgcagcctgggcgacagagtgagactccatctcttaaaaaaaaaaaaaagaaaacataaaatgaagtaggagtggtgtatatgtgtgtgtgtgtgtgtgtgtgtgtgtgtgtgagagagacagagagagacagggtctcactctgtcacccaggctggggtgcagtggcaccatcatggctaagtggcgcctcaacctcccaggctcaagtgctcctcccacttcagcctcccaagtagctgggactacaggcatgtgccaccacacttgactaatttattttttatttttagtagagatgggtcctgacatcttgcccaggatagtcttgaattcctaggctcaagtgatcctcctgcctcagcctaccaaagtgttgggatcacaggcgtgaggcatggtgcccagtcaagagtatttaatttaggttgttgggccctttgaaattataagcaaaagtctgtgtgtccatgtcgatatgcatttctttaagggtagtgagagatagcttttatcagattctcagaagaacctgtagctcaaataaagggtaaagtccactgttttaaaaaatatgttttgtaaagtatgacttcattcacatacccacaagtaaaaacttgcggctttgaaaaaataggtcccccaagttggtacgctttttttgtgccatcttcccataacatactaacttcatcataacttaaatgcttcccaaaataatcccctccaaagccaaaatactcatccaaaaaatccaaacatagtattaatggtataatcataaaaaaataaaaaaaattaccttctgaagttctgccacaatgatagtgaattgatgttcacaaagaagtttccataaagccagagcctgatatgattttcgaaccaactgctgaattgcctgaagtgaaatcttttcacttagttgagcctctaatgagaaaacaaaataaattattataaaataacataggttaagttgctttatttcaaataaaaactgtagttaaggttgaaatccctgttgttttcttcctagcccccattacaggcaaccatgataatcagtagtatttatgttattatcttctccgtgtgtgtatatatatatgcttctgtgtttgtgtaggtacacataaaccatgaaaatattgctgtgtggctgggcgcggtggctcacgcctgtaatcccagcactttgggaggccgaggcaggtggatcatgaggtcaggagatcgagaccgtcctggctaacacggtaaaactcggtctctactaaaaacataaaaaattagctggtgggggggatggcgggtgcctgtagtcccagctacttgggaggctgaggcaggagaatggcgtgaacccaggaggcggagcctgggcgacagagcaagactccatctccaaaaaaataaaagagagacaaaaaatttaaaagatagtaaaaaagaatttacaaaatgatgaatagaaacctagggtcctcagtagggaagaaagtaacttgggacaaaagtaaatggttgagtgttaactgagaaagttctactggccaggcgtggtggctcacgcaagtaatcccagcactttgggaggccgagttgggcggatcacctgaggtcatgagttcaagaccggcctggccaaagtggcaaaacctcatctctactgaaaacacaaaaactagatgggtgtggtggcacacgcctgtgatcccagctacttgagaggctgaggcaggagaatcgcttggacctgggaggtagaggttgcagtaagccaagattgtgccaatgcactccagcctcggcgaaaaagcgagactccatctcaaaacaaacaaaccagaaagttctatcacggccagaaaaagtaactctaaccctaacaatggaaggcaaaagaacttagaaaaaattaaatggcacaaaaagttcatgcaataacttattattgttctaacttgtatctggaataactgaagattatgagaacttttcagttgccttgctctttccttacttgttactacttataattgataaaaagcacaatgaaatatttgattcatatttttagctctataaaaaggcatattactaatcattagggaaatgcaaatcaaaatcccaatgagatgccattccatgttcattaggatggctatatataaaaggacagaaaaatgacaaatgttggcaaagatgtgaagaaattggaacccttgtgcattgctactagaagtataaaatgctgtggctggccaggcgcagtggctcacgcctgtaatcctaccactttgggaggccgaagtgggtggatcacctgaggtcaggagttcaagaccagcctggccaacatggtgaaaccccaactatactaaaaataaaaaaattagctgggtgtggtgacacatgcctgtaaccacagctactcgggaggctgaggcagaattgcttgaacctgggaggtggaggctgcagtgagctgagatcgcaccattgcactccagcctgggagacaagagtgaaactccgtctcaaaaagaaataaagataaacataaacataaaatgcagtagctgctatgaaacagtatggcagttcatcaaaaaaattagtaatagaattaccatatgatatagcaattccacttctgggtatatacccaaaagaactgaaagcagaggctttaatttgtatttgttcacccatgttaatagcagcattattcacgatagccaaaaaacggaagtaactcagtgtccatcaacagatgaatggataaaggaaatgtggtatatgtgcacatatgcacatatacacaatagaaattactcagtcttaaaaaggaaggaaattctgacacgttacaacatggatgaacctcgaggacagtatgctaagtgacataagcctgccacaaaatgtaaaatttgatttcatcctaatagggtacccagagttgtaaaattcaagagacagaaagtagaatggtggttgccagggacctaggataggggaaaaaaatggggggttattatttcatgggtacagagtgacttttggtgtttattttttttaagacagagtcttgctcttgttgcccaggctagggtgcaatggcacaaattcggctcactgcaacctccgcctgctgggttcaagtgattctcttgcctcggcctcccgagcagctgggattacaggtgcccgccaccacgcctggctaatttttgtatttttggtagagatggggtttcaacatgttggccaggctggtcttgaactcctgacctcaggtgatccacctgccatggcctcccaaagtgctgggattacaggtgagagccactgcgcccagcccagagtgacatttttggggaagatgacaaaagttctggagatagatgctggtaatgggtacataaaatgaatatactgaatgccactgaactgtacacttaaaaacagtaaaaacgggccaggcgcagtggctcttgcctgtaatcccagcactttgggaggctgaggtgggcggatcatgaggtcaggagattgagatcatcctgcttaaacacggtgaaaccctgtctctactaaaaatacaaaaaaaaaaaattagccaggtgtggtggcgggcgcctgtagtcccagctactcagaaggctgaggcaggagaatggagtgaacccgggaggtggagcttgcagtgagccgagatcatgccactgcactccagcctgggcgacagagtgagactctgtctcaaaaaaataaataaataaataaaataaagtaaaaatggggctgggcacggtggctcacatctgtaatcccagcactttgggaggccgaggcggacgggatcacctgaggttggaagttcgagaccagcctgaccaacataaagaaccccgtctcttctgaaaatacaaaattagccgggcgtggtggcacatgcctctaatcccagctactcgggaggctgaggcagaagaatttcttgaacccaggaggcagaggttgcagtgagccaagatcacgccattgcactccagcctgggaaacaagagtgaaactctgtctcagaaacataaacaaataaaaagtaaaaatggtaaattttatggtatatatatatttcaccacaataaaaaaaacataatgaaataggtgtgtatcatgttttctggtggaggaaggaacaaaaatgtatatgctaaaagagatagggaaatatacaatatccatattaatatccatattatcctactttcccaatcacactttttttttttttttttgaggcaggttctcactctgtcacccaggctggagtgcagtggcatgatctcagctcactgcaacctctgcctcccaggaagaggtgatcctcccaactcagccttccaaagtgctggtattacaggtgtgagccaccaccccggacccaattacactgatattttaattacaaatatttgtgtacaaagtacatcttactaagaaagtccattgttttctattcaagtaataaaattttactgaggtcatgtacgcttaactgatgagaagcaataatttaccatgaaacttcctctgcagttcctgttgcatttgctggggatttccgttttcaggacgcatgaatcctatcagcctctgctgcactttagcagtagtactgaaacagaaattgcagaatgtgtgtgtttataacagctttattgagatataacacatacagtacaattcaaacatttaatatgtttactttttttaaataattcagaaggttgggcaaccaacaccagaagggctgatggccagaaaaaatttatgacacagactaaacagatgctacttaaaatgactgagattaaatcaattaaatgactgagaacatcagctataaattttcctaacctgtagaaaaaaaaagatcaagtaaaaagagggggtaaaggagagaaaggaaggaaggaaattacggaagagaagaaacaagctagatacaaaagagttaatatgattctccaaagagaatgggacagaagaaacatagattgagtatccctaataaaaaaaaaaactaacatctgaaatgtccccaaatctgaaacgttttgcacatcagcatgatgctcaaaggaaatgcgcactggagcaatttcgatttcaaattttcggaatggggtgctcaacctaagtataatgcaaatatttaaaaatcaaaaaaaacgtgaaagccaaaacacttctggttccaaacagttcggataagggatattcaatgtgtatcacaatacataaaaaacgagagaagaaaactgatcaaagccaagacgttcattcttaaggctcactgagagctgtaaagaagatatacctaaagacatcatgtgacttttgaatttcggtaacaaaaagaaaaaaacacaaaaaaatttcaaagtaaacactaagtcacttacaaaggaaggagaatcatacagataatgtactttttcatctacaacattaaactttgggaagaaaatggtgcaaaatgtatacgaagatctgagaaatggtctatgatcttaaaatcccacattcattgggcaataaaaacgaacaaagcatgaatacatcctaccacataaatctcaaacatgagcccccaaaacacactaagtgaaagaagccagactcaaagaccacacagtatgattctgtttatatgacatgtcaagaataggcacatctacagagatagagcagatcagtaagtgtctggggctaagaagtgggaatggaaagtgactgctaatggacatgaggtatgtctcctagataatggaagtgtgctaaaactggactgtggtgatggttgcacaattctatgaatttactaaaagtcactgaactgaacattcaaaatgagtaaatttagtggtatgtaaagtagatctcaaaaatctgtttaaaaaatttccatagtcaatgaaactaatgttataggaatccaagggttggtcgaaattaggacatgtattaactctattgttaaaggtaagggggaaaatgatatgatcatctctgtaaaatgcagtaaatacatttgacaaactcacttattgaatatggtaagcatattcaatatgttaaatatatgaatatgttaaacatattcaataagggctgagtgcggatggctcatgcctaaaatcccagcattttttgaggccaagacaggaggatcacctaagcccaggagtgcaagatcaacgtgggcaaaacagtgagaacttgtctctacaaaatgtgaaataaaaaaattagctgagcatggtagcatgtgcctgtagtcccaactactcaggaggctgaggtgggaggatcacttgaagctgggaggtcaaagttgcggtgagccgtgatcatgccactgcactccggcctgggcaacagagtgagaccagtctcaaaaaagaaaaccaaaaaacacctcaagtaagggtggatgcagtgggtcatgcctgtaatcccagcactttgggaagctaaggagggagcataacttgaggccaagagttttagaccagcctgggcaacacagtgagaccctatctctgagaaaaataagaaaaaatcagccaggtgtggcagcacatgcctgtagccccagctactcaggcggctgagtctgagattgcagggaataatgatcacatcactgcactccagcctcaatgacagagcaagattgcctaaaaaagaaaaaaaaagagaaaagacagacagagataagtggcagggcgcagcggctcatgcctgtaatcccagcactttgggaggctgaggcgggtggataacctgaggttgggagattgagaccagcctgaccaacaaggagaaaccccgtctctactaaaaatacaaaattagctgggcgtggtggctcatgcctgtaatcccagctactcaggaggctgaggcaggagcatcgcttgaacccgggaggcggaggttgcggtgagccgaggatcatgccatcgcactccagcctaggtaataagagtgaaactctgtctcaattaaaaagaaaaagagagagagagagattaccttgtgcagagaggagaaagcaagtagagctagacaagaaaagatggaaaagatgaaactatctctgtttgcagatgacagaactgcttctgtgacaattcaagaaacatcaatgaaaaaaacatcctgctaaaaactgtaaagataaatgagtaattaagagaaattagaagtagattagaaaatttacatataattgcagatgtaatggtaaaattcaattaacaaaagaccataatgttagaaaaaaaaccaaacaaactaaaaacatctgacaagtaaaattccagataatttggagggagagggatggcagtagaaggcaaggaaacaaaatgtaatagagtttgttaaattattaatgctgactgagatgcatgtctgtcagaatttaagactaacagaggaagaaaaatcatatgtagaacttcttaattggtgtttaaggtagagagaggcctgatcaatccaatacaataaggaaatgggaaagggaagaaaataaacaaaaagcacaaattcaggatggggagaaaaaaatcaaacatttaactagaccagatgcagtggctcactcctgtaatcccagaactttgggaggctgaaggtggattatctgaggtcaagagttcaagatcagccttgccaacatggcaaaaccctgtctctgctacaaatagaaaaattagccaggcatggtggtgtggggctgtagtctcagctacttggaagggtgaggcaggagaatcgcttgagccagggagttggaggttgcagtgagctgagattgcaccactgcattgcagcctgggcgacaaagcaagactctgtctccaaaaaaaccaaaccaaaacaataaaccacatttaactaattccaataaaatgggaaggaggtaaattctcctgcttaaaagataaagacaggccaggcgcggtggctcacccctgtaatcccagcactttgggaggctgaggcgggcggagcacgaagtcaagagatcgagaccatcctgggcaacatggtgaaaccccatctctactaaaaatacaaaaattagccaggcttggtggcacatgcatgtaatcccagctactcgggaggctgaggcagaagaactgcttgagcccaggaggcagaggttgcagtgagctgagattgcaccactgcactccagcctgggcaacagagcaagactctgcctcggcaggggcaggggaatatatatatatatgtatacacacacacacacaaagtatgaataatgttatataaaagtgtacttacttagactctgtttttgcttttaaagaagtgtatatttatgtatgctttattatttatttatgatatttttttttgagacagagtttcactcttgttgcccaggctggagtgcaatggcacgatctgggctcaccgcaacctccgcctcccaggtttaagtgattcgcctgcctcagcctagctagtagctgggattacaggcatgtgccaccacacctggctagttttgtatttttagtagagacgggtttttccatgttggtcaggctggtcttgaaatcccgacctcaggtgatccgcctgcctcagcctcccaaagtactgggattacaggcatcagccatcacgcccggcctatttatgtgtttttgtagtgacaaggtctcctatattgcccaggctggtctcgaactcctggcttcaagcaatcctcctgccttggctttccaaagtgttgggattataggtgtgagccactctgcctggcctacatatgctttaaaaagattatactgtaatacctcgttaacaattctaaggagtgatgtgactcccccaatgccatgtgattattatttttcaacaaaaagtccgtattatattagaggcttaaaaatatccattcttggctgggcgcggtggctcacgcctgtaatctcagcactttgggaggccgaggcgggcggatcacgaggtcaggagatcgagaccatcctggctaacacggtgaaacccagtctctactaaaaatacaaagaattagctgggtgtggtggcaagcgcctgtagtcccagctactcgggaggctgaggcaggagaatggcatgaacccgggaggcggaggttgcagtgagctgagaccgcaccactgcactccaggctgggcgacagagcgagactctgtctcaaaaaaaaaaaaaaaatccattattgctgggcatggtggatcacctgaaggtggtcaggagtttgagaccagcctggccaacatagtgaaactccatttctactacaaatagaaaaattagctgggcatggtggcaggcgcctgtaaccccagctactcaggaggctgaggcaggagaatcgcttgaacctaggaggtggaggttgcagtgagccgagattgcaccattgcactccagcctgggcgacaagagcgaaactccgtctcaaaaaaaaaacccaaatgtccactcttggtcgggcatggtggctcacgcctgtaatcccagaactttgggaggctgaggccagtggatgatgaggtcaggagttcaagaccagcctggtcaacatggtgaaaccccgtctccgctgaaaatacaaagaagaattagctgggcatggtggtgcacatctgtaatctaagctacttgggaggctgaggcaggagaattgcttgaacctgggaggcggaggttgctgtgagccaagttggagccttcgtactccagcacgggtgacagagcaagagtccgtctaaacacatgtccacacaaaaacttgtacaggaatgctcatatcagcattcttattagccaaaaagctgaaacaacccaaatatctatcaactgataaactgagaaatgagacaagtagtaatacatgctacaacaatcaaaccttgaaaacatgcttggggaaagaaacagacaccaaaggttatctgttgcatacttccatttatataaatatttctataaagattccatgtatataaatatgtctataaatattccattcatataaatatttctatattccatttatataactatatttctataaatattccatttatataactatatttctataaacattccatttacatatattcatataatatatttatatattgtgtatcttatgtaatatataaaatataatatttatataaatagtcagaaaaggcagatctgtggagacagaaagtagattagtggttgccagggactgggggaaggtccatgaataataatggctggtcatgggcacaagagtttcttattgctgtgatgaaaatgttctaaaattagatagtggtgatggttgcataaccttgtagatacactaaaaaatactaaactgcacactttaaaaggaccaactttgtagtatgtaaatcatctcaacaaaaaatacaacgaaaagaaaaagatgaattaataaaccctatttattcttactttggatttcctaatggtcctcctgcaaactgggagtttctgtctagaaattcctgcaaaccctttagttcttgtagcactgactctagcagttggcagggaacactactttcaatctgtaaaaatgaaagatttttcaaaagtttaaaaacacaccctctgtatagctataatataaacaattttaattttgaaatgagtatctctatagttatttcttgtatcaattcacacctgttgatccgaataaagtatacctacacacttcctctcctgccagtaacactgatgcataactaacatacaataaaatacaaatactaagaaaacatcttgattacttttatatatttttgtatagtcatcacccagaccacaatacagaaatttccaacaccaaagaaagtttcctatgttcctttgtagccattagtcatcccacctctgaggtaactacttttcttactcctatcaacatagattaattttacaagtttttagacttccatatatatatatggaatcatatactgtgttaggcaaatacactcttattcttagaaacttgaacttttttttttttgagagacagcgtcttgttgttgcctgggagtgtagtggcgcggatcatatcttactgcagccttgacttcctaagttcaagtgaccctccttcccaattagctggaagtaccagcacatgccaccacatatctgactaattttaatcttattttattttatagaaaaggcatctggccgcgttgccctggctggtcctgaactcctgggctcaagccttccaaagcattgtggttacaggcacgggccactgtgcccaactcatgaactttaagagcctcacaattaaaaatatatttggactgggcgtggtggctcacgcctgtattctcagtggaggccgaggtgggcggatcatttgaggtcaggagttcgagaccagcctggctaacatagtaaaacactgtttctactaaaaatacaaaaaatcagctgggcatggtggcgcgcacctgtaatcccagctactcgtgaggctgtggcagaagaatcgcttgaacccaggaggcaggggttacgatgggccgagataatgccattgcacaccagcttgggcaacaagagtgaaactgtgccactgcactccagcttgggcaacaagagcaaaaagcagtctgtaaagtatgccaattcatagaaattagtgctgggtccatggagttttcgttcatatatatgtcaaagtattacatagtaaaatttgagcaatattaagttgcttgagttatccctcatgacaaccttatgagggagatatactacgccccttcttttaccatgaggtatcaggctctgaaatgttaagtaatttactcatattcagacagttaatcaatgttagagatgagatttaaacctgaaggtaagcagtttgttgtccaagaatgcaaacatatacataaaagaataacccgccaggcgctgaggccccctgcctgtaatcttagcactttgggaagccaaggcaggtggtttgcttgagtctaggagtttgagactggcctgggcaacatggtgaaaccctatctctacaaaaactacaaaaattagccaggcatggtggcgcacacctgtaatcccaggtactcaggaggctgaggtgggaggatcgcttgaccccagagggcagaggttgcagtaagctgagactgggccactgcactccagcctgggagacagagcaggactctgtctcaaaaaaaaaaaaaaaaaaaaaaataacctttgccatcttatttgtgtaatatcaggaaatgtgaaacaatctaaccatttataccatcaactggctacacaaaaataacaaaataatattatacacacttactgcagtgatctctctgttgccactcttgaatattctctccacaactaagcttgcatcccaaatgtttctggaaaaaaaaaagttttaatgattgtgctgtaaatgaataaaaacaattacaataaatttctttctctaggaacttaatggctttattcagtttttaaaacttgcagtggtttcatttaacattttactaagctatctagaagagtggaatactagaaaattttcatacctgatgtacctaagtttttcagataatgaaatattactgaagaaaaatcaaaaggctctgtataataaattgtaaacaggaaatttataaaggggctctgtactgtttcatacttttaagcaaatgagatgaatgaaatcatacatctcaaatctaagagaaatatatattaggcatgatagctaactaagataacatgatagactgattgcaaaaacaaccacatttctttatccctccctatatctatcccctctgcagtatgatttgatgtctctcccctaaaaggtggtctatttcccaccttttaaatctgagttggccctgtgacttccctctggccaagtgaataaggcggaaaagtgcatggtaagccagttctgagtttagaataaaggttttgcaagtgtctactctttctcaaggaactctgccaccaccaactaaataatctttggctggcctgctgggggatgagaaaccatgtagagaacaaccaagctgtttcatcttgggccattctagaccagctggaaaatataaccttgaacatgtgagagtctagccaagataagcatagctctctttaacttcacaactgattgcctattcttgagttagcccagcaagacaagaactgccctgttgaactgtagacacatgtcactgagttatggggaagtttgtaacactgtacattcatatgtaagtagatatacagttgacctttgaacaatatgggcttgaattgtgtgggtccacttatacacagatttttttcccacctatgctaccccagcacatcaaaaccaacccttcctcttcctactcctcagcctactcagcgtgaagacaaggatgaagacttttatgatgatccattgccacttaatgaatagtaaatatattttctcttccttatgattttcttaattttttttctctagcttactttatggtaagaatatagtgtataacacatataacacaaaatatcagtgttacggctgttttagaatttgtctagcaggttttctggtttttacgagactcccccatactcctacaccatgcaaaagttaaaaaaagaaaacacaaaaaacatacaaaacgtgttaattgattacttatcagtgaggcttctagacagtaggctattagtaattaagaaagtcaaaagttgtacatgaatttttgactacatgaaggttgaggaatggtggttggcatcccctaacccctgtgttaaggaacaactgtattttgatgctacaaaaatagattatgagagagtaagagaaataaaacacagcaatgaatatagttagataacaaaaactggaataatagaaaagttttattgatcaacaagtgagctaaaactaaaatttaataggaataaatgatgtcccaaattcagagttaaaaatatttaactactcaagatgggacaaggtgagcaataattcattatttcatgacaaacttaccccatgatccgagaaaagtaaatgcaaataccattgtgttttccagagtacacaatctctggtccagtcacacaactcatatttgtggcctgagttgctgggtttcccagagcacacactggagttgacatggcaggaggctgtataccttgtacacacataagaaaaacaaatctcttaatcttaatcttagaacccataaatctcttaatcttaatcttagaacccataaatctcttaatcttagaacccataaaattcagaattctcataacccaagtttgtgtatctagacacaaaggtatttacaaaaacaatgaaatacatagatatttaacttggttttccttaataagaagagagatttaaatgtggatgggtactcccagatagacttgcaagtgttcacaatgcagaatgaaaaggaaacaaacttgccagtactgcttgtaatgctgacagtgaaatagaactgattacacagattttagggttcaatttaatcctggtagccaaataatgggctttccaggcttattataagaggagttcctcctaaataaaggcattcacatccaaatgccaaaacttgcttggacagcgcttctaaaattatatttattttcaagggaataaggcaagttcatctttttcacactaagcattaaggttaactcataatgttagcacttcaaaatgaatccaatccaaaacaaagaaaagaggtaccatgagacggtgttcccaaaaaggatggatttggatagggactaccactaggaacaggagaacctaaaaagggaaagaagaatataaagatttagaaaagaacatctcaatcttttgaatgtgatcaaaattaggtaaagaaggtatttcctttttctttttttgaggcagggtctctttctgtggcccaggctggagtgcagtggcatgatctcggctcactgcaacctctgtctcccgggttcaagcgattctcccgtctcagcctcctgagtagctgggattacaggctcacaccaccacaggccggctactttttgtacttttagtagagacatggtttcaccatattggtcaggctagtctcaaactcccaacctcaggtgatctgcccgcctcggcctcccaaagtcctgggattacaggtgtgagccattgtgcctggccacagaagctatttctaagcataaggagttacattgtccacgatatatgcaagaattagggactgatctcctagtaagtttctaacaactcccaccttggaaaacactgatgtgcgagttaattattaaatcattcatctgtttccctctgaatatataccaaatgagttatgtaaatatgattggttacatcttattttgcttccttacattaaggattcaatattaatagatcacttttaagaatcagaatctatagatgtattcatcaattatacaatagcagtaaataaaacataatgaaaaggcttattgataaaaattgctataaaggttctaagattcaaacgattagaaacaatttcatttcaatgttccatactcactagaatagacaggagaccccaagatgggaccaacattacttggaggcggaagagtggttggaaatctcatctgtgcttcaccaccatacctatttttatgacaagaggttgagtttattcagtaaaacaaaccatccatcttaaaaactggaattgttccttttcctgtttagcttccaagtaaatgctttaaacattagagacttcaatgtattgtgctgacagtaaagtatatgcataagacttataataaatatttattcagtaaatgtggacttgaaactgctaccaggaagaattataagggactctgataacttctaagaaaaagatatgcaatgcatagaatttactttgtgagtaaatggcattgtaattttcatactaggttatggttagatagtacttcaaaaaacgtttctaacaaaatcacatttcaaattcttaaatattttctaaatagaaatatctctttggtaccaagtttccttaaagtaattcagaagccttcaatactaatgatacatattaagcagaattggcatagtgtttggggaagtaaaaaagatagatgagacagtaactgaggtagaacaaagtgtagaaagtagacaagaagttacagaacagaatccagagttaaagtaataatgcataaactatgctaatttacttgcttctattaccattataatctctccagatttcacccttttgcaaatgaattttggtaatttgcctacatagtcactcaactgtttggcaaggctttatcacattgataaaatcattttaaaaagtggcccagtaaaaaaacaaataaataaacaagaaaaactttcacatacctaaagaaagcccgagtagcccaggcagatacttctctatcacaggcagcagtggagcaagcaagaataaggcaagttgcacaagcctggtcttcctgtgtaaaaagaggaatattggccttatattaaatacaaattttaaaatgatttgtgtactgctagatgcagtattaaagtctgtatctagcacagagcaggcattcaataaatacttgctgactgaatgaaatcagttagtgttaaaaagacaagtaaacactactggttttaagttcatcataagcactaggattacaggatgttctcttttccttttaacctagattctgacttagtttccggcttatgtctccaattttcttcctgtggtctttctgctttctagaaaataacaattaagtggtaacactgaatacctaccatgtgtcaggtactattttaagagtttagcatatattaatcctcataccacatcctattataatgtataaggaaactgaagcccagagaagtcaagtaatttacctcagtggtggagctgggatttttaacacaggtgctttgaatccagagtctgtatacttaactttgaactactcccaattttaaccgtatcaattccagttgtggctctgaaatactaagatctctacactgttgcctcaggtttcttcctcaggtcattaagccaaaacaaacaaacaaacaaacaaacaaaccaaaaacaacttgtccctaaatgtcttgtgcttttaatgaaaaggcatttatcatataacctgaacaagaaactcttactagcagacttcaataagaatttatcaacaacaggccaggcatggtggctcacgcctgtaatcccagcactttggcaggccgaggcgggtggatcatgaggtcaggagatcgagaccatcctggctaacatgatgaaaccccatctctactaaaaatacaaaaaattagccaggcgtggtgggggggtcctgtagtcccagctacttgggaggctgaggcaggagaatggaatgaacctgggaggtggagcttagagtgagccgagatcacgccactgcactctagcctgggcgacagagcgagactctgtctcaaaaaaaaaaaagaatttatcaacaacagagaataaaaatctgaaagctcactacaagactcatattaatcctgctttcaaatgtcagttcacatacagtgacttaggcaaagaaaggaatattgttaagattatctatttatggctgggcttggtggctcacggcctgtaatcccagcactttaggaggccgaggtgggcggatcacctgaggtcgggagttcgagaccagcctgaccaacatggagaaactctgtctctactaaaaatacaaaattagttgggagtgctggcacatgcctgtaatcccagctactggggaggctgaggcagaacaatcatttgaacctgagaggcagaggttgcagtgagccaagattgcgccattgcactcctgcctgggcaacaagagcgaaactccatctcaaaatatatatatatatttattacagtattccagtcccaatttacataaactatgactcccactgtttgtttaaaatagcatcacattttttaaaagtatatataattacctgatgtaatttaaagaatctttcaatctcttctccatctcctcccacattactcacaagtagatgcctcagttgatctacaggtctaagtttatgaaacataaggctcccctaagaaatttgaagaaagaacatgaacaagagatttaccaagattggctgatagcaactgactctaccttatttgataaaataaatgaaacaaacaaaaaaaaccattcaacaatacaaagtaggctgggtatggtggcccacatttgtatttccagcacatcacggggctgaggcaggaggaatggctgaggtgatataaaaagtacaactggtcaaaaagatcatctacttctctactcaacctccagtagatctatatatctataaagaaaacttaatgcaattgccccggcaaagctgccccttaaaccagagaattaaagttagattattaattaatcatgttgctactatttatatcaatttaggcaaaaaaaaaaaaaaaaaaagctagaaacatagtcataccttataccagagtaaattccaaatagatcaaaagacttaaaggacaaaataaaactatcataatattacgttggtacaaaagcaattgaggtttctgccattacagctttttttttttttttttttttttttttagacggagtctcgtactgtctcccaggctggagtgcagtggcgcaatctcggctcactgcaagctccgcctcccgggttcatgccattctcctgtctcagcctcccgagtagctgtgactacaggcgcccaccaccatgcccggctaaatttttttatatttttagtaaagacggggtttcactgtgttagccaggatggtgtttttgccattacaatcaatggcaaaaacctcaattgtttttgcaccaatcaataaacaaaagcaactaagagtggattcttttataaaccttagtgagtggaagcttttcaactatgacatatttcaaatgatggctgggcagattggctctcgcctgtaatctcagcactgtgggaggatgaggtgggtggatagcttgagctcaagagtttgagacgagcctgggctttagtgagatcctgtctctacagaaaatacaaaaattaactgggtgtggtggcaaacgcctgtattcccagctactcaggaggctgatgtgggaggatcccttgagcctgggaggcagaggttgccgtaagccaagactgtgcaccacactccagcctgggtgacagattaagaccttgtctaaaataaaataaaataaataaaataaaatatcaactgataactgataattttgactaattataagcttgtgtgcctgggaaaaatctcaataaacaaagtcaaataagaaaccaggaaggctgggtgcaatggctcacacctgtaatcccagaactttgggaggccgaggcaggcggaccacctgagatcaggagttcaagaccagcctggccaacatggtgaaaccccatctctactaaaaatacaaaaattagccaggtgtggtggtgtgcgcctgtaatcccagctactcaggaggctgtggcaggagaattgcttgatctggggaggcagaggttgcagtgagctgagatcacaccactgcactccagcctgggtgatgagcgagactccgtctcaaaaaaaaaagaaagaaaattattcaattaagccactacttcagagaacttgacaaaaatattatacatcgcttatttttgtcactaccataacagaatacgtacacacctgtgctgagaggagaacaaatttcttcggaggtaacatgtgctgctgtacaacaactggtgaatcagttattggaatatgatccttgtttaaaggtgtaattattttatctactttcaattcatctatcgcagaaagagcccaggaatgaccatcaacaccagctgtcatctatgtaaaagaaataaatgttttatacatcatattgaagttacataatgcaaaagaaaaaactacagacttaataaagaagtaaatttaataaatagtacattaacatgaatatttttgaaagtattatgtaattttctactatcttttttttaaatcaggtattttctgggtttttgttttttgttttttttttgagacgaagttgtctaggctggagtgtagtggagtgatcttggctcactgtaacctttgcctcccgggttcaagtgattctcctgcctcagcctccctagtagctgggattacagccatatgtcaccacgcccagctaattttttatttttagtggggacggggtttctccatgttggtcaggctggtcttgaactctcgacctcaggtgatccgcccacctcggcctcccaaagcgctgggattacaggcatgagccaccacacctggcctctggggttttttttttttgagacagcatcttactctgtcacctaagctggagtgcgctggcacgatcacaactcactgcaacctcgacctccctgggttcagttgattctcccacctcaacctcccaagtagctgggactacaggagaatgctaccacggccgcctaatttttctatgttttgtatgaacagggttttaccatgttgcccaggatgttctcgaactcctgggctcatgcagtctgcccatcttggcctctcaaagtgctaatcaggcattaccttttttttttttctgaggcagagtctcaccctgttgccaaggctggagtgcagtggcctaatcagagcccactgtaacgtctgcttcccaggttcatgcaattctcctgcctcagccttccgagtatctgggattagagacgcacaccaccatacccggctaatttttgtattgttattagagactggcttttgccatgttggccaggctggtctcaaactcctgacctcaggtgatctgcctgccttggcctctttccaaagtgctaggattacaggcgtgagccaccatgcccagccataagcaggcattttctatactaatacataaatctttttgtactagaggacaagggcaaacttttctcaagataaactataaatactctttaataaaattataattctcttaaccaagtaactaccttctaccatctttccaggatcaactaaatctgctaagatactatctttcctttaaaaagtattttactggctcggcgaggtggctcacgcctataatcccagcactttgggaggtggaggcgggcggtacccgaggtcaggagttcgagaccagccaggccaatgtggtgaaaccctgtctctactaaaaatagaaaaattagccgggtgtggtggcacacgcctgtaatcccagctactctggatgctgaggcaggagaactgcttgagcccgggagatggaggttgcagtgagccgagattgtgccactgcactccagcctggacgacagaacaagactctgtcacaaaaaaaaaaaaaaaaaagtattttaccagcctaggcaatataatgaagtcccatctctacaaaaaataaaaaaccacctcggtgtggtggcgtgtgcctgtattcccagcaactcagaaggctgaggtaggaggattgcttgaacccaggagtttgaggctatagtgagctatctatgccactgcactccactccaggcaacagagcaaaaccctgtctcagaaaaaaaaaaaaaaaaagtattttaatcttctaaaatactttataataaaaaaattcaagcagccaaaaatgttgaatatacagtaaaagtccacatgcccaatacctagactcaacaattgttagcagttcgccatatctgcattctctctctttctgtatatttgttttattgtactatttgaaagtatagacatcatttatcactcttaaatacttttgcacatatctcctaaaaataagaatgttttcttacaaaccatataataacatttaaaaatgttattggctggacgacacggcttacacctgtaatcccaacacattgggagaccaaggcaggtggatcccttaagcttaggaattcgagaccagcaggggctacatggcaaaaccctgtctctactaaaaatacaaaaaaattagacaagagtggtggcatgtgcctgtagtcccagctacatggcggggagggggtggcgggtgctgaggtaggaggatcccctgagcctgggaggcagttgcagtgagctctgattgtgccactgtactccagcctgggcaacagagtgaaaccttgtctcaaaaaaaaaagttatcaattccctaatataatttaacacctaaccaatataaaatttacccagctgttctaatgtcttttatgactatttttgataactaggatttgatcaaagctcatacactatacttgatgagtttttttgttaaaaacaaaagtccacctttgtttgagaaaaactcaaatattaaatcaaattatatgacatgcagcatttgttctaaaaaaaaagttaggtggaggacagtgtctcacacctgtaatcccagcagtttgggaagccaaggtgggaggatcgcttgagcccaggagttcaagactagtctgggcaatatagtcagaccctgtcgctacaaaaaatttaaaaatcggctgtacgtggtaatgcacacctgtagtcccagccacttgggaggctgaggtgggaggactgcttgggcctgggcaacagggtgagatgctgtcttttaaaagagtaaagaaaaaaaaaaagttaacatttatggaatggtgcttcctatgagtgccaggcattgttctgagtgctttacacacatgagctcatttagtctcacaactccatcgtagtaggtacgattataactattatagaggaagaaacagagagccaaaagcatgtcctccactcccccaacacagcatcccaaccaggacagggtttatatcttattaagttctgaatcctcatagtttatcacagcactaggctggtagtacaaagaataaaggaaagaaggcactccttacctccttatcttcctcctgctcctaccccagctctttgaaccttgtcagaaatttggtagagctcaggcagacaatactcccatccctgggagttcagtttttactcctcccacttacacacacctttttccagtcccatctggaagggttcaaatttaagaaccaccaaagaaccactagttttcagtgaaaactagaagcaaaatgcctgtgaagaggtagctctaaagacagagtaccagacattcacaccccactaggggctggtttatctggtttgatcagcagcctctgtgggctatgcaggactattcaggaggacaggcaggagtgagcagaggacaccaaggggatggagacaggtagcctcccctcacctccttatacactggggactaggatgggcagctgggggcaggggcagttcgtgggttcatagcagcctcggtcctcacccaggaagaccatatccacttcatgatgtatgtggtgatttttgtgtttaaatcaaaactgtgtgtttgtgggtgtctctttgtttatgtgggaaagaaaaatgaaatacaataagaaagatgttggcaactcaattctcttacgtgaggttcaattgactcttcaaactttatgtttgaaagtttccataattaaaaaaaaaacagacaaaattacaaagagattgttagaataaaatctaagtcacaactgtaatagatggcctcatatttaaataactaaacgagcaacatatttaaatgaggtaaagatcatttcatatgaacctgacatgttttcagaaaaaaaaagacaacttcaaaaaagatgtatgtattttctagtacattatggaaaatattccgtaagggtccaatgttttctttaaagattttttttgtgattaccacagtaacttctaccctgacagaggaaaacaaataattgacaggataatttctttactttataatttctaataatacgttattagaagcaaacagcaatacatcagaagataaaagtttcttccatattatccttcacttaaaattatataatagttttttcagaattgtcaggataacttacctgggtttccatcattggcttttggaaaggaaaagtatcatggttgacacaccataaaatatcattatcctcattttctgaggctgccatcaatagaatacctaaaagtttaatatacaaaatattattacatcatgtcaaatatgcatcctcaataaccttaataattattaggttagtgcaaaagcaattgcggttttgcaattaaaattataaaaccgggctgggcacggtggctcatgcctgtaatcccagcacttttggaggatgaggtgggtggatcacgaggtcaggagtccaagaccagcctaatcaacatggtgaaaccctgtttctactaaaatacaaaaattagctgggcatggcggcaggcacctgtaatcccagctactcaggaggctgaggcaggagaatggcgtgaacgcaggaggtggaggttgcagtaagctgagattgtgccactgcactccagcctgggcgccagagcaagattccgtctcaaaaaaaaaaaaaaaaaaaattttacaaaaccacacgtacttttatgccaacttaaaactagcatatataaatatacacacacaacatcaatcttttttttttttttttgagacggagtctcgctgtcacccaggctggagtgcagtggcgcgatctcggctcactgcaagctccgcctcctgggttcacgtcattctcctgcctcagcctcccgagtagctgggactacggcacctgccaccacgcccgactaattttttgtatttttagtagagacgaggtttcaccgtgttagccaggatggtctcgatctcctgacctcgtgatccgcccaacttggcctcccaaagtactggaattacaggcgtgagccactgcgcccaaccgaacatcaatctttataaacaaacaagttacaaaataaaataattccctgaaagactatataattatttttaaggtagactccttaagtgttctcaattttaaactgtatttctctcagataaacatttttttttcacattttagcatttctgaacttagggcatatcttgcagtcaatgggtttatcaatttaattattaattttataaaaatatacttagtatataaaaatgccatgactgacaaattcacaatgtaatacaagctaatattcaatgaaatacagtttatatactggttaattcaaacacaccatgaataaaaatgatgaaggtgctagaggaatggcagagataagtgtactatagaagcaattatctgggccaggtgctgtggcttatgcatgtaatcccagcagtttcggaggctgaggcaggctgatcacttgagcccaggagttcgagaccagcctgggcaataaagtaagaccttgtttcaacaaaacatgaggcaggaggattgcttgagccggggaggtagaggctgtaatgagtcatgactgcatattgcactcctgcttgggtgacagtagacactgtctcaaaaaaaaaaaaaaaaaaggcaattatctcaacaaaacttgccaacacggtggctcacgcctataatcctagcgctttgggaggcagaggtggtaggactgcttgagcccaggagtttaagaccagcctgggaaacatggtgaaaccccgtctctacaaaaaatacaaaaattagccaggagtggtggcacatgcctgtagtcccaactcctcaggaggttgagcaaggaggatcacctgagcctggaaggttgaagctatggtgacccaagatcctgccactgcactccagcctgggcaacagagtgagaaccttcctccccaccctcaaatgacttggaaaaatattctgtattcatggatttgaagacttaacatagttaagatggcaacatgccccaaattgatatactgattcagctatcacaatccaacctcacttttttgtgtgttttttgtttttgtttttgttttgagatggagtcttgctctgtcccccatgctagagtgcagcggtaggatcttggttcactgtaaccttcacttccccagttcaagcgattctcttgcctcagcccacaagaagctgtgactacagacatgccccctacacccggctaatttttgtatttttagtagagacagggtttcgccatgttggccaggctggtcttgaactgatctcaagtgatccacctgcctttgcctcccgaagtgttgggcttacaggcgtgagccactgcacccggccccacctcactttttttgcagaaattaacaaggtgattctaaaattcatatgaaaattcaagaaactgagaagagccaaaatcatcttttaaaaaatcaggccaggtgcacggtggctcatgcctgtaatcccagcactttaggaggccaatgcagacggatcacttgagctcaggagtttgagacgagcctaggcaacatggcaaaagcctatctctacaaaaagtacaaaaattagccgggtgtggtggcacacacctgtagtctctctcagctactcaggaggctgaagtgggaggacagcatgagcctgggaagcggaggttgcagtgagcagagattgtgctactgcactccagcctcggcaacagagccagaccacctcaaaaaaaaaaaaagatcaaagttggaatagtcacacttatcaatttcaaaacttattacaaagcaacggtaatcaagactgtgctactgacataaggatggataatatagaccaacagaatagaactgagaatccagattccatacattaacgggtaattcacttcagacagtaagatgaagacaattcaatgggggatataatagtcttttcaacaaatggtgctcagacagctagataaccacatgcagaaggatgaagtcagattcctacttcacacaacatacaaaaattatcacaaaacagatcaaaaacctaaatgtagcagtgaaaactacactttcaacttttgaatttcactacaatttcaaattttattttagattcaggaggtatatgtgcaaatctgttacttgcgtatattgcgtggtgctaaggtttagggtacaactgattccatcactcaggtactgagcataagacccaatagtccgtttttcaacccttgctcccctacttccctgacccttctagtagttcccagtttctactgttgccatagggtattttcaaatacttcacaacaccatataattttaacaattttaagaatataatcttaaatctgatagtatttcagaacttacctttactataaagagctctatgtacttttgaaggcttttccacggttgaagatgctgagaatccaggaggtaagcggacatgaaccagcgtcagtgtattaggccgtgctaatggctgtctgaatggacaagtgctaaaatataacctaacacctgaagatggggtaaaattatgcatcagtaatagaaaacaaggacctgaggtaaatgtgttattgaagcaattacatacagcaatgcaacactctgctaaaaccatacataactttcctgactaatttttatttttggagatggagtctagctctgtcgcccaggctggagtgcagtggcgccatctcggcttactgcaacctccgcctcccgggttcaagcgattctcctgccttagcctcccaggtagctgagactacaggcatgtgccaccacacccgtctaatttgttttatttttatttttatttttttttgagacagaatcttgctctgtctcccaggctggagtgtagtggcgcgatcttggctcactgtaagctccacctaccaggttcacaccattctcctgcctcagcctcccgagtagctgggactacaggtgcctgccaccatgtctggctaattttttgtgtttttagtagagatggggtttcaccgtgttagccaggatggtcttgatctcctgacctcaggatccacccgccttggcctcccaaagtgctgggatcacaggtgtgagccaccgcacccggctcccctgactgatcttaaattaccatatagactatctgctaaaatatatatctaagaaaatgtcactcgaaattgagaggtgaatcaatacatttcattagaaagaacttgcaaagacaaaccaagaaatcttgtgttccaattcaggctttgttacaaaatgtcagccactgcgccttttaggcttggcttttgttttgcttttttactggttttttgagaaaagatcttgccctattgcccagggtgaagtgtagtagcataatctcagctcactgtagcctcaaactcctgggctcaagtgatctttccatgacagcctcccaagcagctggtactacaaggccgtgccatcacacctagctaatttttgtatttttagtagagacggggttacagggtttcaccatgttgctcaggttagtcttgaactcctgggctcaggcaatctgcctgccttgatctcccaaagcgctaggattacaaatgtgagctaccatgcctggcctaggtttggttttatatctataaaatgaagaaacagaattagaaaaatctcccagttttcaaaatcctttattttacaaactatttatatggctttacggcagatatagaaggaaaaatatatttctaataataaatttccaaatctaagaattttcagaagttgtaacagtaatagcagatatgtaaataaaacaacatacctgcatgtgtgacagccaataactgacagtccagtgattcagaattttcaatcactgctatttggacaattggtttaaaaacagaacgatcgatggtcctaaaagaaaggagaaaataaagtgtatttttaaaatgtgtctgctaaattataagaaatatttcccatcagaatgtttacatatttccatattttccttttttttttgagatgtagtctcactctgtcacccaggctggaggagagtggcgtgatctcggctcactgcaatctccgcctcccaggttcaagcaattctcctgcctcagcctcctgagtagctgggattacgggctcgcgccagcacgcccaggtaatttttgtgttgttagtagagacagggtttcatcgtgttggccaggctggtcttgaactcctgacctcgcgtgagcgtgatccgcccgcctcggccttccaaagtgctgggattgggattacaggcgtgagccactgtgcccgaccacatatttccatattttcttttttttttcttttttcttttttttgagacggagtcttgctctgttgcccaggctggagtgcagtggcgccatctccactcactgcaagctccacctgccaggttcacgccattctcctgcctcagcctcccaagtagctgggactacaggcacccgccaccacacctggctaattttttgtatttttagtagagacggggtttcactatgttagccaggatggtctcgatctcctgacctcatgatccgcctgccttggcctcccaaagtgctggcattacaggtgtgagccactgctcccagccttatattttctaaatatgctaaataatttaagactagcttcttaggaaagtaatacaagagcagcaagaactggaaaaactctggaatgtgtattttttacatttatattattaagagtaaccctattttcaaacaaagatcacaaaaaaagactaaaaccattgggtgaatggttggtggggagcagtgttctcagtgtcaaagtatcattactgctaattaaaaaaggagaaaggccaggtgcagtgactcacgcctgtaattccagcactttgggaagccgagacgggcagataacctgaggtcaagagttcaagactggcctggtcaacatggtgaacccccgtctctactaaaaatacaaaaaaattagccaggggtggtagcgcatgcctgtaatcccagctacttgggaggctgaagcagaagaatcacttgaacccaaggtggaggttgcagtgagctgagatcacgtcactgcagtccagcctgggcaacagactgagactctatctcaagggggaaaaaaaagggagaaaatggatctttataatgtagacatttggttaaaatcacctcaatgaagctttcaacagtgagaaaactgctattatgtgtctcttgatataatgtagtaagacatttcacactgcctatgtaatactggctaaaagatatattactgcttggtgaggtggctcatgcctcaaatcctagcattttgagaggctgaggcagtcagatcacttgaggccaggagttcgagaccagcctgctcaacatggtgaaaccccatctctactaaaaaatatataaaaattagccaagaatagtggcgcacatctagagtcccagctacttgggtggctgaggcacgagaatcactggaactcggaggcagaggttgctgtgagccaagatagcaccatggcactccagactgggtgacagagcaaaactctgtctcaaagaaaaaaaaaaaaaaaagaaagaaaatatacatatataaaatacatataaacatcatatataaaatatattactcagaatctaattataaaaaaagatatattcagaaatttgtataattatcctgcccttccttccaaacgtcaatattataaaaaaaaaaaaaggtggccagggggctgttttatattaaagagactaacaaccaatccaattcataaattctgatataactggagaaaaatggaaagaaaaacaactataaaagatttcgaagccaggcgcagtggctcacgcctgtaatcccagcactttgggaggctgaggcataaaagctggccaacatggtaaaaccccgtctctactaaaaatacaaaaattacccaggtgtggtggtgtgcatctgtagtcccagctacccgggaggccgaggcaggagaactgcttgaacccgggaggtggaggttgcagtgagccaagatcgtgccactgcattccagcctgggtgacagagcaagactccatctcaaaaaaaaaaaaaaaaagattttgggggcacggtggttcacatctgtaatcccagaatcccaggactgtgagaggctgaggcagacacgtcatttgagcccaggagttcaagaccagccagggcaacatggtgagatcccctctctacaaaaaatacaaaaattagccaggtggaggtgtccgtgcctgtggtcccagctgcttgggaggctaaagttggtggatcacctgagcctagggaggtcaagcaccactgcactcaatcctgggcagcagagttaaaaaaaaaaagattttggggactactgggcaattttaatatggactaagtatattgttatgtaacagactaaaggcatgtcggtggctcatgcctgtaatcccagcactttgagaggctgagacatgcggattgcttgacctcaggagttcaagaccagcctgggcaacaatggtgaaaccccgtctgtaccaaaaatacaaaaaattagccagatgtggtggcgcacgtctgtggtctcagctactcaagaggctgagatgtgaggatgccttgagcctgggaggaggaggaggctgcagtaagccacgatcgcaccactgtactccagcctgggtatcagagtgtgactccatttcaaaaaaaaaaaaaaaaaaaagtcatgatgtctacaatgtactttcaaatggctcataagacaggcaacaaagaggcaaaatgttaaaattgagataaagagtgtattagttttgccgggtgcagtggctcatgcctgtaatcacaacactttgggaggccaaggcgcgcagataacaaggtcaggagttcgtaaccatcctggccagcatggtgaaaccctgtctctactgaaaatacaaaaaattagccaggcacagtggtgcgcgcctatagtcccagctgcttgggagggtgaggcaggagcattgcttgaacccggcaggcagagggtgcagtgagctgagactgcaacactgcactccagcctgggtgacgtgacagagtgagattccatctcaaaaaaaaaaaaaaaaaaagtgtattagtttttgtcacattgttcttttaatttttttgtggatttgaaaaaaattccagaaaaaaattagagggaaaaacagaaaattatgtgttttcaattgtgtctgccttcagaatttttttcttgtcactgaagaataaaacaaaacaaaaaggctgagcaagatagcaagaccccaggtctactaaaaataaaattaggtgggcatggtggcacacatctatagtcatagctactcaggaagcttaggcatgaggatcacgtcagcccaggaaattgaggctatagcagactacaattgcaacactgcactccagtctgggcaacagagtgaaaccctgtctgaaaaaaaaaacaaaaagttgatttatttcactctgattgtagcaataatctaggcacaatgacaatagaagttgaaaaatttgaggccttcattataaaaagagtgtttgcaggtggggtgcagtggctcacgcctgtaatcccagcacttcgggaggccaaggcaggcagatcacctcaggtcaggaggtcgagaccagcctggccaacatggtgaagccccatctctactgaaaatacaaaaattagccaggcgtggtgacaggcgcctgtaattccagctactcaggaggctaaggcaggagaatcgcttgaacccgggaggtggaggttgtagggagccaagtcgcgccattgcactccagcctgggggacaagagtgagactttgtctcggaaacaaaaaaaaaagagagagagagcgtttgcagcttgaccaaggtagttgggatatgtgcaaatggtaatgcagattgtctgaagacttggcttccgcgttaggttcttgtacttatttaggagttagatctcaggcaaatcatcccttagtttcagtttcctcatgaataaaatgggtactacaactttgaaatattgtgttctgtacttgtgtcaataatcagaccaactaagcttgaaccacacatgtctgttaaaagagtgagtagtggccgggtgcagtggctcatgcctgtaaccccagcactttgggaggccagagcgggtgtattgcttgagtccaggagttcaagaccagtctgggcaacacggtgaagccctgtctctataaaaaatagaaaaattcgccaggtgtggtggcatgtgcctgtagtcctagccgctcgggaggcttaggtgggagaatcgcttaagcccaggaggtggtgattgcagcaagctgagatggagccactgcactccagcctgggcaacagagcgagactccatctcaaaaagaagcaaacaaaaaaccgaaagagtgaatagttaaaagtggggaaactttgagacatgcagtttcctagtcatgatccctatgtaaagttgccaggaaaaacacgtcaagctgtactttacgtagtaaaaccagtctaccttatatttccaactatcaaacataagaataaaagagtctcaagctgggcacggtggctcacgcctgtaatcccagcactttgggaggccaaggcaggtggatcacctgaggtcgggagttcgagaccagcctgaccaacatggagaaaaccccatctctactaaaaatacaaaattagctgggtgtgatggcgcatgcctgtagtcccagctactcaggaggctacggcaggagaatcacttgaacccgggagacagaggttgcagtgagccgagactgcaccattgcactccagcctggacaacaagagtgaaactccatctcaaaaaaaaaaaaaaaaaagtcttggccaggcacggtggctcacgcctataatctccacattttgggaggcgtggtgggtagattacctgaggtcaggagttagagaccagcctggccaacatggcgaaacccaatctctactaaaaatacaaaaattaggctgggcatggtggctcatgcctgtaatcccagcactttgggaggttgaggcgggcggatcacgaggtcaagagatcgagaccatcctggccaacatggtgaaaccctgtctctactaaaaatacaaaattagctgggcatggtggtgcatgtccgtaatcccaactactcgggaggctgaggcaggagaatcgcttgaacgcgcgaggcagaagttgcggtgagcagagatagcaccactgcactcccgcctgggcaacaagagcgaaactccatctcaaaaaaaatatatataaaaattagccaggcatggtggcaggcacctgtaatctcagctactagggagcctgtggcaggagaatcagttgaacccaggaggtggaggttgcagtgagccaagattgtgtcactgcactccagcctgggtgacagagtgagaccctgtctcaaaaaaataaataaataaataaataaataaaggagtctctaacagctccatttcaaacataatgtagagtgtcatctcttcaacattccttgtcttttagagacattttgatgagggaataatatatacttttagaaggctacacacaaatagtataattatgcctgcaaatgaaatgcttaataataaattacatgttacctagcaatgttaccagcagcagagacaatggcattctgtgacacagaggcaactctgctcattccttgtccatcttgtcccaaatcatacacctgtgaatacaaaatcattctcacttaaacatgattatatactatacacatattattaaactctttcttttaagggatcctttaatattggtatttaatacaaacatgaaaacattcagattcgaaatttcatagaaaggggacccttctgagaagtgagttgggctttttttttttgagacgaagtcttgctctactgcccaggctggagggcaaaggcatgatctcggctcactgcaacctccgccgcccaggttcaaatgattctcctgcctcagcctcccaagtagctgggattaaaggcacataccaccacacctggctaatttttgtatttttagtagaggcagggtttcatcatgttggctagactggtctcaaactccagacctcaggtgatccgcccaccttggcctcccaaagtgctgggattacaggcttgagccaccatgcccagcaggctttttttttttttagttacacagttcataggaaaaatttaagaggtgggaattgtcttccttaaaaataaggatttatttgactcttaatggtataataatattaatactaacctgtattactcctttctcagatcgtgtatataaaatatttctagaattatcaattgcaatttgaagaataggatctaaaagtaagacaaaaaaaaaaaagagaaaaaagtaaacccaaggattaacaaagcaaatacattagctagttacaacaaactgttgaatcagaactttgtattcaggggctttctactctcttgctttgtagttaaatcctaggatgtttgcataagatccagtccaaaaagcattttggtcagacaacacatgaaaaaaacacatgctaaatactgtgactgggttatgagcatagaaagtaagttattttgtcctctaaatgaattttaagccaaactgaaaacaaattctaagttattttttcatgaaataacttagaaaataaattctaagttatttaaacattaatgaatgtttactacatcctagaaacacagaataagtatacctggtcctttatgttaagaaacttccagtttggcctaattgattgtgtgaaagaaaataattttaaaattcagtcatattaatctttgggtatacagatcttattttgccaaagcattttaaaaattatttcacctgttgaaatctctcagttcattaaaagctaagatatattctttttatactggaaatttgttctagaccaagcaaacaatgtattagctgtctgaatgtctgtctctctcacatacatacacatattttggtttaattatgtacagctgttttagacgcaagttctttgatgctacatttataggaaataagtaaacttgagaacaaaatccacactttctctaggttatgatctccttaccctttaaaagaccttatgaatatataagaaatgctacttaacataacaaattgtttcaattaagaatgataatttctgaagaaaacgttgagggaacaatgtgttagaaattagttgtacttgccaaatttattgttttctacttaccatcttctgagaacgtgaattgtagcaaggaaggaacaaggaaagaaagtgagctctttgagtggtttattttcctacatctttggctaaaccaccctgcttcagccttaaagaaaaaagtagaaagacgacttataaaagtatgtaactcccttacaataactactgtatatccatatttataaaaaccttcaaatcttcatgaaataccagttataatcactaataccagttataatcaacaaaacgagacatattattcaaaattaactactgagtttagcccataatttaaaatatcaaccaaatactgacaaggaaagaatttcaagacatactgttagatgaaaagccagttatgggctgggcacagtggctcgcacctgtaaatcctagcactttgggaggccaaggcaggtggatcatttgaggtcaggagttcgagaccagcctagccaacatgatgaaactctgcctctaataaaaacacaaaaattagctggatgtggtggtgcacacctgtaatcccagctattgggaggctgaggcaggagaactgcttaaacccaggggatggaggttgcagtgagctaagattcagccactgcattccagcctgggtgatagacctgggtgatacagtgagactccatcacatttaaaaaaaaaaaaaaaaaaaaagcaattacgaattaaatcaataatccaagtgaaaacacatatttgcaaaagtgcattttgtatttgtatatgtgtatatacacacaaacacatatgcatagatatctatagagacattgatgtgtgccttatgttccacgaggacatacatagaataatgacttttacctctgagggctgagttttgtaggcatggtgtagtcatggggactacagcttcaactgtatgcttgaatatttaccataaaaatatattaatgtccttatataattagaaaacaaaataaaggcttatctttccctactccatcaagagagaaaaaaaaacgtttacaaatgtcagacttacctggtaggctacttcatataaacagccatcctttccagccaagaaaattctgccattatcagtggaagttattgttaaaaggtaagtattatcagtaggaagagaatataaaggatctggaagcaactgcattccaccagacaaactatcattaagaactccagaacctatttaagaaagaatacataaatcagtttattagctactccacagtttttaaaaatctttgcattatcatcagaatctatatgtttactcaattcttttttttttttcttgagacagtcttactctgtcacccaggctgggtgcagtggcccgatctcagctcactgcaagctctacctcccgggttcatgccattctcctgcctcagcctcccgagtagctgggactacaggcgcccgccaccatgcccagctaatttttttttgtatttttagtagaggcaaggtttcaccgtgttagccaggatggtctcgatctcctgatctcgtgatccgcctgcctcggcctcccagagtgctaagattacaggcaagagccaccatacccagccttactcaattcttactgacaattaacatagtcaacagcttctataatatacattttaaaattactaaaagaagtctgatacaatttgataattcaagttaaacagaacctgcagagtgtgtgagtgtgtgtgtgtgtgtgtgtgtgcctgtgtgtttattatatagtaagataataaacaagaaactaacccggccgggtgccgtggctcatgcctgtaatcccagcactttgggaggcccaggtgggcagatcacctgaggtcggcagttcaagaccagcctgaccaacatgaagacaccccgtctcttctaaaaatacaaaattaggccgggcacagtggctcacgcctgtaatcccagcactttgggaggccaaggcaggtggatcacgaggtcaggagttcaagaacagcctggccaacacagtaaaaccctgtctctactaaaaatacaaaaaaattagctgggtgtggtagtgggtgcctgtaatcccagctacttgggaggctgaggcaggagaatcgcttgaacctgggaggcagaggttgcactgagccaagattgcaccactacactccagcccgggcgacagtgcaagactcccttatcaaaaacaaacaaacaaacaaaaaaacaaaattagccgggtatggtggtgcatgcctgtaatcccagcaactcaagagactgaagcaggagaatcacttgagcctgggaggcagaggatgcggtaagccaagatcacgccattgcactgcagcctgggcaacaagagcgaaaatccgtctcaaaaaacaaaacaaaacaaaacaaaacaaaaaactaacccaatgttaacttgtggaaaagagcctgaggatttggcagtaataatcattaatgtgagtcaatggaattcaacatttcacccagattagcttttaactgtaatatcaattggccaaaatactattattttaaaaaacgttaacatgtgggttgccatacctgtttgcaaattagcatagctgagtccaagaattactatgtctacaggggtcgccaaaaccaggaggtgtcgcacatgaggttgaaagatgcctaagataaagtagacacagggcaggaatactttcagcatttaagcactaacagagtaagcttttattaccattaaagtgagctactaattaaatggtatatgaaaagtctggatgcagtttagtcaattctgttgttaaaaatattattatgtatgatcatttaaataagtaaattttgaatgtcatcaagataatgaagaggaaaaaaagttaatagcagtggaaaagaaccaccttagaaaacaatcacttcagtatttaatgctattttaaaagtgttatattacaaaatagtttaaatatattaaaatatagagatgtatatttgtatacccatgttcatagcagtgtttttcacaataactaaaaggtgaaaacaaaatccaagtgtccatcgatagatgcattaaaaaaaatgacatatatatatatacacacacacacacaaaatggaatactactgaactttaaaaagtaagaaagttggccgggcacgcctgtaatcccatgggaggctgaggcaggcaaatcacctgaggtcaggagtttgagaccagcctggccaacatggtgaaaccccatctctactaaaaacaaaaaattagccgagtgtggtggcacgtgcctgtagtaccagctacttgagaggctgaggcaggagaattgcttgaacccgggaggcaggggttgcagtgagccgagatcacgccattacaccccagtctggacgacagagtgagactccatctcaaaaaaaataaaaaaataaaaacataaaaggaaaaatgttctgatgcatgctgtaacacagatgaaccttgaggacataggttaaataaaatgagccagtcacaaaatgaccaatatagtaccatatgattccatttatatgaggaaacctagaatagtcaaattcttacagacaaaaagtggaatggttactaccaactgctgagggaaggaggaacaggagtttttagttaataggtacagtttccattttacaaaatacagagttctagatatagatggtggtgaagtttacacaataacgtgaatggacttaataccactgaagtataggcttaaaaacagttaagatggcaaagtttgtattatgtgtattttaccacaattaaaatatatataatagatttcattttgaaatgcaaataaaagctagacaattttagaaaataaaacttacacctatagttatctacacaagaaaagattacaaccttgataatagtatatagcaatatttatacacttaatgcatctcttttagattctatgtaaaggacatacatttgctttgcttttctttttgagacagagtttcactcttgttgcccaggctggagtgcagtggctcgatctcggctcactataacctctgcctcccgggttcaagtgatcctcctgcctcagcctcccgagtaggtgagattacaggcatatggcaccatgcccagcttattttgtatttttagtagagacacggtttcaccatgtggtcaggcttgtctcgaattcctgacgtcagttgatccacccgccccagcctcccaaagtgctgggattacaggcgtgaaccaacgcacccagtgtctttatttcttctttttttttttttttttttgagacagggtcttgctctgctgcccaggctggagtgcagtggcagaatcaaggcttactgcagccttgtcctcctatgctcaagcgatcctcccgcttcagcctcatgaatagctgggactacaggcatgcaccaccatgcctggcttatgtttctgttttttgcagacagggtatcaccatgttgcccaggctggtcttgaagtctcagactcaggtgatctgctcgcctcagcctcacaaagtgctgggattacaggtgtgagccaccacacccagcctgaaaatatattttcaatgcaagtaaataaatagtgtataaaatgtcggtttgggctgggcgtggtggctcacgcctgtaatctcagcactttgagaggcagagacgggcggatcacttgaggtcaggagttcgagaccagcctgaccaacatggtgaaaccctgtctctactaaaaatacaaaaattagccgggcctgctggcgggcgcctgtaatcccagctactcgggaggctgaggcagaagaatcgcttgaacccgggaggcggaggttgcagtgagccgagatcgtgccattgcactccagcctgggcgacagaatgagactccatctcaaaaaaaaaaagaagtctgtttttacttaactgagtatctataattgcaaaatggccataatcttaaaaaatttcacttaggccttgcaaaaaagtaatttttgtctattatttcctcctataaaaaggtacatttggctgcacagtggctcacatctgtaataccaggactttgagaggccaaggtgggcggatcgcttgaggccaggtgttaaaagactagcctggacaacatggccaaaccacatgctactaaaaatacaaaaattagccgggaatggtggcacatgcctgaaattccagctactcaggagcctgaggcaggagaatcgcttaaacccaggaggcggaggttgtagtgagcaccaaggtgactccactgtactccagcctgggtgacagtgagacactgtttcaaaaaaaaaaaagtacggttaaagaatgtgtgtgtgtgtgtatatatatatatatttatttatttgtttgtttgtttgtttgtttttcagaggcgatgtctcactctgttgcccaggctggagtgcagtggcgtgatcttggctcactgcacgctccacctcccaggttcacacaattctcctgcctcagcctcccaagtagctgggactacaggcgaccaccaccaagcccagctaattttttgtatttttagtacagatggggtttcactgtgttagtcaggatggtctcgatctcctgacctcatgatccacccaccttggcctcccaaagtgctgggattacaggctcaagccaccatgtccagccaagaatatattttaaatttaaatcaatcaattctccttcctagtaactctgataagagatttggcattatgctgggcatggtggctcacgtctgtaatcccaaacactttgggaggccgaggtgggcggatcacctgaggtcgggagttcaagaccagcccgaccaacatggagaattcccatctctactaaaaatataaaattagccaagcgtggtggtgcatgcctgtaatcccagctacttgggaggctgaggcaggagaatcgcttgaacccaggaggcggagggtgcggtgagccgagatcacgccattacactccagcctgggcaacaagagcaaaattccatctcaaaaaaaaaaaaaaaaaatagagatttggcattatgagggtgaaagagtaagtcaaacaatgcttgtgatatctacaagatttaatttactctgaactctgttctcacttccatgggctatcaggattatggccagggcatggcagctcatgcctataataccagcactttgggagaccgatgtgggaggatcacctgaggtcaggagttcgaaaccagcatggccaacatggcgaaaccctgtctctactaaaaatataaaaattaggcgtggtgacatgcgtttataatcccagctacttgagaggctgaggcaggagaatcgcttgaactcaggaggcgagactgcagtgagcaccaaggtggctaaactgcactctagcctgggcaacagagtgagactctgtaacagaaaaaaaaagaaaggtacatttaaaggatatattttaaatttaaatcaatcaattctccttctcagtaaccctgataagagatttggcattatgagggtgaaacaataagttaaacaatgcttgtgacgtttctaagatttactctaaactctgttctcacttccacgggccatcaagaatatggccagggcacggcggctcacgcctgtaatcccagcacattgggaggccaaggtaggcaaatcacctgaggtcaacagttcaaaaccagcctggccaacatggcaaaaccctgctctactaaaaatataaaaattagctgggcatggtggcacatgcctgtaatcccagctacttggaaggctgaggcaagagaatcgctcaatcctgggaggcggaggctgctgtgagcggagatcacgccactgcactccagcctgggcaacagagcgagactctgtctcaaaaaagaaaaagactaaaaaaatggccaggtgcagtggctcacaagtgttaacccagcatccctgaggtgggtggattgcttgagcacaggagttcaagaccagcctgggcaacatggcaaaaccccatctctacaaaaattagcctggtgtggtagcacaaaactgtagtcccagctacttgggaggctgaggtgggagggtctcctgagcctgggaggttgaggctgtagtgagccatgatcatgccactgcactccagcccgggtgatagagtataagaccttaatctcaaaaaaaaaaaaaaaaaaaaaaaaaaagagaaagacagactaataaaatgcagacactaaaatttttcttaacattaaattcagcaattaatgaaaaatctatagtgcaaaaccttcaggtatatcaagaaagagcagtaaaaagcaaataaaataaaattcaaaaaattacagtttaacatttttaaaggcagtgtcacttataccattaaagtaaacagttaaacattaataatcactttacatatttctaattagaattcaaaataaaacttcaatggagaatacaattgtttaaaaaagggtgttgtcagccaggcgcggtggcttacatctgtaatcccagcactttgggaggctgaggcgggcggatcacctgaggtcaggagttgagaccagcctggccaacatggcggagccccgtctctactaaaaatacaaaaattagctgggtgtggtggcgcacgcccgtaatcccagctattcgggaggctgaggcaggagaactgcttgaacccaggaggcggagattgcagtgagccaagattgcgccactgcactccagcctactcgatggaacgagactccatctcgaaaaaaatgtgtgttgttgttcaggtctataccatttggagtttacatatacaaacataatctcttccttatagttttatttcttacctgcttttggcttcacaagccccacagcaagaatagtctcactaagtccatcaaaataggcaaggtctcctctgtgaataaatgaagaaaaacatgttacacatataaagcaaataggccagatgtggtggctcatgtctttaatcccagtactttgggagtctgaggcaggaggactgcctgagcccagaagttcaagaccagcctgggcaacatagtgagactgtctctacaaaaaagaaacaaaaaattagccaggcatgggggtgtgaggccactgagttggcaggatcgcaaaggcctgggaggttgaggctgcagtgagtagtgatcatgccactgcactccagcctgggtgacaaagtgagagcctgtctcaaaaaagaaaagaaaagaaaaacagaaaaccaagtattatcttacaatgatctttattattattattactattatttttgagacaaggtccagctctgtcacccaggctgaagtgcagtggcacaatcttggctcactgcaatctccacttcacacctggctaatttttgtattttttgtagagacaaggtttggccatattgcccaggctagtgttgaactcctgaatgctctttattagttaaataaatttagacacagaatataatgaaaagactgggtgggcacagtggctcacacctgtaaacccagcactttgggaggccggggtgggcgaatcacaaggtcaggagattgaggccatcctggccaatgtggtgaaaccccgtctctactaaaatacaaaaaattagcccggcatggtggcgcacgcctgtggtcccagctactcgggagggtgaggcaggagaatcacttgaacccgggaggcagagttgcagtgagccgagatcacaccactgcactccagcctggctagagaacgagactccgtctcaaaaaaaaaaaagactgggagaggtggctcatgcctgtaatctcagcactttgggagggtgaggcaggagcccaggagagttcaagaccctgggaaacacagtgagacttggtctttatgaaaaatttatatatatatataactttttcattttatatatattgaatatataaaaatatttttcattatatatataatgaaaaaataaacaagcaaagaaaactgtttcagttccaagacccagggatccagacctgcttatggctaaggatgaactagaaaaatagggaaatacaaaaatagaaaatgctgctccccattccaaacatctccacaacagggctgcacatcaagtaatagcaatctactgctggggcagggataagggtaagaagagggccatcttacaaggatggaatcacaggaagagcctaagactgaggatgtaagaggaacactgagaaaaaatctccagtaaaccaacttgcaccctaagtacaacaacagaacccaaatccagctcaagtcctgacctggaaaaaggcaattccccatataataaagatctgctataccttagccaaggaaaagacatgcccatttctaagaataaataccacttgctacttacttacagtatctactgtcttaacatgatttctggctttcaataagaaatcatgagacacaaaataacaagaaaaaaaaccccagtgtcaagaaacaaagtaatcaatagaaccagactcagctatgaatccaaactatcagacaagaaatgtaaagtaactatgaactatacatataggctttatataggaaaaattacctaattgactatatgtacaaataggtaaagttgggaggttgagacgtgtggatcacttgaggccatgagttcaagaccagcctggccaacacaatgatacctgtttctactaaaaatagaaaaaattagccaggcatggtgtcccaggcctgtaatcccagctactccggaggctgaggcatgaaaatcacttgaacctgggaggtggaggttgcagtgaggcaagatgataccactgcactcaagcctgggcaacagagcgagactctgtctcaaaaaaaagggagaaataaaacagacaaaaaaaaataggtaaagaatttcgacaaaaagataaaaattataagaagtcagcgaggctgggtgtggtggctcacgcctgtaatccccagcattttgggaggctgaggcgggtggatcacgaggtcaggagatcgagaccgtcctggccaacatggtgaaaccccgtctctactaaaatacaaaaaaaaattagctggccatggtggcacacgcttgtattcccagctactcaggaggctgaggcaggggaattacttgaaccagggaggagaaggttgcagtcagccaagatcttgccactgcactccagcctgggcaacagaatgagactcagtctcaaaaaaaaaagccaatgaaggccaagtgcggtggcttacgcttgtaatcccagcactttgggaggctgaggtgggcaggtcacctgaggtcaggaattcgagaccagcttgcccaacccggtgaaactccgtctccactaaaaatacaaaaattagccgggtgtggtggtgcatgcctataatcccagttactcgggaggctgaggcaggagaatcacttgaacccaggaggttgaggctgcagtgagccgagatcatgccactgcactccagcctcagcaacggaatgagataaaaaaaaaggggggggggtccaggcgcagtggcttacacctgtaatcccagcactttgagactccgtctcccaaaaaacagggagatagagacagaaagtggaaaaacaaaaaacagaatggagcatccaaaatgaggtatataacaaaagtatagctgaaatttctgaagaaagagaatgtatcagaatatttcaagataatggctgggctgggtgcggtggctcatgcttgtaatcccagcactttgggaggcccaggagggcaaatcactggaggccaggagttcaagaccagcctagtcaatatagtgaaaccccatctctaataacaatacaaaaattagccaggtgtggtggcccatacctgtagtcccagctactccagaggctgaggcaagaagtgcttgaacccaggaggtggaggttgcagtgaaccaagatagtccactgcactccagcctgggcgacagagcgagactctgtctcaaaaaaaaaaaaaaaaaaaagacaatggctgaacagaaaaggagagagagagagagaaataaagataacagctgaaaaaaattctaaaaataatagaagacatcaaactaaagatctaagaagctcagagaacaagaagcagaaaaaataccacgaaaaaatatgatctagactttcaagaaagcttccagtcatcctgaaaaggccatccacacaggaacaaaatagctaaatggcaacttatgcggactaggattccccatcctcttacatcatgccattccacagggccctttgataactggcacagcctcttggaactacgatccaatgctgagatatttgggggttagagaacaatgaaatgaccaagattacatttttatcatccaggtggaattaggatttataatagaaagccaattgaatatttaaactaagtataaattttacaaaattgaatttgtggaccttgtgccttgattttttaaaataagtacattcttcaaataatttttctttaaatgaacacacactgctatggatcaaatatctgtgtcctcctaaaattcatattaaatcctaactcttaatgtgatagtatttgtaggtggggtctttgaaaggttattaggtcatgagggtatatctcatgaatgggattagtgcccttataaaagaggacccaaagaactcccctacccctctgccatgtgaggacagagtgaaaagatagccatctatgaacattgaagtgggctttcaccagaccttgatcttggacttccagcttccagaaccatgagaaagaaattcatgttgatcacaggctatggtattctgttttagcagctcggactaagacacacagtaaggtaggactgtttgttccatgagggcagaactacattcatctcattcagtactgttcctaccacaacaacagtgtcagatacataagatcaatatgtatgtgttaaataaatatgttggatgttaatggaaatgtaaaaaatttcattagtgtttttttttttttgagatggagttttccctcttgttgcccaggctggagtgcaatggcgcgatctcggctcaccacaacctccgcctcccaggttcaagtgattctcctgcctcagcctcccgagtagctgcgattacaggcatgtgccaccatgccaggctaattttgtatttttagtagagatgggctttctccatgttggtcaggctggtctcgaactcccgactgcaggtgatctgcctgccttggcctcctaaagtgctgggattacaggcatgagccaccatgcccagccgaaaacatattttaaagaaaacaattattctcacatttatctgttctgtaatatttttgcaatgacttctcttgaaaagatacatacctaaacaaaaaaggtttcattatttagtataaaaatgaatatgttatggtaacataacaaagtggggaacattcagggtacatgaaaaataatcacaatcatacatcactgctattacaactattacatttcaacatgaaaaattgctacgaaacttctagtagaaaaaaatggtttcgtttaagctataggtgttaagctgtcatttagtttcaattttgtttcaataatacagtgttttgttgttgttgtttctgagatggagtctcgctctgtcactcaggctggagtgcagtggcactatctcagctcactgcaacctccatctcccaggttcaagcaattctcctgcctcagctcccgagtggctgggactacaggcatgtgccaccacacttggctaatttttgtatttttagtagagacagggtttctccatgttggccaggctggtctcggactcctgacctcaggtgatccacccacctcagcctcccaaagtgctgggattataggcgtttgagtcagcgtgctcggccgatacagtgtctttttaatgcacgtgtgttcctaaaaagatcattaattactcaggaacaagagtaacatcttaattatatgggctttcctatgtttatcccacacctcatctaaggataatgtaatggacaactggaagtaaaacaaaatctatctctaaaaagtcaacagggagatcaccagaccaacatgctgtatttaagcaaaagtaccttaggctttcactcagaatcatttctatacatataatttacacacgggtcaaattcacaaaatgacaacaaaataaataaatatcacatgcctactccatagaaatgcaaggaaaacagaagtctttaaaaatgtccaatcatctctcaatgaattgccaacatctatttttactacgggctaacagcttgggacccgggctcctgccactcaagaatggcacctaaaccagcagcagcagttggcagcttgttagaaatgcagactcttgagcctcactcaggactactaagacagaatgcacatttgaacatctccagatgactgatactgagaagcactgacccaaaggctagatgaatgaaagataaaccaagcagcttctaatgagaacactagctacagtaaagtttatataaattccaatcacccttaaagcaaaccagccttaaatacatacccatcctcatagttccacatgaatatatcactgtcaattgtgagccaagctctgctgataggagggaacacacccatcatgcaattacactgcatatctgaggtagtgtggatgtaaggcagacagaggtgaatcttattcttctttaacttgtttcaatagcttttgacttaatatttacgtaaaaaatcacaatgtgtccactctttaatacaacatggaacccatatacttaaacgaattttaaataaaacccttaaatgaatatataacacattaattaaacatagaacaagaattataagaatgaaaaataccaattttaacatttttaaaataaatacaaagtaataggatacgtccaaactgctcaacaagttcaggtgggagaggaactcttcggatggaactgatctctggaaggttgggtacggacagcaaaccaggtccttgcaaaggataatccatatctgacatgccagaaacggtgggattatctacaaaaagaaaatgaagtatttataataatgtactgctcatcaaccgggcaaacaaaaggattgagtgccacaaaaaaattgttgtgtgttggttccaaaggtacagagagaatattctagttttgacccaacacaaagtagtcctgaaatattcccttgtgaaggtaggaacagttactggtttcaggcctaaagggaaagtcatatctcaaaaaacttgctctgtaacaaaggaaatgtttattttattttattttttttttttttgagatagagtctcgcactgtcgcccaggctggagtgcagtggcacaatctcggctcactgcaagctccacctcccgggttcacgccattctcctgcctcagtctcccaagtagctgagactacaggcgtccgccaccacacccggctaattttttgtatttttagtagaaacggggtttcaccgtgttagccaggctggtcttgatctcctgacctcatgatccgcccgcctcggcctcccaaaaggctaggattacaggtgtgagccaccgtgcccagctggaaatgtttaaatttgataatttagtgttattttaaaataaaagtggctgggcgcagtggctcaagcctgtaatcctagcactttgggaggccgaggtaggaggatcatgaggtcaggagtttgagactagcctggccaacatggtgaaactccatctctactaaagacacaaaaaattagcctgcctggtggcgtgcgcctataatcccagctactgcggaggctgaggcagaactgcttgaacccgggaggcggaagttgcagtgagctgagattgtgtcattgcattccagcctgagcgacagggcaagactctgtctcaaaaataaataaataaataaataaacaaaatgaaagcatgtaattgtattgtttgtaacacaaaggataaatgcttgagaggatagataccccattttccctgatgtgatcatttcacattgcatgcctgtatcaaaacatctcatgcaccacataaatatatacaccgttgggcgcggtagctcacgcctgtaatcccagcactttgggaggcagaggcaagccgatcacaaggtcaggagttcaagaccagcctggccaaaatggtgaaaccctgtctccactaaaaatacaaaaaaattagccaggcacagtagcaagcacctataatcccagctacttgggaggctgaggcaggagaactgcttgaacctgggaggcggaggcagcagtgagccaagatcgtgccactgcactccagccagggtgacagagcaagactctgtctcggggagaaaaaaaaaaaaaaaaaaaaaaaaaatatatatatatatacacacacacacacacacacacacacacacacacacacacagacgcctactatgtacacacaaaattaaaaataaaaaaatttaaaaataataatttagtgtttttctatcattttgctaatctgaaatgggaaaatataaaactgctttggggctcaaaggtaaaatgactataagcaaacaaaataatgactgggggaaaatactgcctttaccagctaaacatttatagattaaaacaacccatgacttttccctttagatttatccccaagaccactaagacaaatacaaataataccccacaagcagtatcttattggggggataaaaacaaagactgctctataaagtgttctcatgggcaacctttctcttgctctaagactccatcactaaggacaggagtgggctggtctactcagcctacccttgctcccggacaaggcgttatttagacctgactgatgacctacttatctcaggcactttctcaggttctatagagtacaaagatgttaaggaaaactgacatataaaacaatcttgaagtgtattatggaaatttttaaaatatatataagaaaaatacaataaatacccatgtactgattatccaacttaataaccagtaatatccccaatcatgtttcatttttatcattgttcactccttccccaattatctttttatttttattttttgagacggagtctcgctctgacgccaagctagagtgcattggcgcgatctcagctcactgcaacctccaattccctggttcaagggattctcctgcctcagactcccgggtagctgggattacaggcatgagccaccacgcccagctaatttttgtagttttaatagagacaaggtttcaccatgttggccaggatagtctcaatctttttttttttttttttgagacggagtctcacaggctggagtgcagtggcctgatctcagctcactgcaagctccaccacctgggttcaggccattcttctgtctcagcctcccaagtagctgggactacaggcgcctgttgccacgccaggctaatttttttatttttagtagagacggggtgtcaccgtgttagccaggatggtctcgatctcccgacctcgtgatctgcccgcttcggcctcccaaagtgctgggattacaggcgtgagccaccgtgcccggccggtctcaatctcttgacctcgtaatccgcctgccttggcctcccaaagtgctgggattacagatgtgagccactgcacccggccgaactctttttctctttttttttttttcctgagacggggtttcactctgtcgccttggctggaatgcagtggtgcaatcacagctcagggcaacctcagcctcttgggctcaagcaatcttccaccacagcctcgtgagtagctaggactacagtgtcatgacaccatgcctagctaattttttttttgtttttggggtttttttttgggatgggctctcgctctgtcgcccaggctgtagtgcaatggcggctcactgcaacctctgcctcccaggttcaagagattctcctgcctcagcctcccgagatgccaggactacaggagtgtgccaccacacccggctaatttttgtatttttagtagagacaggatttcgccatgatggccaggctagtctcaaactcctgacctcaagtgatccactcacctttgcctcccaaattgctgagattacaggagtaaaccaccgagcccagccaaacagcatttttctttttcctttttttttttttttgagacggagtctcactctgtcgcccaggctggaatgcagtggcgcgatctcggctcactgcaagctccgcctcccgggttcacaccattctcctgtctcagcctccggagtagctgggactataggcgcccgccaccacgcccggctaattattttgtatttttagtagagatgggggtttcaccatgttagccaggatggtctcatctcctgacctcgtgatccgcccacctgggcctcccatttcttttgagaaagagtctccctctattgccctggctggagtacagtggcgcgatctcggctcactgcaacttccgcctccctggttcaagcgattgtcctgcctcagcctcctgaataactgggattacagccatgagccaccacacccagctaatttttgtatttttagtagagacggggttttaccacgttggtcaggctggtcttgaactcctaacctcgtgatctgccacctcagcctcccaaagtgctgggattatgggcgtgagccaccgcacccagccactttttgtagagacagggttttgccatgttgctcactcaggctggtctcaaactcaagctcaagtgatccaccccacttccaggtcccaaattgctaggattacaggcatgaggcacagcgccaggccttttttttttttttttttttttttttttgagacagggtctcactctgttgcccaggctggagtgcagcggcgcaatcacagctccctgcagtctcaacctccccgtctcaagttatcctcccacctcagcctcccaagtagctgggggtccaagtgtgtgtcaccatgccaagctaatttttgtattattgtatttcttttctttaagaggctgggttttgccatattgccaagactggtctcaaacttctgggctcaagtaatctgcccactttggcctcccaaagtgctgagactattgggctgaattcatattaaagcaaatccaggctgggcacagtgggtgacacctgtaatcccaacactttgggaggccgaggcgggcggatcacatgaggtcaggagatcaagaccaacctggccaacacggtgaaaccctgtctctactaaaaatagaaaaatgagccagtggcgaacacctatgatcccagctactcaggaggctgaggcaggagcatcgcttgaacctgggaggtggaggccgtagtgagccaagattatgccaactgcactccaggctgggtgacagtaagactctgtctcaaaaaataaataaataaagcaaatccagacatcccatttaatcctaaaacataactttaataggccgaaggtggcagatcaccatgttaaatggcagtgggaacacagagggaggaatcgataactttagtgaggatgggaatgctacgaaagacttcaggccaggagtgtgacttacatctgtaatctcagcactttggaaggctgaggtaggaggactgcttgatgccaggaatttgagaccagccttgtaacagagtgagactacgtctctacataaaaattaaaaattagctgggtgtggtggcaggcgcctgtagtcccagctactggggagggcaaggcgggaggaccacttgagctcatgagttagaggctgcaatgagctgtgatcatgccactgcactccagcctggtaacagaactagaccttgactcaaaaaaaaagaacaagaaaaagaaagacaacaaagagaaactaaggactttcacagggagtctggaaaaagtttgtcaggcaaaaaaagaacattgcagaaacaataaaagtaagataaaatcctgaggaaatcctgaagatggggcttcttacggaaaatatgctaaattctctgtaatcagagcaacggatgaaaaattggatggaaaagaaggggaagagactgggtgaaagaggaaggtgtgtgtaaaggcatgagatatgtaagagaaggaccagaatgcatgcactgtttttatatcttgttttcacacctaaggaggccaaaatgagtaatgttgttcaagatgataattgctaataggccaatcaggtattataagacacgctcattggtaagtagctgtagggagcaaatactatctttgtttctatcatttctttgattacaaagctatcaatgatttttataaataatcagaagtgttctcggtttacactgcacaaattatcctatttagattactttggttcttgctcaccaacaatcttttctttcttacacttcgctggttttctccaaattccatctcacaaaggggtcactttttctagcaactgatgtaattccataagccgtggggagctggttataacttaaaactgttaaacaaattactttccagtcacctatattgtcaacacatattctgccttactctccctgtacataagcactgtgatttccctgttctctttctttattccactggtagttcttttaagatcctccagcatttcataacacacatctctacacataataaagcgtttcttggccgggtgcagtggcttgcgcctgtaatcccagcactttgggaggccgaggcgggcggatcacttgaggtcagagttcgtgaccagccaggccaatatggtgaaaccccgtctctacttaaaaaacacaaaaattagccgggcttggtggcaggcgcctgtaatctcagctacttgggagtctgaggcagaagaatcgcttgaacccaggaggcggaggttgcaatgagccgagatcgcgccattgcacttcagcctgggcgaagagggaaccgctccgtctcaataaataaacaaataaatataaagcaaagcgtatctttaagataacatgctaaatttccaaattaacttcgtttgctcttacgatctactcaaacactaacaggagaaatgaacaaatttgggacttggatctggagatgcttctcatatggccttagccataagcacttgagagcggcgagaagctcattaaggttgaggtctttgcctctttctgcttcaactgggagcttgctcttcactcttgccctctcaagtatctacaatgaagaaagtgaggaaaggaaaaaacctgaaaagaagctgcttgctgttctccaaaaatgcagccaacagtgccataaatctcagcatatcctcgccgggaccaacgctggggataagtagcaaattaggaagtcaggcgagagtcctttaggttgagaaagcagggtcactatcactcacttggggcagacaccataagcagctcggaaaggtccgggtacatgcggtcctcttgcaactgacggtcgatgagccgtccagcattttccagagcttcctgcagggctgcggcagatgtagaggccggcatcgccgcgcccaacaaagaagacggcatctcggaaatcgtagacaccagggtccagaaaaagtcaaaaaccaaggagaaacaagaaaagatccaagaagttagcttagatccgccgcctagggcgcgcgcgccaaacgagcgcctt

SEQ ID NO: 1733 - DNA, 64010 bp, Homo sapiens
ggaaaatagtcaatctagacattttattaagttctattaaaaaatattaagacatctgaaaaactcagaaagtttataaaacacactcatactcaataattttcttattctttgatagccagtgtgacatgttgaagatgttacaccaaaaccaacccaccatactgcaaaaagctgtatctcgagtttaatcaacatgcatcctaattaaggggaaatacactcttgtataaaagagtgtaagtttttattaagttgtttttaaaaataacttttcccttaaacttaggaagggttgatttcgctaatttacccaacaccatgataacttatgttcttttaatgatataggataaatgcagagatgcaacatgctggaacttcttaaaatatacagtatagctgggcgcagtggctcacgcctgtaatcccagcactttaggaggccgaggcgggcggatcacctgaggtcgggagtttgagaccagcctgaccaacatggagaaaccagtctctactaaaaatacaaaattagccaggcgttgtggcacatgcctgtaatcccagctacctgggaagatgaagcaggaaaatcgcttgaacccaggaggcagaggttgcagtgatctgagatcctgccattgcactccagcctgggctacaagagcaaaactccgtctcaaaaaaaaaagtacagtataaaagagcagttgagacttagagctggatagtatctgtctactacttaaacttgtaggaataactgatctcagggcttttcttaaaggtttcagtgatgttgaacagctctatttgaacaatgagaacttagtcctatcaccagccagccatctcacagaagtcactcttcccaattggctgctaccaagaaacagtgactccagaatgatcaggagccttgtggtaggctcctgttttccctaagtatcttcaggagacaccctgtccctgtattaaaagggcagggagttaaaaggttaaaataattttggtaactgtctgagacgttttacatctaagaaggtgcctactgaattcatgctattcatctgctttagcgtttcagaaggttgcaaactttcaggaaaaattgtaatgtccccttcattttctttctcaggatgttgagtgaactctgctttcccggttcgaaggttcactgcaggacttggtttaaggttctttactaagaaagctggcttttcagtcaactgctgttttgcttttgtctgcaaaacttcatttgtaatatttctcaatactggcgtatctgcgttggtccccacagattcacagttagaacaattaattatttcatggtcattcttagaaggctctttctgaccaccaagctgttcaggtatggacctaaggttctgattcaataaatattcactcttgctatctgcattgtcgggaggttcctcttcatcttcactattgtcactgctttgtaggagtccatatctcttcatatattttttggttgcaaatgacatgttgtttggtgaaattaaactaagccccactgtgcttctgtctgtattaatatggagaaggctgaatgggtcacaattattttggttcgatcgagtgacagacagttgtgacagctgattttcatttaaatatttcagagctatagcatttgcctccatgctcaaatccacaccattggggcttaagccgctcatgccaacattagcaaatgacatgcagtttaatccagagatcactgcttctgggctgatgcatgccaacacactgaaagacacaaagtagtaagccatcatttaccatattctaagtaatacatagttctcaatgtgttccattctatacaagcaacaaaagatcttcagctttaagttcatggtccttttatctaactactcagacatctaagtcttgatgatccagatacacaaaggatacatatgggctgggtatagtggcccaagcctccaatcccagcagattggggcactgaggtgggaggattgcttgaagccaggagttcaagatcagcctaggcaatatagcaagatcttgtctctacaaaaaaatttaaaaattggccaggcatggtggtgcacatttatagtcccaactactcaagaggctgaggcaggaggattgcttgagctcaagagttcaaagttacagtgagccatgatcgtgccactgcactccagcctgggcaacagaacaagaccctgtctcttaaaaaagaaaaaataaagaaaaaataaaaaaagggatacaaataatagcctagaaggtaatccatgatttacaggtttaaagtggaatacaaattaattttcctaaatctgtatatcagtcatggttttaagaacaaatacaaggccccaaatgtaaaagtcatcaacatagctatgagtcatttaatttacgactattagcccaaacagcacaagagatcagctaatgtttaatgtaaagtaaaacataaaaataaaatcaaacacaaaacacatttgattatataacagtacaagctttagtaagtagctcagaaaattaaattgttcatagttgaagagattccatttgcaattaataaaaaacatcaaccagtctctggatatgggcttatacacacacacacacacacacacacacacacacacacacacacacacgaatacttttttcattagttataatcttcaacttactttgattagtgttaagtcaactgacttaccttttccttaatatcacatatataataaatagctgctaatttttttttttggagacagggtcttgctctgttgcccagtctagagtacagtggcaactgcatgtcatttgctaatgttggcacaattacagactcaggctgctctcaaactcctgaggtaaagcgagcctccctcctcgaattcccaaaagtgttgggattacaggcgtgagccactgtacccagcctgctaattactgagtcgttatatatgccaggtactctattaatgctttacatgcattattcatatacattccttacagtaacctttgtcagggaggtattctctatggaatatttctatcttattctccatttcaacatcttacattccctttcccctacttttttgttttctttttagcacttaccgcggtctatacattgaatacacacatctacatattcaatcaatgctcgattcttatttattgtctagcaccctcatgaaagccaataaggacagagttttgtctgttctcctggcccccactgcagtatcctcgatgcctggacacacatagtaggcactcagtaagtacttgttgaatgaataaaagtagtaggtactattgttatatttactctcagttgagaaaactgaggaatagagatttgagctattttttccaagctaaatagtacatagcaagctgagataatccatgactgccttactctctggggctctgcaaccactcttttactgtactatattcagtaacttggattttttctatcagagtcctttgtgcactatttgttgtggtgaacattatattctagtcaaatatgctatggctttctacatcatcccatgaagaaattcagctgttttatatgtgctagccactgcttgcattcacagacccacaaaaatcaaacaaccattatatattttcattcttataagcacctgaaattcgcaaaaaactatttccaaccactaataatccctgaaaccaggccaggcatggtggctcccgcctgtaatcccagcactttgggaggccgaggtgagcagatcacctgaggtcaggagtttgagaccaacctggccaacatggcaaaaccccgtctctactaaaaatacaaaaaaattagctgggcgtggtggcgggtgcctgtaatcccagctactctgtaggctgagacaggagaatcggttaaacacaggaggcggaggttgcagtgagccgagattgcgtcactgcattccagcctaggtgacagagtgagactctgtctcaaaaaaaaaaaaaaaaaaaaaaaaaaaaaaattctctgaaaccagtgatgccatcaccaaacaatggaacagtgtgctcactaatgctggtctttacaaccttgaaattctcccttaatcttcttggcatttaatgctttgaagactattttaataagatgaaagagatactactaatttatccagacattattcttttattcatagtgacaatacttttggaagtctttttctactttgcctatttcctcagtctatagataatgttaatgtaaataatttgataaaagcaaagaaaaactactaattcaaaatgttaaatatttaaagaaagcaggtctaatttgggttttttttttgttttttttgagacaaggtctcactctgccactaaggctggagtgcagtggcgcaatcatggctcaccatggcatcgacctcccagactcaagtgaccctcctacctcagcctcccaagtagctgggactacaggtgcatgccaccatgcccagctaatcaaaaatttttctttttgtaaagatggggtctcactatgttgttcaggctggtcttgaactcctgagctccagtgatcctcccatcttggcctcccaaagtgctgggataacaggcatgagacaccatgcccagcctcttaattttaactagggcttcttttatagaatggttaaaagatccataaagtagtcaatatcagtttagaaggctattcaagtttcaatgcctaacacaagctagccaatttcaatttggagggtgggctaggggcaatgagatatcattactttaatagcaaaacaaatcaagacaggcacagtggtatgcacacctgtagtcctagcttctcaggagcctgaggcaggaggattgcttaagcccaggcattcaaggggccaccctaggcaaaatagagaccacatcactaaaaaaaaaatcaataatactcagaaaccaaagcatataaacactagggtaattaagacgaaaagcaaaaaggaacccattccactaatcaaatcctaaaagcctgagcacaaatatatgcctatgttaaaatctcattagatgtgcagccacaaggaatgatgaaagtccatgaataaatttgagttagccacatgtcaacaatttatgggaagctctaaaattattccaactcagatgacaatcaagacccccatctctacaaataaaaataagctgggtgtgctgctgcacacctgtagtcccagctactcaggaagctaaagtgggaggatcacttgagcccaggagattgaggctgcagttgagccatgattgtgccactgcactgcagcctgggcaacagagcgagaccctgtctctcaaaaaaaaaaaaaaaaaagtcaactttgattcatgatcctatttgaatccagattagttatctactacttatcctacacagtttttcaactactaagcagatagccaggaagcaaggtaaagaagcaactagagagactacttgagacaggttttgaattcaaaaagtcactccaattgggaatatgtagaggttgcttccagacctcgaacccacaatctccatttcctgcacaatttctaggtttgtctggcaccctttttccctgccttcctgcctttagactctcttaatctctgcggcattctattaacaggaaaatagaaagcaggtcttccttcccctgccttagccactcttctggcggaatgatgtgctcctggagtccagaactggaacatgaaatgagttttcacatagacacaatgataaaagacggctgatttacagagctagaggaacagcatggattataaggattagtttcctagaatattcaacctataatctgtaacactgtttctatagaaaaatgtgtcttacattctaaacaacggccttataaacttttagtataccagttatattatacctacacatgttaaaaagttaacaatataagattataaatactgacagtaaatactacaaagacactaaaaatgaaccttcactgtaagcgtcggtgatgacctgagtaggaggaatgtcgttcattcagcaaatgactcattgaaggcccactaagttagtggtagaggcaatgaggatttagaactatataaaatcttcgctggagcagtggctcatgcctgcaatcccagcactttgggaggccgagactggcagatcacaaggtcaggagtttgagactagcctggccaatatagtgaaaccccgtctctactaaaaacacaaaacttagctgggcgtggtggtgcgcacctgtagtcccagctactcaggaggcggaggcagaagaattgcttgaacctggggggcggaggttgcagtgagccaagatcatgccactacactccagcctgggcgacagagcgagactccatctcaaaaaaaaaaaaaaaaaaatcttgctgaaaatgtgtcataagtacatgctacaatttactgagaacgaggtattttaagagtacaaaacatcggccaggcacggtggctcacgcctgtaatcccagcactttgggaggccgaggcaggtggatcatctgaggttgggagttcgagaccagcctgactaacatggagaaaccctgtctctactaaaagtacaaaattagccgggcatggtggcgcatgcctgtaatcccagctactcaggaaggctgaggcaggagaaatcacttgaagccgggaggtgaaggttatggtgagcccagatcatgccactgcactccagcctgggcaataagagtacaaaacatcaatacactctgagaggtccaggaaactgaccaaagaggtgacatttgagttcagctttgaaggataaggattttggcaagcagaaaggtaaaaaaaaagagcacctcagataaaagtaacatcaaggaatcttgcaaatgccaatggcaagtaggctggaacttggtagagaatggtaggacattatactaaaaaactaagtttaagtcaaactgaaacaatgcgaattaatcaggtaggcctcagataggctgggaggatattccagacggagcctaagataacagggaaactaaatttaactcttatgttggagaaactattgcagtacagtttcctatttaatcaaaatgacatagagatgatggcacacgcctgtggtcccagctactcaaaaagctgaggcaggaggattggcttcagcccaggagtttgaggttacataaattatgattgtaccatcatactccagcctgggtgacaggcctgggtgacagagcaagatcctatttttaaaaactaaaaaaaagttttaaatatacagatattgcatcaataataaaatataactttcaaaactttaagatatttttggtcttaattagtacagatctttaaaaggggccattttgatgtagatcaattacaacacagtatgaaatactcctaaagttagctacctttcttttttcctttcctttataaattaagttagctacctttcctatgtgattccatggcattccctatccttccatttcatagcaggcataaaagatattgactatctgtgtcttccccactgaactgtaaactctatgagaacaaagatgtctttctttatcaggttatcttgtgtattacgatatctcttataggctggctcatagaaactcagtaagtatttgttgaagtgaatgtattggtgaaatggtagctggcacacatgtatatgtgtagctggtaataatacttactctttcagaaagcaacttagcaacagctttaaaatttttgtatcattttaccttagtctttccatttccgagattctattctaaggaaataatcctaaaactgaaaagcaatatttgcaaaagatcatcacagcaacattaaaatagtaagaaaccacaactaacgtgacaagttggttctcagttctgacaagaggggaagggttaggatacatagcctctatcttgcaacatggataaaaaactcaaaaatgctagcctcactcttttacactattggtaggaatataaactggtacaactatttgatgagcaatggtagcatctactaagactttgaatgcacatactctttgatcctgcctatctaggaatttatcctacaaagatacttgtacctgtagaatgatgttcacttaggattgcttgaaataacaaataagagatttggcctaaaggtccattaatagagcactggggttcaatatattctagtacaagggtacaaaagaatattatgcagctgtttaaatacaagagaaagaactgtatatccctataaggaaaagtatccaagatattataatatcatgtttaaaacaaaaacaaaaaaacaggccaggtgcagtggctcacggctgtaatcctagcactttgggaggccaaggtgggaagattgcttgagtctaagagtttgtctgagaccagactgggcaacatagcaagacaccatctctgcaaaaaataaaaaattagctaagtactggtgcaagcctgtagtgccagctactcaaaaggctgagatgggaggctcacttgagtccaggaggttgaggctgcagtgagctgtgatcatgccactgcactccagcctgggtgacagagcgagactgtctcaaaattaaaacaacagcaacaacaacaaaaaatcaaatcacaaagcttatcacatacacatatacttgaacatgcatggaacatttctagaatacaaaagaaatggttaagagaagtaactttgcttttttttttttttgagacagtcttgctttgctatccaagctggagtgcagtggcgcaatctcggctcactgcaagctctgcctcctgggttcacgccattctcgtgcctcagcctcctgagtagctgggactacaggcgcccaccaccacgctcagctaattttttgtatttttagtagagacggggtttcaccgtgttagccagaatggtcttgatctcctgacctcgtgatccgcccacctcggcttcccaaagtgctgggattacaggtgtgaggtaccgcgcccggccttttttttttttttttttttgactgagtcttgctctgtcgtccaggctagatagagtgcagtggcgctatctcggctcactgcgacctctgcctccccgggttcaggcaattctcttgcctcagcctcccaagtagctgagattacaggcgcccgccaccgcacccatctaatttttgtatttttagtagagacggggtttcaccatcttggccaggctggtctcgaactcctgacctcatgattcacctgcctcagccctgcaaagtgctgggattacaggcgtgagccaccgcgcccggcctaagagaagtaactttggaagagtcaggcaggaatgtggggagttgtggcttttgcattttatcttacactctcttctgtattgttttttaaaaccatgaatttttattactttttaaattagaaaacaaaaaataattaacagaaaatatgccagccttaataatataatctccagactttattttctttttaataagttatgtgctgaggtcatctttggtagaaaggaatctgaacagaaggacatgaccagttgggcacattcccagaaaaaagaaatatttttgctttttagatggcacgactgtgtaactgtacatccagtagctggaacagaccttatcacctccagaaagacttttcagatgctaccaagcaaaactcctttctctttcctcaagactcctaaagtattttgttggcctatccagccaggagtcatcccacaatatctctcaaattacttatgtatgtaaccctctctcccactaaaatgaagaatctcttattcatcatgcatatggtaggccctgaataaatcgtgaatcaactcaattgaggcacaaacgtaacttttctgatgagattgccacaatacatctaaaatttattcatctagccaatgatgggcaaaaataaataaaaatttttaaaaaataaaatttattcactctttaaaacaaaattttaaaagttacctggcgtgatccacgttatgtgcatttttcttcactttagtgggagaatcaatttttactccaaggcttcttagttgcttaagagttgcattaaggacacaatctttgtccaccagtcttgaatgatgtgtttttttctttgtatggtaaacgttttgggttctggtgcattcatgactgataattactgctttggtagacggctgctcagtttccttggaggaactatttaataggtggtttacttgaccctgacaaaaagaaaaaaaatttttttgaaaaatcactattaacaatgttagggctgggtgtggtggttcacacctataatcccagcactttgggaagccaaggcaggaagatcgcttgagcccaggagtttaagaccctgggcaacacagcgagatcctgtctctacaaaaaactaaaaattagctgggcacggtggcacacgcctgtagttccagctacttaggaggctgaagtaggaggaccacttgagccacgaggctgaggctgcagttagccgtgattgtgccactatatcctgcgtgacaaagtgagactctgtctctaaaaaaattaaaattaaaaaaaagttaaaaaacaattttacagtaagaccttaatgatacaacaaggccagggaaaatcagtatcttgtcaaattccacaaagtatcaagtaggcaggtattatggtattatttgcaggtattatgaagtttttatagaagcacatcctaatgaacaatttcatcagaccctagagaaaacagaatgcttgttcagacttcattcacttaaaaaccaacataagctgggcgtggtggctcacacctgtaatcccagcactttgggaggccaaggtgggcggatcactttaggtcaggagttcaagaccagcctagccaacatggtgaaaccctgtctctaataaaaatacaaaaattagccgggtgtggtggcacgtacctgtggtcccggctatttgggaggctgaggcatgagaatcacttgaacccagaaggcccaggttgcagagagctgagatggcgccactgtactccagcctgggtgacagagtgagactctgtctaaaaaaaataaataaataaaatagaaaataaacaaataaaaataaaaaccaacgtatttaaaaatcatttgagtacaggcgtgtggctcaaacctgtaatcccagcactttgggaggccaaggcgggcagatcacttgaggccaggagttcaagaccagcctggctaacatggtgaaaccccatctctgctaaaaatacaaaaattagccgggtgtggtggcgtgcacctgtggtcccagctacttgaaaggctgatgcaggagaatcacttgaacctgggaggcagaagctgcagtaagctgagatcatgtcactgcattccagcctgggcaacagaaacacagtgagactctgtctcaaaaaaaaaaaaaaaaattagccaggcatggtggcaggtgcctgtagtcccagctacttggaaggctgaggcacaagaatcgcttgaacctgggaggcagaggttacagtgagctgagatcatgtcactgcactctagcctgggtgacagagactctgtctcaaaaaaaaaaaaaaaaatcttttgagtaattctccaagtattttcgaggacttatgctaaattttttataaacaagttttaaataatgctttcgtttgcaaagtgataatgtttcagttataaattaggcctttatgatgttcacagagttaggctccttttcttctcactttctcaaagtaagaatgacctgtgatactatttctgcatatttcattccctgagcatacaagctgctagcaccagcctaggacctagcaagcaaataacaaatatgtgttcattgatgaatacatagggccctgtgaagtatgttgccttctcgcaaatggacaaatcaaatgttctacaatttggatgaaagtgacagtcagggtttctctatcctttaagtcccagatcacattttaagttttataatactagttcctccaaccagaattacccctttattctgtgttctctttgctttacactactactcctcaacagcctgtcttataattgttactagtctgcatgtgctgttgtttcccctaggctctcaagggcacagagtgtcatattcacctttatattatcgatttcacttagcctactgtcttagactaagctaagtatttaataaacattggcttacctgaactaaaatcagtaaatgttatcataaatatcccactactttccaattttcaaatttccgagaaactcttgcttattttctaatactaattttggtttgaattaggcataatatcaatatttatactttaaaaataaagctgtgtttttctaagtacttaagtatgtttatggtaaattagtgaatttaagttataatttatgaaaagctaaaagaaaaattacattgttaattagacaaaaaatctttttatcttaaggtctcaatcagtttaaacctaggaaaagcttaactagtatatcctatactaaataaccttctcaaaaagatgaaatgctctacattttcttaccaataaatcctggtaaattttctggttatctgatggttgatgaagcaagggttgcattacatgctcaatttttggttcctctgatgtttcagaattgttactggcaccccctgttggtccagtctgtaaacacatgcttacactttctgccagctggccacttggaaagaacacaggtacatcaggttcttttctcacaactagagaagagctgctgggaaggatatataatgtgttagtcattgaggtacctttaacatataattgaaatgtagtaactttagaaaaaagggttaagactcaagcagcacctggttgtatttttagctcttagtgatgatgctacataaacaccccatcttagccaggtgcagtggctcatgcctgtaatctgtgttttgggagagcaaggcaagagaagtttgaggtaagaagttcaagatcagactggggaatatatcgagaccccatctccacaaaaaatttgttttaattagctgggtgtgacaccatgcacctgtaatcctagctgctcaggaggctgagcaagaggatcacttagcccaggaattcgaggctgcagtgagctatgattgtaccactgcactcagcctaggcatcagagcaagaccctatttctataagaaacaaaaacgaaaacacctcgttttaacaggctgcatataaactaaaccatggtaccttttaacttgtgttacttatatttaagacaactttctttgaagcctggaaaacaagctgttgatttctcctgaacttgatggcaatggaaatttttagagcatttaaatattttaggtatgttatttgttcattccaagttttttttttttttttttttttttttgagacagagtctcaccatgtcacccaggctggaatgtagtggcgtcatctcggctgactgtaacctctgccttctgggttcaagcgattctcctgcctcagcctcctgagtagctgggattacaggcatgcaccaccatgctcagctagtttctgtatttttagtagagatggggtttcaccatgttggccaggctggtctcgaactcctgacctcaggtgatctgcctgcctcagcctccccaagtgctgggattacaggcgtgagccactgcacctggcctcaaggatttaaaaatatctgtcttggtgtctaacctaggaagcaaaaactaaaactgaaaaagaacaaacccaaatcattaaagattacaagggtccttaataaaataacaccaagagctagatagctcctttcaccacgtgaggacacaaggaagaggcatcaactatgaaccaggaaatgggtcctcacaaaacattacatctgctggcgcctcaatcttggagtttccagtcctcagaacaatgagaaacaaatttctgttgtttataagccaaaataaataaataaatgtctacactctttagggggaagaaaaaggaataaataaaaatgtcaaatctcaacaaaagatttaagattaaataaaaaattttaaaatgcttctaatatgccaagtattattaggtatgcccaaagcacagcttctaaagaaaaatatggatcattttaaaagaaagtctctataaatactacataccactactcactgctgggaaaaagtaatcaataaccaatgaagctgcaaggcaaataaatttatctttcacagactacttcaacatcagaaacactggtccaacaagacatctaagggggactggaagccctggagttgcgtgtcatctatgaatactcagcagtgggaaccagagcacgaatcagaccaaaagtgcgagaaggatcccagagaagcaccaaaaccatcatagacaacactggagaaagtatttaatccaaatcaacaacccaaatcaatgctgagcaaagattagatttacatctagttatgtgttgggatcgacagagttaattaattgctctgaaaaagcaattaacttcattctatcaattaactcagatctgtttctaaagttaaaaaaaaaaaaaaaaagccaaaacaagggcatggtggctcacatctttaatcccagcactttgggaggccgagacaagcagatcacttgaggtcaggagttcgagaccagcctggccaacacggtgaaacaccgtcttcactaaaaatacaaaaattagctgggtgtggtggcgtacacttgtaatcccagctacttgagaggctgaggcagaaggatctccggaacccaggaggtggaggttgcagtgaaccaagatcacaccactgcactccagcctgagcaacagagcaacactccatctcccaaaaaaaaaaaaaaaaaaaaaaacacaagattggatattttttaaaattccaatctgaaaacccccattattctagaaagtagtctgcagtttacagagttaaggagaataaataaagatcccatggtttgctcctctttgtcctcagtttctataattattctaaataaactgcagacctactttggggctcaccccatggggaaccagacactgggtcaaactgtagttttttttaattactttttttgaaacagagttggccgggcatggtgactcacacctgtaatcccagcactttgggaggctgaggcgggcagatcatctgaggtcaggagttggagaccagcctggccaacatggagaaaccccgtctctactaaaaatacaaaacttagccgggcatagtggcaagtgcctgtaatcctagctacttggcaggctgaggcaggagaactgcttgtacccgggaggcggagggtgcagtgagctgagctgagattgcgccactgcactccaacctggatgacagagcaagactgtctcaaaaaaaaaaaaaaaaaaaaaaagaaacagtctctctctgtcacccaggctggagtgcagtggcgtgatcacagctcactgcagactcaacttcccaggctccagcaatcctcccaccttagcctcccgaacagctgggaccaagggctaatttctgtaattttggtagagacagggtttcgccatgttacccaggctggtctcaaataccttagcacaagcaatcggttcactttggcctcccaaagtgctaagattacaggcatgagccaccaagcccagcaaattctaaaaatatggaaattactatgatccttaccctgcaggaactcaatctaacatacacaaaagagcttttctgtatactgtggcacacacaatgagtgcttaattttatcatatgattaaaacatatactatactaaaaggagatgtttctctgtagttttctgaagggacatgtttattgtcttaaccattattgtaatcacaatgatttaaaatgtcaaatatcacaaggcttattaatttctaaaaagtaatccactgcctgccccatgtcaccttaccagttcacctttttttatttttagaaatggagtctcactctgttattgaagccagagtacaatggcacttatcatagatcactgcaacctcaaacttctggtctcaagcgatcctcctgtttcagcctcctgagtaggtggaactactacaggcacataccaccacacccagctaagttaaaatatttttttatagagacagggtctcactattttgcctagcctggtcttgaatttcaaattaacctctttaaactgtttcatgtgctattatcctgggatgttttatacctacatttttcttttaccttcaaaatttatcctacacctgatcccttccacgaattccacaagtccaagacatcttcatctcacttggtctttagtttattaatcagttagtatcttaacttccactcttaacatccttcagttctccacgaaacaattagaatggtcttcaaaaaatgaaaatcagatcataacactccattatctaaaatcctccactagctttaatgagcatgcaataaattaaaaaatcttttctatatcctacaaagccccatataacttggctcctgcctgtatctcagacttcatttcctatactctccctctcaatcactatgtccagccacactggctttcatgcttttttctgtaacttttaaacccacacttgccattacacttgctttttcctccacttggaatactcatccccagatattatcatgactggctccttctcatcattcaggtcactactcaaatgtcaccccctcacagagatggtttcctttaccactctacttaatataacaccttgttcccaggttaccatcccagttacactccacttgatcactctagtttactttttcagagcagttgtcactatctgaaactatgttatttgctgctcatgtggttaaattccataaagttaggagctttgcctaacctagtatttgatatttagtgtctagttttgtggtagcacgtaccagaaactcaaatatttgctgagtttgtttccaaatttgctgaggatataaattactttaggccaggtgcagtggctcataccagtaatcccaacaatttgaaaggccgaggcaggtggctaacctgaggtcaggagttcaagaccaccctggctaacatggcaaaaccctgtctctactaaaaacacaaaaattagccaggtgtggtggcccgtgcctgtagtcccagctacttgggaggctgaggttgcagtgagccaagatcacgccaccgtactccagccagggcgacagagcgagtatctaaaaaaaaaaaaaaaaaaaaaaatttactttagaatccgttttttgttttgttttgttttgagacttagtcttgctctgtcacccaggctggaatgcagtggcgcaatctcggctcactgcaacctccacctcccaggttcaggcaattctcctgcctcagcctcccaagtacctgggactacatgtgtgcaccaccgtgcccagttacaggtaagagtcactgagcctagcctacgatccttatttaatggaaaatttcataatgaaaaatttcaaacatgagagaattattttacaaatcaccatatacaatcagtttcaaaaattaccaaatagccaatcttatttcatttatactcctagccatttcattctcccacagaattaatttgaagcaaatctcagataacatttcatatataaatattaaggttctatcactcaaaaatagactcttttatatataatggcaatacggagaatctttagaaatctcgccatctcacagtggctcatgcctataatcccagcactttggaaggctgaggcaggcggatcacctcaggtgaggagttccagatcagcctggccaacatgggaagccccatctctactaaaaatacaaaaattagctgggcgtggtggcgcacgcctgtaatcccagctgcttgggaggctgaggctcaagaatgccttgaacctgggaggcagaggttgcagtgagccaagacagtgccattgcactccagcctgggtgaaaaagcgagactcttgtctcaaaaaataaatacataaaataaaataggctgggcacagtggctcatgcctgtaattccagcactttaggaggtcaaggtgggtggatcacctgaggtcaggagttcacgaccagcctggccaacacggcgaaaccccatctctaaaaaaaatacaaacaaaattagcccagcatggtggcaggtgtctgtaatcccagctactcaggaggctgaggcaggagaatcacttgaacccaggaggcagggattgcagtgagtcaagatcgcaccattgcactctagactgagcaacaagagagaaactccatctcataaataaataaataaataaataaataaataaattaaataaaagaaatttctccgccaggtgtggtggctcacgcctgtaatcccagcactttgggaggccgaggcaggcagatcacgaggtcaggagatcgaggccatcctggctaacatggtgaaaccccatctctactaaaaatacaaacacggaattagccgggcatggtggcaggagcctgtagtcccagctacacgggaggcaggagaatggcgtgaacccgggaggtggagattgcagtgagccgagattgcaccactgcactccagcctgggcaacagagcgggactccgtcaaaaaaaaaaaaaaaaaaatttctccatctgtatctggaacctaatattatcagatcctctagggtgaggcctgagcttgtgtatttttgaagttttcttccgatttctgattcatccagactgttaatatagccaaagactgacatctggaaatggttctagaaggctcagagttgtcagttacatagaaatcatatcaagtaaagacataaaagaaaataccagttagaaaatatatcatttctgagttagaagactttaaagaaattagaattaaaaacaaaaaaaaacctgaacagaacagcaactgtaatgaataataatacattgtatatttcaaaattgctaatagtagacttcaaatgtttttaccacagaaaaagttaagtatgtgaagtgatagatttgttggtctgatttaatcattccatactgtaaacatgcatctaaacattgtgccccacaaatatatacaattattatttgtctatcaaaaaaaattttttttgaaagtaggatgaaagactaaatcaaagagaccttacttggatacagaaagtggctggttaaattcttcttccacagcaatgttgctctcttcaaaactgggaatatcaactgcttttaatgaagatgcactacctggaagacttgtgacttcattattaatatcgacagaaaaattcatgtcctcactggaaattttggtatcatcttgcttcatttgagagtcaggctcttgatcctcacctgctgcattccaaaacaagctagcacctggaggttaaataatttaagatactgaaacaaacattcaactttaaaaataatactctgccaaacctttgttaagaatagccatattggctgggtgcaatggctcacgcctataatcccaacactttgagaggcagaggcgggaggatcacttgagctcaggagttcgagaccagcctgggcaacatggagaaatcctgtctctacaaaaaaaatacaaaaaaattagccaggtgtggtggtgtgcctgtagtcccatctactcaggaggcagaggtgtaagatcacttgagcccaggaggtcgatgctgcaatgagctgtgattgtgctactgcattccagcctgggcaactctggctcaaaaaaaaaaaaaaatatatatatatatacacacacacacacacacacacacacacacacacacacaattacttagaactaagtttttagattatatttcctcagaaatgccaggaagaggtaggtggaagacagaaagacaaaacactaggggacgggtcgggtggaagggcacattctgggttctgctttttcaagaagggtggctctgaaatgatttgctttacatattaagattctgaatatgatccgtgggatggggtgtgtatgttgaaaactgctgctctgaataatatgagataatatataaaatacaaatccctaggttctctggttttgacacttaaatgcaatatttaaaagactacattggtgatgcatcagacatctgtaatatctgtaatatcaggcaggtattaaaaaaaatcaagtgtttcccaatctttttttttttttttttttttttttaagacagggtgtcactttgttgctcaggctggagtgcagtgacacaatcacagctcactgcagcctcaacgtccctgggctcaggtgatcctcccacctcagcttcccgagtagctgggactgcaggtgtgcgccaccatatgtggctaatttttgtattttttttaaagatggggcttcatcattttgaccaggctggtctcgaactcctagcatcaggcaatccacctgccttgacctcccaaagtgcaaacattataggcatgagccactgcgcccagccaatttctcaatctttatgaagcacttacacctatcttcagagctatttgcatgtaatattgtttacttactctttctttaaattaactctttttttactgagcctcattatttctctaaaatcacagatttgatatgcttattgtatttatacctatgagtattggaaaagatatatttacaaaatataaatattaatctgtataacaccctaaatcatcttttgtaccacgagccataggcattctataatttggggaatattgctaatacataatggtttaaacagatggttaaaaccaaaaagtagcctgggcacagtggctcatgcctgtaatacaatcccagccctttgggaggctgaggtgggtggatcatgcggtcaggagttggagaccagcctgaccaacatagtgaaaccccatctctactaaaaatacaaaaattagccaggtgtggtggcaggcgcttgtagtcccagctactcaggaaaatcacttgaacccaggaggcggaggttgcagtgagccgagactatgccattgcactccagcctgtgtgacggagtgagactccgtctcaaaaaaaaaaaaaaaaaaaagtaaatcatagtcaaaatggtttctactctgaggatatacttgggtgattttatgaaaataaattaatacaaacaagactggctggacgcggtggctcacgcctgtaatcccaacactttgggaggctgagacaggaggattgcttgaacctaggatggtggaggttgcagtgagctgagagtgcaccacactgcactctagcttgggcaacacagcgagactccatttcaaaaaaaaaaacaaaaaacaaaaaaaaaaccagaattgggtccagcctagaaaagtagcaaaatcaaacactttatcatgttatgcagtttgcaggtgtagttttatttcacaaagactaaaatcacacaaaaacttaagtcatactctcatcaccttggttttggtcctactgcaccatgcaccaatttgaacataaaattcaaaaaccagatatgaaaagcatttttaacaatttccttacaaattaaaaaaaaactgaaattacctgtgctcacagcaatgcttacaccttttctcatgtgcaagccaggggaagactgtgcttccacagaaaccaactccatttgtcttccagcttgcactgtgtcttcaacagcagttgtcttaggggaacagggcatcagagactgtgcttccaacaaacgctgaatctgtatcaattaaaaacatactttaaactgacagggaagtaatcaacaaaactggcagcagtttaataatgaattacaaagcgccctaattataagaaactgacttttaagtctattttctcaaatttcaactagaccataccatgaaacttattcaatatagaaagccattatcactagttattaagaagcactttaagtatactatttttttttttttttgagacaaggtcttgctctgtcacccaggctgtcacccagccgtggtgcaatcatggcttattgcagcctcaacctcctgggctcaatcgatcctcccacctcagcctcctggggtggctgggatgacagccatgcaccaccatgcctggttaattttcacatgttttgtagagatggggttttgccatgttgcccaggctgttctcaaactcctgggctcaagcaatctgcccacctcagcctttaagtatacatttaaaagcaatacataaaggtgtttagcttagtattcgtaagttgatactcatgtaaaaaagtgtgaatggttaatacttcaaactaacattatattcctatttcacttataaatcaaaagttagattggaggtatactctgactctctgactccatataccaaatactgaacatatcacacaagattattataaaggtaaatcagaattgcccatgtttgcccatgttgaaattggatatattaataacaatggctaacagttactgagcgcctgttgtttgcaagaccctattactataggcttttatgtataatttttacagcaatcctctgaagactatattacaattaaacattttttttacaagtaagaaaacctgcggcaaggaaaaagttaagttacttgtataggacatataactaacaagtagcaaatctgaaagctgaggttcaaacaccaaaagcctcccctcttccattttaaattgagatataattcatgtaccatgaaattagctgctttaaagtgtacaattcagtggtttttggtatactcacaaagtgtgcaataatcaccactatctgattccagaacattttcatcaaacccccaaaactctgtacccattagcagccacaccctattgcccttctccggagcccctgacggtctaacatgatttctatctctgaatttgcctattctggacatttcatataaacagtaccatactgtggccttgtatctggcttctttcacttggcataatgttttgaaggttcaaccatgttgcagcatttactaatactttattgcttctgattgctgaataacattcccttgtatggatatatcacattgtgcttttccactcatcagctgacagacatttaggttgttttcactttgggctattaggaataatgctacttggacatttacatacagctttttgtgtggacatatttttttcacttctcttgggtatgtaactaggagtggaagagcctccctttgtaaacactatgattttctgcttctctacaaatggtactactgtgctcaatataattttagtggattaaccttattaatataggaaaataagtatcatcaatcaattattaaggtcagtagaaatataaactgcgctaatagtataaaatggcatgtgtatttatagtggtttggagtacagctttggtatcatgtggctataagtttaaatcctaccctgctaccttttggaaaagttacttaaccactatgagcttcaatatcacctaaaactaaggttgttaaaagagataaataaaacagttgtaatttgttgcgtacttcctctagccaggtcccatactaagtaagcactttacacacacacacacactcatttaatctttaaatctacatataatactgatcatttctcccattttataggtgagaaaagtgaagtgtagagaaatcacataggaaatgtacagtaaaagacattacacacactcaggtcctaaaattgatcactcagtgtttttaaaacattaatcactagaattctatagtgcattttaacatttgaaacagctaatattctttctttctcagaacttttcttttttttctttgagacagagcctcgctctgtcgcccaggctggagtgcagtggcgtatctcagctcactgcaagctccgcctcccgggtccacgccattctcctgcctcagcctcccgagtagctgggactacgccaggctaattttttgtattttttttagtagagacggagtttcactatgttagccaggatggtctcgatctcttgacctcgtgatccacccacctcagcctcccaaagtgctgggattacaggcgtgagccaccacacccagcctctttctcagaacttttagggatcatttggcaggacttcagtgttattttttaaagttcctctcctcaagctgcatcttctccattaaaaaaaaaaaagccattaaagttggaatattgaaatataaagctgtgggtgattaaatcaaatggtaactagtggtggggggcaggcagatatgtggagcagactatagttcagaaatagatgcaaacatatgatactttcattatacaataaaaaatgcatctcttgctgggtgcagtggctcacacctgaaatcccagcactttgggaggccgaggcaggtggatcacctgaggtcaggagttcaagaccagcctagccaacatggtaaaaccctgtctctactaaaaccacaaaaattagccgggcatggtggcacacggctgcaatcccagctactcaggtgataaaggcaggagaatcacttgcacctggaaggcagaggttgcagtgagctgagccagtgccctccagcctgggttacagagcaagactctgtctcatcaacaacaacaacaacaacaaaaagcatctctaaatcattcgtaaaaagatatgtatttattaaataaatatgtgagtccagtcatctgatttaaaaaaaaaaacttacttaaataaaaaagaagcaacaaatataatcctgaagggagagggagaattttttaaaaagattttttttttgctgggcgcggtggctcactcctgtaatcccagcactttgggaggctgaggcgggcggatcacaaggtcaggagatcaagaccatcctggctaacatggtaaaaccccgtctctactaaaaatacaaaaaattagcccggcttggtggccaacgcctgtagtcccagctactcaggaggctgaggcaggagaatggtgtgaacccgggaggcagagcttgcagtgagctgagatcgcgccactgcactccagcctgggtgacacagtgagactccatctcaataaataaataaataaataagattttttttttttaagacaggatcttactctgtcgcctaggccagagtacagtggcacggtcttggctcactgcagcctcagcttcctaggctgaagcaatcctcctgcttcagtctcccaaggagctgggattacaggtgcgcaacactatggccagttatttcttttttattttttgtagagatggagtctcactatgttgccctggctggtctcatattcctgggctcaagtgatccaaccaccttggcctcccaaaatgctgggattacaggcatgagccagtgggcccagccaagaataaattttttataatcttgaaaggaagaaggcttttctaaacataaaacccagaaagagaatgactcatacttttttttttttctttttgagacagagtctagctctgtcgcccaggctggagtgcagtggtgtgatcttggctcactgcaatttccgcctctgaggttcaagcgattctcatgcctcagcctcctaagtagcgggattacaggcgcccactaccacgcccaggtaatttttgtatttttagtagagacgggatttcaccatgttggccaggctggtctcaaactcctgacctcaggtgatccagccgcctaggtctcccaaagtgctgggactacaggtgtgagccaccgcacctggtctacattatttaactgtatctaaactggaatattctgtacaaaacaaatggttaaaatgcaaaacacttaagactaactgtaagaaataccacacgcatatgcatatacatatacatatatatatatatgaatgataaaggaccaatttccttcatatacaatgagctcttataaataataatcaattacatatgttaatataatgtaaattaaaacaacttctaggccaggcatggtggctcacacctgtaatcctagcactctgggaggccgaggcaggtggatcacctgaggtcaggagttcgagatcagcctggccaacatggtgaaacccctgtctctactaaaaatacaaaaattaaccaggtgtggtggtgggtgcctataatcccagctacttgggaagctgaggcaggagaattgcttcaaccccggggggcagatagaggttgcagtgagcccagatcatgccatttcactctagcctgggtgaaagagtaaaactctgcctaaaaaaaaaaaaaaaaaaaaaaaaaaaccatcttctaagactggtaataatttaagtttgcctaatgttggacatgtagatgtggaaaaatggtttggggatactaaattggtataatctggcatcattcatctcatctagaaaaataaataaataaatagatatagcctttccagcagccattttcactcattcaagtaacaaactatgtattaagcaacgattacacatcaagtactattcaaggtgctaagaaaacagtgatgaatgtgagctccttccctggagctttctatcacaaatagaacaaaaaaacgtgattaagggcctgaatgatgagaaggaaatagccattagaagggtccaaggaggaatatttcaggcaaagggaaccaaaagctgaagaacctaaagtataaacatgttttggcatttttaaagtacaaaaagttaaagaaaaaagcactacagctgaagtgtagtgaacacagaagacagtgataagagatgagtttgcagagaaagacaagccaagtcataaagggctttaagggccaaggtaaagcatttggattttattctaattgcaatggaaatccactggaggattttaagcaagagtgctacaatctgacctgggctttaaagatggtgtggggaaaacaaacaaacaacgacggtatggtgtttccaagtataggaaacatgaggggatagtactggatggaagtggtatgtaagggtgtcatcagtggtttgaattaggttggtagcaggaaagatagtaaagagtagttaagttcagtatatatctacaaagcagagcctgggtttgtgactcctgagaattttgcctgagtgacgagatgagaggtgataccattaactaagataataatagtgaaataatagtaatagttaacatatactgagcactaactatatgtcagcaatattctacacctttatctagtaactcattcagatccttagaactccatacaactttgccatacatgtgaacaactgaaaaaaaaattaaaacaaaaaacaaaagaactccatacaacttatgtatatccctattttgtatgtgagaaaactgaagtcaatgaggtaaggtaacttgtccatgatcttgtaacctacagtacccacaaactagatcagaatccaaggagtctggtaccacagcccactctcttaacccttacaccaaaatgagatttgcaatactagaacaggaacaaatttgggtatctttgaacatttaaaatgtttattccatttggcttcacagttttacttctaggaatctatagtatagagatacttgcacataggtagtaagatgcaaatataggaatgttcactgctgcattgtttgcaatagcagaagctttaaatggttgaaataatcaataggagaacaattagaaaatttgttgtctatcattatgatagaaacccatgcagggtaagggagttctatatatacttatataaaaaatgtataagatactttttaaaaagtggtacctaaaaatttaagttcatatatatataaggaaaatactatatgtatttacacacagaagcatttttttgtatatttcatattttctaaatataatgattcagatagtctagaccacggcctgtgatctataatattatattttaagtatacaaattccaagtaactaagatttctaaatagtataatgggtccttttagcctctaattagtcttctttagaacaagacaggaaataagtgagaaataattattttcaatgtaaaaatatttaggtatattcaaatttttgctaagtgtttataatgttaaaatccaatttatattttacattatgtgggagtggtgactcacacctataatcccagcactctgggaggtcaaagcagaaagatcacttgagctgaggagttcaagaccagtctgggcaatataggaagaccttttctctaaaaaaaaaagtaaaaattttaaaaaaaactatactttacaatttcaaagaatttacctaggtttaaaaaaacagcagagctaaatttttctcaggtgttcctatccaaagcgttttcactgatttgaaaaatgtcattgtcttttttctgataaaatgcaaacactataactccaattttataaaacaaagattttttaaaaaatcatatgtatggccgggcgcggaggctcacgcctgtaatcccaacactttgggaggccgaggtgggaggatcacaaggtcaggagatcgagaccatcctggctaacatagtgaaactccgtctctactaaaaaaatacaaaaaattagccgggcatagtcccagctactccggcggctgaggcaggagaatggcgtgaacccgggaggcggagcttgcagtgagccgagatcgtggcactgcactccagcctgggcgacagagaaatactccgtctcaaaaaaaaaaaaaaaaaatcatacgtatatatgcacattacacatatatttgcatagttataggatcatgaaaaatatttaaaactacatttcaggttgttcccattggtgctggggagaaagagaggaacactgttttggggtaggtatgtggaggaaggacgtcagtgaggaaagaagaaaaaagacaacacttacacactaaacactgcgcaaggatataattaagacaaagaactccgtcgagactatgctggccaacatggcgaaaccccgtctctactaaaaatacaaaaactagccaggcatggtggcgcgtgcctgtaatcccagctcctagcagggctgaggcaggaagatcacttgaacttgggaggcggaggttgcagtgagccaagatcatgcccctgcactccagcctgcgcaacagaagagactccgtctcaaaaaaaaaaaaaaaaaacaacaaaaaactaagaactctgcaacagaggttctgaaaaaagggaacatttcagaaaacaagaagtagaataagtccagtatagatatgcagaaaggctctaactatatagataggcattatatagggctgacaaactagagatgaagtataagccactgtccagactttatatttagctgtatataaaggcttagttaattataacagacttttcattagaggcaaaaaataaaaatacaattctattgtaggttaggatatgcataagatggttctactactaactagcaacgtggcattgggttaaattattctctctaatcctcattttacttacctgtaaaacaagagggcctagaattcagtttccaaggtccctcctaattctgacattctatacttctataaaacatcattactgaggagaggtgccagtttttaagaaatcttaataccaagaaattaatagaactaggaaagcaccaagcaaacctgtgcctgaagtagtcttagctgtctgtcttgttctgtgaggaaccgatatgcatctggagatagtcccatcattccattatctgactcagtcttgggtgtgtgcatgcacactgtgcaaggctgtgggttacataagtccatatgtgaaggcggtcttgccacaggcgatggttcaatattgctgtggggagaacaactgcccatatctccctgaggtctcaaggctataggactacttgaagaacagaatgcattacagtacagggctggacatccacttgggtgaaataatgaatgcttttgaagggcttcagactggacatcttgaatggatccaactgtgtttgctccttgccaagaatttagcggactatattgaatatgactatgatgctgacaacacctgcaaacgtttgtggaacagtaagatggcagtgggggagtaggtatctgaagttccattggtcttcctgaattatggggtgaaaaaacaaaatcgtgtggttgggactgcggggcaagagaagactgcctagaattaagtgtggagggtcttataggatactcttcgttttgtacatttccagcagaaactgtttggagcttttcaaatatatcatgagatggcccattatgagaagatggtttaatactgttcctggtatgggggttccctttcttataggcaggtggctgtcttactttgcagtgtctcaaaagagctggtttatcctggtttaactgatttggtattcctctcaaggaaggctctccagcttcaacttctggactgtgtttctcatcataaagctggggttgcaatggcttcaagtgttccaagtggttaatcaaaggaggattttcattattcaccatttccaatggagtaggcagagggtttgattctatgaaattgccatccaacacaagtgaaagttcaggaactgatggttggatcttagaaatctacaaataagaaagaaatagaaaaaaaaagtatttttttggagaaactgtatactttactttcctcagaccagtatttcccaaattatatctaattacatattaacaagtgttcattctttatttagaccatcagttaattttttctgggcatgttttatgtgctaagcactaggaatgcaattgtaagctaaataaacaaggtccttgccctaaaagaataaaactaaacacttcccaaacttatttaataatggaactctttttattaaaacactaacactgctaagatcacagaacacaatatgagaaactgttttatataactttttaaatcctctctgcaaaaaataaaattgtcacaagcagaatgttttcacagatctagtagcaaatgtttatgtaccttaaatagtaaaatcttccaataaatgtttcaaaatatttctccactaagaagtcactcactgttattccttctattgatatcaactaagaggtggaaagcaaaaaagagtaaacaaaatactcgctgtgatgaatttggttataatttgatattagctttaaaaaatccttcccattcctttttcttctaaaataagaattaaacaattctaaaatgacccacaggttggtagcaataaaaaaattatgacaagaattttagcaattaacctctgaaagcaagtataatgttttctcagaatatagtgataaaaaccaatgtcaagctctagtgatagtatataatgttgagtctatatggttattaaaagtaccagattctaaaaccaaacctcctgaaatagaatcccagctttactacttactagttgtgtgtcttgggtaggtaacttaaccaatctatgtctcagtttactctaggaataaccatacatgcttattacatagatattacacatatgtatatatcattacatataatatgaattattatatataactgtgaaatacttatatctctatatatagatataaccatagagatagaaatagctagatatatctaagaatgatacttaggtttcaggtagtattatttagtgttttaaccatgaagagacttaggtctctaaccacaaaagtgaatgcattttaaaatcagtgataccttctgactcactggatgaggactaggaattggtcttggagaaaaatcttcatcttcaacaccagagtcgtgatcatgtattggcatcttcccagaagataacttttgggaagacctaaagaatagaaggggagaccagaaaagcctttggtaatccagtgttttctttcttctagaaattgaataaagtcctttaataagttgcagtagtactcagatcatttaatttagtatctgacaaccacaaattattttatttttcaggccagtgttagttgaccagggaagctggaccagccagccttaataaactaccctatttacctgatgatagcaagtttaaccttgtattgttaatgtcacaataaatcaagtcactgggcaccctctagttgatcacttcgataaatatagaaacaagtaagacttagtacttgctgtcaaaaaatttataatctagtattaaaggttattaaacacactatattacaaaccctctgtattaaaaaggaaaaccaaataaggaattatattttcctatgtacttatatctatgatgggaaaatactttgaaaaatcaaagtactaccctcccatttagtcaggaatactcattgtatcacagatggcatgcccagcaaaacagaaaatttctgagtgctggtaccaagttttaaaagctgaaattagtgtttaagactaaagatttggaatactatatgcatcaggcttttttacatcctacactagacaaagtctcaataggatgcattagggaaaagaaaagccagaatgaaagctaacagcgctcaggattaatgggatccctaaaaaagcaccctgcattctgtttcatgcaagttgaatcctccctagcaggaagaacaaaagaaactccaaggcaggtttgaaaatcaaacagcagaagagaccttttgccctaaaccctgattgtctgaagaggtagaccttcacagagttctttctgtacaaggtattacaatgaagcaatcagaatgtctgcatgattatgtttaagcagaaatgggtcttcagtcccacaaagctcttctccaacacccaaggcagcttgagatacataatgatattccaaagcgctcagtgcagcatggacaggaaacaagagagccagtggcctgaacagggtcaaaagttgcagcaggaacttgcacaaatctgacaaagaccagatgcaaatgaaaacacctcagcagattgtagcacagatggatgagaatcacgtcaccccatatcaccagtactggcataccattagtcccctctacattacatataaccccagagaaaagggaataaagaaaccttgaattaggtgaaatttggtgtctataattcagtagaacaaataggggcttaaaatagatattaagttcaattactaacttttttaagttacattcttttgtatacctgagttgtggcatggaattaatatctgttttgtacttaagatgaatatacacacaaaaccgttgacactgagcaataaaacccatttcttagcttttttttttgcgggggggtggggggtggatagagtctccctctgtcgcccaggctggagtacagtagcatgacttcagttcacagcaacctccgcctccaaggttcaagtgattcttgagcctcagcgtccgaggagctcagactacaggcatgtgccagcacgcccagctaatttttatatttttagtagacacagggtttcaccatgttggtcaggctggtcttgaactcctgacctcaggtgatccacccacctctgcctcccgaagcactgggattacaagtgtgagccactgtgcctggcctcatttcttagcttttttagtacccaagggaaaaaaggaaaaacttcaggttgtatagttataacaacagtactttaggagagacaaacattttgataacatttaaaatgactgttcctcattaaagcttaggccagaatggaaaataaacaaggttttttaacatcactttttttgaagccgggtttcactctattacttaggctagagtgcagttggcatagcatgatcatggctccccaactcgacttcttgggcccaagtgatcctcctacctcagccttctgagtagcttttaataacaatcttaaagaaattgctattgtctccttagtttggctatttcttccataaatattcaataaaatgttgaataaggtcttaaaatttaagacagtaaagatgttcctggctgggtgaggtgacacaagcctgtaatcccagcactttgggaggccaaggtgggtggatcatttgaggtcaggagttcgaggccagcctggccaacatggtgaaaccccatctctactaaaaatacaaaaattagccgggcgtggtgatgcacacctgtaatcccagctacttgggaggctgaagcaggagaattccttgaacctgcgaagtggaggttgcagtgagctgagatcacaccactgtactccagcctgggtgacagagtgagaccctatctcaaaaaaaaaaaaagataaagactgacttcctggagggaaaaggaattctgccagcaggctgcctttggactcaaattgcaattcttccctgggtgtccagcctaccagcctacctgtagacattttttgtctttttttttttttttttctttgagacagggtctcattttatcacccaggctgcagtgcagtgccacgaacatggctcactgaagccttgacctcctgggcaagtgatcctcccacctcagccctgcaagtagctgggactataggcatgtgccaccacaaccagctaaattctgtacttcttttctgtttttgtagaggcagggtttcgccacattgcccaggctggtctcgaactcctgagctcaagcaatcctcccgcctcagccttccaaagtactggaattaaagggatgagccactgtgctcagcctctacctgtagactttggatttgccaaaccttcacaaacacagaagccaattccttaaaacaaatatctctacatacacacatcttgttgtttctgttaatctggagaaccctaatacaagataatatcttttttattttttttgagatggagtctcactgtatcacccaggatggagtgtagtggcatgatctcggctcactacaacctgtgcctcttgggttcaagtgattctcttgcttcagcctcctgagtagctgggattacaggcatgcaccaccaggcccggctaattcttgtatttttagtaaagacggggtttcaccacgttggccaggctggtctccaagtcccgagactcaggtgatctgcctgcttctgcctcccaaagtgctgggattacaggcgtgagccaccgggcctggccgagaatatcttctttaccacaaaaggtagaatatgctgacccaagaagtcacaagactttatttaattaatattcttcaagtgtgttttagaagttttaaaacaattttttttttttaggtaggagtttgttttgagacagggtcttactctgttgcccaggctgaagtgcagtggcgcaatctcagctcactgcaacctctgcctcccgggttcaagcgattctcccacttcagcgtaccgagtagctgggattacaggcacgctccagtgcgtccggctaatttttgtatttttagttgagacggggtttcaccatgttggccaggctggtctcaaactcctgacctcaactgatccgcccgcctcagcctcccaaagtgctaggattacaggcgtgagccactgcacccagcaagagatgcattttttattgtataatgaaagtatcatatgtttgcatctatttctgaactatagtctgctccacatatctgcctgccccccaccactagttaccgtttgatttaatcacccacagctttatatttcaatattccaacttcaatggcttttttttttaaatggagaagatgcagcttgaggagaggaactttaaaaaataacactgaagacctgccaaatgatccctaaaagttctgagaaagaggccgggtgtggtggctcacgcctgtaatcccagcactttgggaggctgaggtgggtggatcacgaggtcaagagatcgagaccatcctggctaacatagtgaaactccgtctctactaaaaaaaatacaaaaaattagcctggcgtagtcccagctactcgggaggctgaggcaggagaatggcgtggacccgggaggcggagcttgcagtgagctgagatacgccactgcactccagcctgggcgacagagcgaggctctgtctcaaagaaaaaaaagaaaagttctgagaaagaaagaatattagctgtttcaaatgttaaaatgcactatagaattctagtgattaatgttttaaaaacactgggtgatcaatttcaggacctgagtgtgtgtaatgtcttttactgtacatttcctatgtgatttctctacacttcacttttctcacctataaaatgggagaaatgaccagtattatatgtagatttaaggatgttggccaggctggtctcaaactcctgacctcaagtgatctgctcgccttggactcccaaagtgctgggattataggcgtgagccatcacactccagctagtagttaattttatagtagtttatctgataggtccagatttaaaactataaggaagggttggggacgatggttcacacacgtgatcccagcactttgggaggccaaggcagaaggatcacttgaggctaggagctcgagaccaacctggccaatacagcgagaccccacctttaatttaaatattaaaataagaaacttataaggaagggaagaacaaatagaaagcactaaacaaaacagggagcagattcttgctaagcaagataattttttgacaaatacttttgtatttttcctgtataatacatcaacccaaatgaaaaccatattagagttgccacttcattaaaattactatccaacttcctagtgaatatgaaggaatgcatttaaaacaaagacatttatggtacataagatttaaaaaatcatttcatcagaaataatttagttattttactcaccaaaaactaataaatataatttttaaaaaaacacacacataataacaaaaagatcttttacctcttaattgaaaaattcttggaagccttactgaaaaactctgtttctgcattttggctttcagcgctcagttcacaacggattggatttttgtcaggaggttcaacattctgaaatgaagtaggtcatattttgagatctgacttaaataagaacaccagagaattctatttagatgaaaagtagctctgaaacactagatgatggagtggcagacttctgatttctgtaaccctcttttgtaaactgtccagttccctgctacataagtgaaaaagttaatcacttgtgttataatcacagattcagtgaatataactatgaaatgagaataccatctaaagaataaaatgacaaatatgtctctaaaacagaaatattagatctcagttaaaatgataggtataaaatacaaaaactttatagcttacataacctataaaatataaaatgtatataatatataatataaaggtattttatatataacatatatgtaatataatgtatatattataatattaaaatatatatttatataaaatatatagatgtataacatatacatgatctcaaagaaggtactaaatacgatctgagtggacacgtggttatttaaaagtattcaatatttttctaataaagaatgtacttttattagtctgagacctaaaataaccaataattttattgaaaagtagcatttgaatattttcatataatgacacctagtttcaaagatctacttcctctttttttttttgagacagagtttccttcttgttgcccaggctagagtgcagcggcacgatctcagttcactgcaacctctacctcccaggttcaagtgattctcctgcctcagtctcccaagtagctaggattacaggcacctggcactatgcctggctaatttttgtatttttagtagagacagagtttcaccatgttggccaggctggtctcaaactcctgacctcaggtgatccgcccacctcggcctcccaaagtgctgggattcgaggtgtgagccgccacgcctggcctaaagatctactttttctatgatcatcatctagttgtgtttctaggtattttattagatgatatagtaacaatctattctgattccttagatacataatataaataatggcctttaagtataaaaaaccatttcttattcccacacattttaaaaataatacagtcatggtcaggtgcagtggctcacacctataatcccagcactttgggaggcttaggcaggtggatcacctaaggtcaggagttcgagaccagcatggccaacatggtgaaactccctctctaatgaaaatacaaaaaaaaaaaaaaaaaaaaatagccaggtgtgatggtgggctcctgtaatcccagctattctggaggttgaggcaggagaatcacttgaacctgggaggcagaggttgcagtgagccgagatcacgccactgcactccagcctgggcaactgagtgagattccatctcaaaaaaaaaaaaaaaaaaaaaaaaacatcaggacaaagaaaagtactgagatcccacaaagttaaccttcacaagtataaaatgatatatgaacaactgatatattcttcaaagattttagaaaaacatgggcaagttattctgtgagtaacctctggttctctattgtaatttggttgaagatatgatctcagatttactaaaaaaatttaaccataaatgaataaagttaatatttaataagattatttataagtaaacaaagcataatagtttggattactattttaaagggtaaaagctgttgggtttaaactgccaaagtgcaaaaccctaaacagtcactaatgtactagacaatgaaatcacttactttgaaaagatgtaatgtttccttactggttagcaactgaaaccgaaagtcaggtatcttgccatcacaagggaagcattcataaaactcaggttccttatgtgtcatagaatagagaactatgatgaaatttccagattctgaaaaaaccctgcacaaaaaaagtcatttaattaaaatttaatgaggataacatgatgacactcaaataacttcatgtgagtctcccaatctagttaacaaaatgactaaaaggtgcaatttttgttcaaaaactggggtccaccacttaggaaggcaaaaggtgggaggatcgcttgaggccaggagtttgagaccagccttgtcaacatagtgagacccttcctctctacaaaacaaaattttattttattcaggaggctgaggcaggagaatggcgtgaacccgggaggcggagcttgtaatgagccaagatcgcgccactgcactccagcctgggcgacagagcaagactccgtctccaaaaaaaaaaaaaaaaaaaaggaataagagagcaattcaaaattaattttactgaggatttactgtcaatatgaacttaaagcatgatcagtaattgataataaaacataattgtactaaatcatagcaaaggatctaaaactaacatttaatttctgctatctaaatataactaattatcttgaaaagttaaaacaaaatgttaaaagtagaactccaaaagcatctgaagaaaatacaagtgatttttttacttcagtaaatacacctggagtgggtgaatcttttctaaacacgatatgaaaaagattaataaatatgactaaaaaacagtaagtctgtttgggaaaaatattgttaaacttaaatgacaatctggggggaaaaccgttactatatatcatcaatatgtgtttctctatgtattttacattatatatatagagagagagcttgctagcacaagcaatatgaaaagatgcacaggccgggcgcagtggctcacgcctgtaatcccagcacttcgggaggccgaggcaggcggatcacgaggccaggagatcgagaccatcctggctaccacagtgaaaccctgtctactaaaaatacaaaacatcagccaggcatggtggcgggcacctgtagtcccagctactcgggaggctgaggcaggagaatggcgtgaacccgggaggtggagcttgcagtgagccgagatcgcgccacagcactccagcccgggcaacagagcaagactccgtctcaaaaaaaaaaaaaaagaaaagatacacaatctaagagaaaaatggctaaagacatgactaggcagttcctggaagatgaggttataaatcattggaaaagtttatttttcatctatcaggttagcagaggtcaaaagtttaacaacagccctccactcacctctctgagctcatctccagctactctccccttccttcactcctctctagctacagtggcctctttgctgctccttgaagatgtaacgtgttgtttcacccagagcccttacacttaacacatcctttgcctaggacagtgccccagacagccacaaggcttacttcctcaccttaagtcggcctccctgaccacctatttaaattgcaactcttggccgggtgcagtggctcacgcctgtaatcgcagcactttgggaggccaaggcaggcagatcacctgaggtcaggagttcgagatcagcctgaccaacatggagaaaccctgtctctactgaaaaaatacaaaattagccgggcatggtggcacatgcctgtaatcccagctactcaggaggctgaggcaggagaaacgcttgaacccaggaggtggaggtttctgtgagctgagattgagccattgcactccagcctgggcgacagagcaagactccatctcaaaaaaaataagtaaaataaaataaataaataaaaatttaaaaattaaaaattaaataaataaataaataaacggcaactctttacttgccactatcattcagacacacaacatcctcctctcaggctttatttttctccacagtactcatcgccttttaacatactatttattttatttattctgtttattgcctgtctctgcaggactattttattttttatttatttatttattttttgttgcccaggctggagtgtagtggtgcgatctcagctcactgtaacctctgcctcctgggtgcaagtgattctcctgcctcaacctcccgagcagctgggattaccggcatgctctaccacaccgggctaatttttgcatttttagtagagatggggtttcaccatgttggccaagctggtctctaattcctggcctcaagtgatccacccgccttggcctcccaaagtgttgggattacagatgtgagccaccatgcctggcctattttatttttttaagacagggtctgtattgttcaggctggagtacagtggcacaatcatggcttactgcagcctgaactcctgggctcaagcgatcttcccatatcagtctcctgctgggactacaggcatgtgtcattacacccagctaacttgttttttgttttttttttttgttagagacagagtcttgctatggtacccaggctggtctggaactcctggcctcaagcgatcctcctgcctcagcctcccaaagtcccaaagtgctgggattacagacataagacaccatgcctggtctggggacctttattttgtttactctgatccccagtactgtgaacataatagatataataggtgctcaataaataaataaataaatatttctttcacagtgttagtgcaggtagagaaaaaggcactctcgtgtactgctggaaaaattataaattggtgcagtctttttgaagggcaatttggcaatatctaccaaattttaaattacatactctttggcctagaaaaaaacacttttagaaacttatcctacaaatatactagcatatgcacacaaagatgtatgcataaaatgttcagtctaccactatctgcaagacaaaagggccagtttttaaaatacagtatgtattataaactcttcagttgtaaaatatgtatattaaatctgtatatgccaagaggtaatgatctccaaggtataatttatacagaaaaaagcaacataaagaaaagaaaggatgctatggtttaatttttacaggccaggaaaaggtgatacttgtctatgttgagtattgaaatattgactatttcaggaaggaagcacaagatatcactttacagtgattgcctctgagaatggggtctagggaaatggggaggaagagagatctacttttattgtagatatttacatatgtcaatttattactatgtgcttgtactgccttttcaatatagtttaagtcctttacagccacccaaggtagataaaaatagaccttctcatttaatagataaagaaggtgagagacaaatactgacaaagatgtcaccttctttatctattaaatgagttgaggttaaaagtaaagtttccctaactattaattccaatgtttaggcttcagtttcaggaagaaattaaaaatcttgtctcaagtatttctttgtgtattagtagtaacactgtgtaacttaataaaacatctgtaaggtaacaaatccaaactcatttgcagtcatttcactgaaagttaacctccttaattattaaataggatgctacagtagacaatctccacagtttttttccacccccaaaaggtttgtgttctgtggttaggcaagtgaattccttggtatttccaggtatactgcaacctcatctttttttaatctggttttattctcatttaatataaggtttgttttttcttaatgtacgtgtttatttataagtattgtaaaaggttacggcattacatgaattttaaatgggaccataaactatgaatgggggaaaggatcgaaataaagtactacagaataaaatatcacttgcctttcttgaacagaagaattgaatatgtatcgcaaacagcaagcccatacctgaggactatagatatgtgtaattccagacagccaactaaaagaaaaagatagaaattaaaaaccatagtcacttacatatatagcataatttacattcttcctaagataacaaagtagacgtatggcttttatcagccatacattaaaaagccttagtaataagaaatctaaaaacgtgctgataattaaaaggaagaatatatagacatttgtatatatataactatattgatatatatagacagacatatagatatatatcgagagagagagagagaaagagagcaagcacgcgtatctctgtcctcttttacctgagatgtgggaaagaaaatggttaacagagatgaaagcagtatactagaatgaattagcttggactggaaagaatgggctaaggtagtacagactaatttgcagcctaaaactacttcacagagttgctgaggattaaatgctgtaatatatacaggtagtcagaaagagagaaggctcttaatatttacttaagcatcaacaatccattgcctatattaggactgtagcaaactataagtagatttcatggtccagagaacattcatgcattctcattcactttgcatgtgccattcccttacatgggttcccttccccaacaatcttcccttctactatctaaacaattgaaagtctagctcaagtttgtcttctctaggaaaatgctccctatcatatctttcttacaaatactaagtgttcactttccatactggtcactttatagtaaatcatatactttatttttctgtgtatgaatatttgaatgttttatcacctcactttgattttaaattctttaagaagctttaaacctcaacacattatcaagcataacactgtatataataagtactcaatactgaatgaatataaatttctaaatattctgtctaaatatcattaactcagatggcttgagcccaggagttccagaccagcctgggcaacatggcgaaagcccgcctctacaaaatatacaaaacctagccaggcgtgatggccggtgcctgtagtcctagctattcaggaggctgaggtgggaggatcacctgaaccccagagattgaggctgcagtgagccatgattgtgccactgcactccagcctgtgtgacaaagtgagaccctgtctcaaaacatgtatacatatataaaaaaaagtaaacacataaatatcattaattactactctaaagagaaggccattaacactaaaggagatttctgcaagattgactgacagtggattttaaatggtattattatgagccctgagttctttagggtgacttaaggatgagtggtagtgagagaatactgaagaaacagggctctaagccttcaccttcaaccaggagaattcaacttatattttttatttttttttgagaaggagtttcactcttgttgcccaagctggagtgcaatggcgcaatctcagctcactgcaacctccacctcctgggctcaagtgattctcctgcctcagcctgccaagtagctgggattacaggcacgcaccaccatgcctggctaattttttgtatttttagtagaaatggggtttcaccatgttatccaggctggccttgaactcctgacctcgaactcctgacctcaggtgatccgcccacctcagcctccaaaagtgctgggattacaggcgtgagccactgcgcctggccatagaattaagcttttatctgttttatatgttagagttcttcctaatattggacaaaatctggctgagcatgatggttcacacctgtaatccaagcactttgggaggctgaggcgggtaaatcacttgaggccacgggttcgagacgagcctggccaacatggtaaaaccccgtctctactaaaaaagcaaaaattagccaggcatggtgatgcacgcctgtaatcccagctacttaggaggctgaagcacgagaatcacttgaacctgggggatggagattgcagtgagccgagatctctccactgcactccagtctgggcacagagcaagactccatctcaaaaaaaagattgggtaaaatcttattttagctgattctactagtaaaataagaaaacctgacaaccacttatctttgtggctttataaaatgatctaaatatttatagtacaactgagtcacatgcttatcatatacatttgaacatttggctgataaggttttcataaataatgtaatacttacattcccaccaatggtagagaataaaccttgggatcagattccaacaaaagtaacaatttgcgtgtttcatccatggtaagatatctaaacagaagacattcatgtgaaaataactgaaattatgtactttttacctaaaagacataatctaaatgctgaagcatactttagaaaggggagataattcaaatgaacgttgtcttgcacacacaaaagaaacagaaactttttactgactcagtaaaaagactctggtaagaggaagagattaaagagatttaataccttaaaacttccatctatcaattaaaagacattgaagattatacaccttttttaaaagttttgctctataactttacttacaatttactttaatcaagagtgttaacattaaggtaggcagtttcagaaccaaataggtttccttggaagaactgaattccctatcactagaaaatgttcatgcatccaagtgatttgacaagactgcaacagatgtgacttctaagtgaaggagactgaattaggagaagtatgatcaaccttccatgtgccatattcctccaaccactgtcaaaggactttggaaccatcataaaacacaaaagctcactctttcctaaaaggacattatactatatttatattttattatatttattattgacagcaagttataagaatacaaaaaaccaaagtagaattgttaattttattgttatgtctttcttcaaaaacaatgccattagtgggtcaggcatggtggctcacgcttactgtaatcccagcactttgggaggccgaggtgggcaaatcacttgaggtgaggagttcgagaccagcatggccaacatggcaaaaccccatctctactgaatatacaaaaaaaaaaattagccaggcattgtggcacacgcctgtaatcccagctactcgggaggctgaggcaggagaatgaatcacttgaacccaggaagcagaggttgcagtgagccgagattgcaccactgcacttcagcctgggcaacagagtgagactccgtctcaaaaacagaaaacaaaaacaatgccattagtgatataaagccttggcagtaccactgatgatatattttattgctctaataacactaaaacacaaagacaatacatttgtcaggtcttgtgacaagaatattaagcctgagttggcgtaagatttacaaatcaacaatgacacagctgctttaaaagttctccctcatgtcttgcccatctgataaatttctactccttaaaagaattagttcaggctggctgggcccagtggctcatgcctgtaattccaacactttggaaggctgagatgggtgcatcatgaggtcaggagttcaagacaagcctggccaagatggtgaaaccccatctctactaaaaatacaaaaattagccaggcatggtgacgggcgcctgtaatcccagctacttgggaggctgaggcaggagaatcacttgaacccaggaggtggaggttgctgcagtgagctgagatcgtgccactgcactccagcctggcaacagagcaagactccatctcaaaaaaaaaaaaagaattagttcaggctttccatgatttccccaggcattttggacatccctccccctactttcccagcactgtatataaacctccattataacacatcatgtttacatgtcaacatattcaatagatagtaagtatagtttttaatctatttatttccaatgtctaacataatgcctatgccataatgggccctagtaaatattagggtatataaagggcaaatgtcaaatttttttttaatgatggggtctcactacattgtcctagctggagagcagtggctattcacaggcactattgtagcttactgcagccttgaaatcctaagctcaagccaccctcctgcctcactctcccaagcagctgggattacaggtgtgtgtcaatgtacctggcatggcaaatgtcaccaatttaatagacgattctagataggaagtggcaaggagaataggtgattgacagaatactgaacatcctggttattaccagcatgcccgcccagcagtcacagatggataattccaagaaaggtaaattcatgctatacaagtaaatggggatgggtactaaagaaaacaaattaatttttttgttaatttaaacaaaaaatcccatgctccacttgagaagtactttattaattaagaggattaaatgtttcatttaattcaaacaatttttgctcacttttgaccactccatgattttggaatataccaatttttcctttgggccactccaatcagaaagcacagctctggtcagaatctggttctgaagaggtatttttagagaataagacttggaattgagtgtactttggcaaacatttttagattgaatggcctaacaggaactagggtggagtcactgggaaaggaaaccagaagtgtaatacttggagcagtctctggtcaaactttaaagtagagtagttatattgtctaacctagttttataaataatagataaagaaaatagatgaagattcagggaagcagccttgctgaagattagaaagcatgcattttggcttacatttcctaagaaattaagagtggagataggaagctggagaggattctactccagctctgtgaggaaactccaccctcaagtagttggcaatttggtaagcaagagtactgtaactttttatttaattatctcctttctctatctgcaatgctcattattcacagttaaaaccacatactataaatgaattctctagcctcccttgggttcataattaggttatagttaagaaaaaaaaaaggcctaaaacctaaataaaatacaaagaataatacagaatatacaatatagaacacaatttcctcttacattttcaaataataaattatcaaccaatttgtttttttttgttttttggtttttttgagacagagtctcgctctgccgcccacactgaagtgcaatggtgtgatctcagctcactgcaacctctgcctcccaggttcaagcgattctcctgcctcaacctcctgagtagctgggattacaggcacgtgccaccatgcccagcttttttgtttgtttgttatttttagtagagatggagtttcaccatgttggtgaggctagtcttgaactcctgacctcgtgatccacccgcctcggcctccaattttaatataatttttaccaccactttttttttttttttagaactgaggtctctggggctgggcatggtagctcacccctgtaatctcagcactttgggaggctgaggcaggaggatcacctgaagtctggagttgaagtccagcctggccaacatggtgaaacctcatctctattaaaaatacaaaaattagccggtgtagtggcatgcacctgtaatcacagctactcaggaggctgaagtgggaggatcacttgaaccagggaggtggaggttacagtgagccaagatcccaccactgcactccagtctgggtgacagaacaagacaccatctcaaaaaaagaactgagttatccagacattatactttatggccactcagttttgtcttttttttttttttgaaacggagtctctgttgcccaggctagagtgctgtggtgcgatctcagctcattgcaacctccacctcccaggttcaagtgatcctcctgcctcaacctcccgagtaactgggactacaggcatgcaccaccacgctcagctaatttttatatttttagtagagatggggtttcaccatgttggccagactgatctgcaactcctgacctcaggtgatctgcccgcctaggcctcccaaagtactgggattacaggtgtgagccactgcgccaggccctaccaccaattttttgtaggtggtggcacaacttaaagaaaatttcatattcaacgaaaataaaccatttcattttttactttccctggttattaaccaagccaccatatctctggcatataaattgactggacaattctttcacattacatggacattctgaaaatatactaatgcaactaacatttagattaatgtatcttttacttacccatatttataagtcccttgaacttgagaaatattcagattactgctcaagtttcttgccagagctgttggaataatggggatgggcttcacaggtgtgcatttaaagttatttgctagagttactgctgcccaatgcaagtcaaattccacactgtccaaactctccctggaagtgatatgaactcttagggaaagcagcttaccacagtccaaggaatctttgctacatatatggcactgtagagcctgagaaatcaatattaaataattattttaaaactttgaaatgtgcccatatcgccaaagtttattttatactgatacatatacatatataatatcttgcacaaataaaattaaatgagttctgatttacagcatttcagttctcgtttattccatgtgaccaaaagattatgtgaataattatatcaaagcaagtaagatttactgtcccaagctccactacacattttcaatgtagatatcccagcagcacttcagtcttattggggagtcacccccaataaatatttaccacatgggaaaaaatggacataaaataatttttttttttttgagaaggagtctcgttctttttgcccaggctggagtgcagtggtgcgatctcagctcaccacaaactccacctcccggttcaagcgattctcctgcctcaacctcccaagtagctgggattacaggtgtgtgccaccacacccagctaattttttatatttttagtagagacaaggtttcaccatgttggccaggctggtcttgaactcctcctgatcagcccacctcagcctctcaaagtgctgggattacaggcgtaagccaccgtgcctggcctcataaaataattccgattgagcctcagagaatctaaagtccattcctctttgattcctttcttgttaccacaaattgtcaagttagttctccctctgtatttgcccatgcccactgtgtccttcctagtttcactgctaccattgtactataggttaatacatccctctataatacacacctgcccaacttctacaatggctactctaacttcggtcagcctaccctatcagattaactatttctgatttgacagtgttttcttttttcaagaaccttcaatttctacatggcccatatgacaaagttcaaattcatcaggctggcagacaaggctcttctttcttgagacagggtcttgctcccaccaaggctggagtgcagtggtgtgatcacggctcaacctcccgggctcaagcaatccacctgcctcagcttcccgaagtgttgggattaaagacaggagccaccatgcccagccaagcctctctataatctgaccaaattaatactccagtctgactgcccacaaattcagcaaaaatgtatactctaaacactaccctaagtacatcttgaactttcttatctcggttacactgcttcttctgaaaggctactcatatcgcttacctagagtttttgccctcacaaacacatttagttggattttaggttcacaataattcaaccaaattattgtaaatcattctcaaatatggttttactaaaatacagcatactaaacatagtttgattcttgtgttgaattaactatcaagttgtcaatgaatcgcacctttaaagctgaactgaagtcatctacactgtgaactatcatttctcttgaacaaagttcttgagtatgaactttgcatggaatcaaaaagtccccaggaagagaagcagtaggggttatttctaggcattcaggtacttctcgaccaggatcaaagcgatctactgtcaatgttacaccttcttcatctgtagaacaaaaataacagctattatacagcatactaattaaaaacataaaatcaaccaagcaagactacattatagcaaagcactttgttcataccaatagtacactaaactcttaaatactaaactaaactcttacagtaaactaaactcttataagcgtatactaaagtcttacttgcttatatatattgatccatctgaccagacagtgaactctgtaattaatagttttactcatcttcatatccttggtacacagcaaagaaaattagcgcaaagcaaatacaatagttggccgaatcaataaattctattgcagtcatacaagtaatttaaaaaaatgttttcttgtactgatggagtcttactatgttatgcaagctggtcttaaactcctaggttcaagtgatcctcccactccagcctcccaacgtgctgggattacaggcgtgagcactggtccatttttaaaagtgtattaccttcgtctgctgtcagagaaccaagtaaaaagcatgacgaattttttttattctgcttagcatgacgataagcaagtcggatggtcttctcagtcaccacaagctttggatttctgaaaaacaacaagtcttttatgaatatggtagacctcatatcttaaaaaaacctcctgccataaaatgctgtctaaattataacacacatttttaaaaatgtacagaaagatcattgtcaggaaatcccagggtcaaaggcaggggatacggagggccacttggaaactagaatggcaataaacagacactgaaactatagttgttctccaggcattttgttaactttatgaacctcagcaggtaggtctcctgtttttgtaagtaaattttgattgaaacagtcacatctgtttctttacatactgtgtatgggcttcagatataatcagcattacagtagtgcccccttatctctgggagacatgttccagacccccagtggatgtctgaaaccacagatagtaacaaatcctatatatactatgtttcttcctatacatacgtatctatgataaagtttaatttataaattaggcacagtaaatgattaacaacaataattaatagtagcataattttaacagtatactgtaaaaaagttgtgtgaatatggtctgtctctcaaaataccttattgtattatactgtgggtaactgaaaccatggaaagtgaaaccatgcataaaggggggaaactactgtattgaatacaaaatatagtatgatttaaatgctttaaaaaatgtaaaaggaaaaccaaaatataagccaggaataagatactacgaaaaaagaccaggcaaatttgaataaaaaagccatacagaacttaaagaaataaaaaatataatttgcaaaaattcaataagttatataattaactggggataggtacacaaatgtgtattgttattctattaactatgcatatatactataagtatcctctcatatatatggtacaccgccacgttttaaaaaacctaaatgagggccaggcgtggtggcacatgcctgtaatcccagcactttgggaggatgaggcaggtggatcacctgaggtcaggagttcgtgaccagcctgactaacatggtgaaaccccatctctaccaaatacaaaaaaattagccaggcgtggtggcacatgtctgtaattcgagctacttgggaggctgagacaggagaatcgcttgtacatgggaggcggaggttgcagtgagccaacatcacgccactgcactccagcctggacaacaacagcaaaactcctctcaaaaaaaacaaccaaacttaaatgaataggttagatggcagctaagcacagctaaagagaaaataagcagacttgaaaaacaaaggaaactactcaaaatgtacagaaagacaacaataaaaaaaataaaaacaggactaaccattatttagttgaacttccataagactctccctatttttgtcaatggtaccacccttctctgccaactagtgttgaacccgaatactttctttcttgtatctttccttcagttcctctattcagtcaatcatcaaatactacaaattatttattcaaaacaccttgtttcattctttcctcttgatctgaatactgctacattgctctaagtccttataatgtataatagatgccatttatgaaatactttctattccaggcactgtgacaattgctttacagagtcttatttaacccctacaagagaactgtgaaactggtattattatagtcattttataaataaggaaactgatccttggctactttactgaggttgcataaataagtactagaatcaggatttgattccctaggcagtctgctccaattattgcaccgtttttttttccttattttgtttttttttttactttttattttaattttttattgagacaaggtctcactttgttgcccaggctggtttcaaactcctgacttcaagcaatcctcctgcctcaacctcccaaagtgctggggttacaggtgtgagccactgcacccagcccagttatagcaccttaaaccattacaatatacacctgtgtgattacagaaaagcatcttgaagctaggctgactcaaggctctccccgccataatctatccttcttagaatactacttttaacaagtaactcttatgtacaaaacctcaatagatctattttctattactttacacctaaactttcttgtctgtcaaggtcctagatgtaactacaagattttatattccttctaatctgatccactcaaaaattggttcaagcttctcaacgttccacaaagacaccatgctgacataataaaaaacactttcagtttttactatatttcacctcttttgaattcctacaatatgcagaatttgcagaaaactgggaagataagattatctctcaaaagtacaaggaacagatgttaagaagcagaaggaaaattttgcctgaggggagattctaaaagaaaagtaaagaaaaatgaataattggtcatagtaatcaactttgccttatacatctttgtattactcttgtttatactggcttgatttgaaaaaaagaaacatgttatacctgtagtaactgagatgtaagtagatgaaatctccagttggcgttgggttccaaagtgcacattttgatggaggaaagtggaaaggtaccatcctgcttgaaggaaaccttttgaaaaaacaatgtaaaattaaagcacaaggaatagcaaacttggtagacatttggtaggaaacaactaactatctttaaggtgatggtattttcagactacttttgtaattttcaaagagtttatatatatatattttttttgagacaaagtctcactccatcacccaggctggagtgcagtggcgtgatctcagctcactgcaacctctgcctcctgggttcaagcaattcccctgcctgagcttcctgagtagctgagattacaggagtgcaccaccacacccggctactttttgtatttttagtagagacggggtttcgccatgtgggcaagctggtctcgaactcctgacctcaagtcatccacctgcctcggcctcccaaagtgctaggattacaggcattagccactgtgcctggccaaaaaatacttttttattttttgagacggattctcactctgtcgcccaggctggagtactgtggtgcaatctcagcttactgcaacctccgccttccaggttgaagcgattctccagccttagcctcccaagtagctgggactacaggcacataccaccatgcctggctaattttttgtatttttagtagagacagggtttcactgttaatcaggatggtcctgatctgctgacctcatgatcagcctgcctcagcctcccaaagtgctgggattacaggcgtgagccaccacgcctggcctttttttttttttttttttttttttcagacggagtcttaccctgttgcccaggctggagtgcaatggcgtgatctcagctcactgcaacctccgcctctgggttcaagtgatcctcccacctcagcctcccgagtagctaggattacaggcgcctgccaccacacgcaggtaattttttgtatctttagtagagacggggtttcaccatgttggccaagctggtctcaaactcctgacgtcatgatctacccgcctcagcctcccaaagtgctgggattacaggcgtaagccaccgcgcccggcccaaaaaatattttttaaaaaagaaaattcacttgtaactctactaccaggagaataggcactcaaaatttggcttatttgtccttttttatctatgcatatgtaaatttatgtatacacaagcttttaaaaaaagaacaagacaatcctacaaaatcccttttaagtaacagaaaaatgagtataaatcatacatttacatttaaatttaaactaaaatctttcttttctttccttttttttttttttttttaaagagcagggccttgctctgttgcccaagctggaatgcaggggctcaatcatacctcactgcagccttaaactcctgggctcaagggagcctctcaagcagctaagaccacaaatgtgcaccaccacgtgagatttacttttgtaatttttgtagacacagggtcctgctatgtttcccaggctggtcttgaactcatggttttaagcaatcttcccaccttggcctcccaaagcactgggattataggcatgagccatggctcctggcctaaaatctgtctttctgaactgatttccagataattgttagataatacccaacagttatgaaaagcaaaaaaacttaataaattcttaattattttccagtgtttccaaatttggtattctggaataccaaaatacagcacaagtttaattattgaagcgtcaaaaggacataattataaataattcctcaacaaagatgccaggggcagtgtaaagcaaggttgtgatattaaatcatatagggtaccatcaaaaacttttcattttacatgagtgtataacacgagaaaaccacaataagaaaaagaccactaatggggccaggcctggtggctcacacctatgtcagcactttgggaggccaaggcaggtggatcacttgaggcctgcagttcgagaccagcctggccaacatggtgaaaccccatctccactagaaatacaaaattagccaggtgtggtgccacgcgcctctggtcccagctagttcagaggctgaggcacgagaatcacttgaacccagggggaagaggtttcagtgagccaagatcacgccaccccactacagcttgggtgacaagagcaaaactccatctcaaaaaacaaaaaacaaaaaattagctggacatggtggcacacgcctgtaatcccagttactcaggaggctgaggcatgagaattgcttgaatcagttgaggttgcagtgagctgagaccgcaccactgcactccagcctgagtgacagagtgagactctgtcttgttgcgggaagtcagggaccccaaatggagggaccggccgaagccatgactgaaggacgtggattgtgaagattttatggacatttattagttccccaaattaatacttttgtaatttcttatgcctgtctttactgcaatctctaaacataaattgtaaagatttcatggacacttatcacttccccaatcaatacccttgtgatttcctatgcctgtctttgctttaatctcttaatcctgtcagccgagaaggatgtatatcgtctcaggaccctgtaataattgcgttaactacacaaattgtacagcatgtgtgtttgagcaatatgaaatgtgggcacctgaaaaaagaacaggataacagcaattgttcagggaataagagagataaccttaaactctgaccgccggtgagccaggcagaacagagccatatttctcttctttcaaaagcaaatgggagaaatatcactgaattctttttctcagcatggaatgtccctgagaaagaaaatgcgcacctaggggtaggtctctgaactggcccccccggggcgtacctgtctcttatggtcgagattgcagaggtgaaataaactccagtctcccatagcgctcccaggcttattaggaagaggaaattcccacctaataaattgtagtcagaccggttgatctgaaaaccctgtctcctgataagatgttatcaatgacagtggtgcccaaaacctcattagcaattttaatttcgcctcagtcctgtggtcctgtgatctcgccctgcctccacttgccttgtgatattctattaccctgttaagtacttgatgtctgtcacccacacctattcgcacactccctccccttttgaaactccctaataaaaacttgctggtttttgtggcttgtggggcatcacgaatcctaccaacgtgtgatgtctcccccggaagcccagctttaaaatttctctcttttgtactctgtccttttatttctcaaggcagcggacgcttaggaaaacagaaaagaacctacgtgattatcggggcaggtcccccgatactgtctcaaaaaacaaaaaaaaagaaaaaagaaaaagaaaatggaaaaaaaaaagaataaattcctgtcatttgcaacaacatggttagaactggagatcaccatgttaagtgaaataagccaggagcagaaatacaaacttcacgttttcgcttatttgtgggatctaaaaatcaaaacaatggaactcatggacacagagagtagaaggatggttaccagaggctgggaagagtagtaggggttgggtgagaggtagacacagttaatgggtttaaaaaaaaaaaaccagaaagaatgattaagacctattatttgatagcacagcagggtgactatagtcaataacaacttaaaagtaataaataataacatttaaaaataattaggctgggcacagtggctcacacctataatcctagcactttgggaggctgaggtgggcagatcacttgaggtcaggatttcaagaccagcctggccaacatggtgaaaccccgtctctactaaaaatacaagttagctgggcatggtggcgcacgcctgtaatcccagctactcgagtggctgagacacgagaatcacttgaacccaggaagcaaagattgcagtgagccgagatggcgccactgccctccagcataagtgacaaagtgagactctgtctccaaaaaaaaaaaaaaataataataattaaaagtgtacagttggattgtctctaacacaaaagataaatgcttaaggggatggataccctatttcccatatgtgattattacacattgcatgccttataaaaatatgtcatataccccataaatacatacaccatgtacccacaaaaatttaaatttttttaattaaaaacagaatacactgaacttgttacacaactgtacccttctaagaatagaagacaaaatttttctgtcaacatggggtttccccatgttgcccaggctgattttgaactcctgagctcaagcgatctgcccacctcagcctcccaaagtgctaggattacaggcataagccaccttgcccaccgacaaattttcaaataagagatggcaggggggtagaacacaagggccaaaattaaagcaaaaggaatacgatagcctccttgggtcatgtttcccactatcttcatcaagaacatctggcacaaagaaagacattacagagaataaaggcgacccatgaatgcaattctggtttggaagaaaaaaaaattcacatgtcagcattaactgtcgttccctaggggaaaaaagagcaataaatgatccaaagagccaaataatacaagctgatttgcccagtccccatagtaacagactgagaaaaatggaagacaggtggcaagctcctacttcacttgacaaaggcttaggaacatctgaggaaacttggtatacctaatgtgaaattattcccatcaaggaatcagtatttgtaagagggaaggaacccaaccaatttcccacttgtctagaaagtaaacaaacaccgatataatttttagcctcctaagttcaggtactatttcccatcaataaagatctatattacgaaaataattgaaggagggacggaactagtatttactgagtgcctattacatactagaccctttagtttagtaatcttattcaaccccacacaataatcttctgtgagacagagattaccatcctcattttacagatgaagaactgaggcttagttaattaacttgatcacggtcacccacctaacaagtggtagagctaggatatgaacccagaatttcctgattctaaagattatattcttttttctcttccaacctaccttcccaagttatgtgaaaagctgtaagacaaatatttgtaaatatacttctatacctggtattcatctggggccgtgcaaaaggatatataggctccatgatgtctggtgaatgatttctttaattccaaatcctcagtatcctaaagaattaaagagaatattactaatgaatgataaaaacaaagaagaaaaatatgatttaaccacatattaaaattacaggcaaaattagattacttatatgaagtgtgactatagattaataagattaaatgcttgtagattctgccaatcattttcatacgttagagtcattctgccaataaattactgttaatatttattctaggcagcaaaatctaccaatatatctatcccttaaggaaagctcggattctgccccaaaacctttgtatcaacttagtgagctcggtaaggcaggtagtatcaaatgtatgagattttgaccaaaaaccttacaaccctcataaaaccatgaagcagcagaaaaaaatgatttgggctagatatttatttggggcctataatgaagtcattaaagaatcttcattggaaaaaaaacagtactgcatgcattcccacaaactgacttgtgtcagtgaaaaatcagtgttctttttttttgagatggagtcttgttctgttgctaggctggagtgcagcagtgcgatctcagctcactgcacctccgcctcctgggttcaagcgattctcctgcctcagcctcctgagtagctgagactgcaggtgcgcaccaccatgcccagctaatttttgtatttttagtagagacggggtttcaccatgttggccaggatggtctcaatctcttgacctcgtgatccgcccaccttggcctcccaaagtgctaggattacaggtgtgagccaccatgcccagcccagtattcttttttaactccacatgctctctctgggtactatcctccactcccattgcttctacacctacttatctatagcaaacctttagctccacctctcttctgagtttcaaatccattttcttttctttttttcttttttttttttttttgaaacagggtctcactctgtagcccaggctgaagtagtacagtggtgcaatctcagctcactgcaacctccaccacctgagctcaggtgatcctcccacctcagcctcctgaatagctgggaccacaggcattcaccactgcacccggctaatttttttggattttttgtagagatggggtttcatcacgttgcccaggctggtctcgaactcttggattaaagcaatccatcagcctttgcctcaaaaagtgctgggattacaggcatgagccaccatgcccagatgtttcaaatccatatttctaactgcccactggacagttccatctaagtattattgaagctaaacacagacctcgtagtcctttctttagagttcagtatgtcctatattctttcaagccttagagttccttaggtcctgcacattctgtatcaattctaggaaaaagaaactgtctaaggccaggtgtgggagctcattcctgtaatcccaccactttgggaggccgaggtgggtggatcacctgaggtgaggagttcgagaccagccgggtcaacatggtgaaaccccgtctctactaaaaatacaaaaattagctgggcatggtggtgcacacctgtaatcccagctagtcaggaggctgggacaggagaatcacttgaacctgggaggggaggttgcagtgagctgatatcatcccactgcactccagcctgggcaagagaatgagcctctgtctcactctgtgtgaagcaagataaaggagaaaaggattattaatccagatgcagagattatttagaagagactttttagataaagtcagaggctgaaaatcctattgaaaatgctcttataccttgttcaagacagagaaaaacgtgcttctaataaaattgactaggccggacacggtagctcacgcctgtaatcccagcactttgggaggccgaggtgggtggatcacgaggtcaggagatcgagaccatcctggctaacacgatgaaaccccgtctctactaaaaatacaaaaaattagtggggtgtggtggcgggcacctgtagtgaacccgggaggcggagcttgcagcgagtggagatttcgtcactgccctccagcctgggcaacagagcgagactccgtctcaaaaaaaaaaaaaggtgactaaacagtccttcttagaaatatctggacttaaaaggtttaatgcagcttccacagaatgcaggctttaaatcctaaaacccttccttagtacttggttgtcatggataacagtattcacatggataactgtaactctacaaagtataaaaagtgccaattttttcttcattaaacagaagtgtcttaaaatgcgctatttgtgttttattcctttattcatttgggtgaaaagatggataatgttgatttcttattttaaaacaatatacataaggtactttcattctgtcagtgttgtacaagccactaaaggtaataaaactaaaaccacacaacatctacacctagcaaaacatattctcaggtaaagtcattatcgtgtacaatagaaacgttcaaatcatcctcaccccttcttccatataaattatctttccatacccaccaccttagttgctaacttcatcaactcaccagacttatggaaaagtccccataatgctgctagaagagtgtttccatataaatctgatcaaattattctcctgctttaaaagtcaatggctcatgtcaggggcggtggctcacgcttgtaatcccagcattttgggaggccgaggcgggtggatcacctgaagtcaggatttccagaccagcccgaccaacatggtgaaaccccgtctctactaaaaatacaaaaatcagccgagcgtggtggcgtttgcctgtaatcccagctactagggaggctgaggcaggagaatcgcttgaacccgggggacggaggttgcagtgagccgagatcactccacttcactccagcctgggccaaagagtgaaactgcgtctcaaaaataaacataaaaataaattttttttaaaaagccgatggctcttctttacatacagaataaaggatcttcacaatccagccccactctattattccaaccttaacccccccatccactcatcctacattccagtcaaactgaactacttgcagtgccccggtttcaatatctgcacaggatgcctcccttaacttggaatgccctagtaaacccccgccatccctcacaatccaactcgaatgtcacttcctctgtgaaaccttctcccagacaccgtggcgatggtactatactgtctgtactcacacgcatagcattctcgcactttgctgtttacactttacttccagtagtccatgaacttcaaacattaactgatcccttactacgtagcagagtgtgagccagaaattgtgaggaatgcaagagcgagcattcaaggtttcagtcctcaagaaattcccaccgtaaaaacaactttaaatggcacgttatcgactgcaaacctctttcacataccttagctcagatgatacccaaggatttcatggactgcttaatttctcccactagctccccttctcgtcatctgctccaggctcctggagggcggaacccactacagggctttgaatgttacccaccaaccttcccagggccccgctgccgcctctcaaggggaaaccaggagcacaaagctccacttaccgcaacttccgcggagctgaggtctgtttgcagggtaggagcgggagccggctccaaggagcgccaccgccgactccggccccgcctctgggacgttggggtcgcgggaact

SEQ ID NO: 1734 - DNA, 64010 bp, Homo sapiens; identical to SEQ ID NO: 1733

SEQ ID NO: 1735 - DNA, 584368 bp, Homo sapiens
tttgtcttaacaaggtttatttctccgtggttgtgtcatatagtcactaaagcctgagcgaatgcctgaacaagtgaaaattatgcttttattactcctatatttggaataaattttgttaaaatgacaaagaaataaactgacttccatgaagttgttttttaagtttttgccataaatttatgtcacattatatcagcagccatttcaccaatgagatttcctttctttttctcctgggatatctgtttaataagaatgagaaaaaaaggaggaaaacatctacttacaaaaagaaaaataatattcattatttaaacattaccaaagaataacgattcttacaaaattagaagttaaatatataaaatgatataatctacttacatcgatagagcttgttttattacttcgttcaaaaattaattgtgttgtgaatataatcaatattaattttatatctaagtctagtacttttattttttacttcaagtaggtctgttgtgcacttatttacttgtaatagtctgttgtctaggcccacacatgtagcaaacagcatcaagtgagtgaaggtcaggcattcctatcctaataggatatggcttacttggtgtttctatttatagatgaaactgtttcaagtcaaacctttctacaattctttttgttctttatttttcctctgaaatttgcaaaagctattcagcttcaattaatttccaggcttttttgactactctaaagtatgacttcactgacctttgtcctaactttctgatttccagaacattagttattttgcactgattactacagtatatttaaccttcaattctctcttttctactctggagttttgaccaattcagtttcagctcctgcctaagttatcttacctgtaagtattctatgctatttccaattcctaatgtccttttgacaaaaagatcaaaatattttaaccaacacttcattactcaataacaaatatttaataaatatatagtaagagcctactgtatgcaaagcattttcaattctttaatttccttgccttttccttctccagccttcctcaactgatgcaagtcatttgtcctccacaagtctcaatcttttctacttaacagacaaatctgaacggtagggtgatcatatttaaacagtgtctgctctcattgatcaggccttaatatctgatatcctcccagactacagattcccatgatgacccttaggataatttttattccaaagcagtgtagtacagtggaaattggtcttggaggcagatgagtctgagtcaaaattcttattccaacattttggagttatgacatcatcggaaaattactctgtttcctaactatgaaatagtacccttctctgctgaaatataactaggaaaattggctaaatagaaaatctaatgtgctctgtcatcaatcatattgtaaaactttgggtacagccataagactctctcctttcctttttggagtactagaagtgtctagacaagggcaaataaatctcatttgaagaacatgactgtttaatgagactccatgccctttaagagagggaaagaactaggtactctttgtaaatgtaagggaatatttaaaaagagagggcttatcagacacgagcaatgaaaacatgttcctctttaacactggattgaaggagatgagtgtccactgttaaagccatagatctaaattctccttttctccatttaccagagaagagagaagtacccataggcaaaaatcaaagtaaaacaaaacaaaacaatgagaaagcatgaatccagagattcaacatctggtagcatggaacatttgtttcgaaagagccagtacaacatagtaaagaagatcagagacctatacccaagatgtattctcagaaggtgacaacatgaatgagtaaaattgaggggaggggggaacgactcagaaaagcaaatctataaggaaatgtgtttgactcattcttgtcattagaaagaaatgaccccaataaacgtacatgtgcatgtgtctttatagcagcatgatttatagtcctttgggtatatacccagtaatgggatggccgggtcaaatggtatttctagttctagatccctgaggagtcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttatggctgcataaatgtcttcttttgagaagtgtctgttcatgtcctttgcccactttttgatggggttgtttttttcttgtaaatttgtttgagttcattgtagattctggatattagtcctttgtcagataagtagtttgcgaaaattttctcccattttgtaggctgcctgttcactctgatggtagtttcttttgctgtgcaagagctctttagtttaattagatctcatatgacaattttggcttttgttgccactgcttttggtgttttagacatgaagtccttgcccatgcctatgtcctgaatggtaatgcctaggttttcttctaggacttctatggtttaaggtctaacatttaagtctttaatccatcttgaattaatttttgtataaggggtaaggaagggattcagtttcagcatatggctagccagttttcccagcaccatttattaaatagggaatcctttccccattgcttgtttttctcaggtttgtcaaagatcagatagttgtagatatgcagcgttatttctgggggctaagttctgttccattgatctatatctctgttttggtaccagtaccatgctgttttggttattgtagccttgtagtatactttgaagtcaggtagcgtgatgcctccagctttgttcttttggcttaggattgacttggctatgcgggctcttttttggttccatatgaactttaaagtagttttttccaattctgtgaagaaagtcattggtagcttgatggggatggcattaaatctataaattacattgggcagcatggccattttcatgatattgattcttcctactcatgagcatggaatgttcttccatttgtttgtatcctcttttatttcattgagcagtggtttgtagttctccttgaagaggtccttcacgtccctcgtaaggtggattcctaggtattttattctctttgaagcaattgtgaatgggagttcactcatgatttggctctctgtttgtctgttattggtgtataagaatgcctgtgatttttgcacattgattttgtatcctgagactttgctgaagttgcttatcagctcaaggagattttgggctgagaaaatggggttttctagatatacaatcatgtcatctgcaaacagggacaattagacttcctcttttcctaattgaataccctttatttccttctcctgcctaattgccctggccagaacttccaacactatgttgaataggagtggtgagggagggcatccctgtcttgtgccagttttcaaagggaatgcttgcagtttttgcccattcagtatgatattggctgtgggtttgtcatagatagctgttattattttgagatacttcccatcaatacctaatttcttgagagtttttagcatgaagggttgttgaattttgtcaaaggccttttctgcatctattgagataatcctgtgttttttgtctttgcttctgtttatatgctggattacatttattgatttgcgtatattgaaccagccttgcatcccagggatgaagcccacttgatcacggtggataagctttgtgatgtgctgtgggattcggtttgccaatattttatcgaggatttttgcatcaatgttcatcaaggatattggtctaatattctcttttttggttgtgtctctgcctggatttggtatcaggatgatgctggcatcataaaatgagttagggaggattccctctttttctattgataggaatagtttcagaaggaatggtaccagttcctccttgtacctctggtagaattcggctgtgaatccatctggtcctggactctttttgtttggtaaactattgattattgccacaatttcagaacctgttattggtctattcagagaggcaacttcttcctgatttagtcttgggagggtgtatgtgtcaaggaatttatccatttcttctagattttctagtttatttgcatagaggtgtttgtagtattccctgatggtagtttgtatttctgtgggatcagtggtgatatcccctttgtcattttttattgcgtctatttgattcttctgtcttttcttatcagtcttgctagcggtctatcaattttgttgatcctttcaaaaaaccagctcctggattcattacttttttgaagggttttttgtgtctctatttccttcagttctgctctgattttagttatttcttgccttctgctagcttttgaatgtgtttgcttttgcttttctagttcttttaattgtgatgttaggttgtcaattttggatctttcctgctttctcttgtgggcatttagtgctataaatttccctctacacactattttgaatgagtcccagagattcttgtatgttgtgtctttgttttcattagtttcaaagaacatctttatttctgccttcatttcgttatgtacccagtagtcattcaggagcaggttgctcagtttccatgtagttgagtgcttttgagtgagtttcttaatcctgagttctggtttgattgcactgtggtctgagagacagtttgttataatttctgatcttttacatttgctgaggagagctttacttctaatgatgtggtcaattttggaataggtgtggtgctgaaaaaaatatatattctgttgatttgtggtggagagttctgtagatgtctactaggtctgcttggtgcagagctgagttcaattcctggatatcctttttaactttctgtctgttgatctgtctaatgttgacagtggggtgttaaagtctcccattattattgtgtgagagtctaagtctcattgtaggtcactgaggacttgctttatgaatgtaggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccacttgcttggtagatcttcctccatcctttcattttgagcctatgtgtgtctctgcatgtgagatgggtttcctgaatacagcacactgatgggtcttgactctttatccaatttgccagtctgtgtcttttaattggagcatttagtccatttacatttaaagttaatattgttatgtgtgtatttgagcctgtcattatgatgttagctggttattttgctcgttagttgatgcagtttcttcctagcatcgatggtctttacaatttggcatgattttgcagtgactggtactggttgttcctttccatgtttagtgcttccttcaggacctcttttagggcaggcctggtggtgacaaaatctctcagtgtttgcttgtctgtaaagtattttatttctccttcacttatgaagcttagtttggcttgatatgaaattctgggttgaaaattcttttctttaagaatgttgaatagtggccctcactctctactggcttgtagagtttctgccgagagatccatggttagtctgatgggcttccctttgtgagtaacccgacctttctctctggctgccgttaacattttttccttcatttgaactttggtgaatctgataattatgtgtcttggagttgctcttctcgaggagtatctttgtggcgttctctgtatttcctgaatctgaatgttagcctgccttgctagactggggaagttctcctggataatatcctgcagagtgttttccaacttagttccattcttcccttcactttcaggtacaccaatcagacgtagatttggtcttttcacatagtcccatatttcttggaggctttgttcgtttctttttattcttttttctctaaacttcccttctcgcttcatttcattcatttcatcttccatcactgataccctttcttccagttgatcacatcagctcctgaggcttctgcattcttcacgcagttctcgagccttggctttcagctccatcagctcctttaagcacttctctgtattggttattatagttatacattcatcgaaatttttttcaaagttttcaacttcttttcccttggtttgaatttcctcctgtagctcggagtagtttgatcatctgaagccttcttctctcaactcgtcaaagtcattctctgtccagctttgttccattgctggtgaggagctgcgttcctttgtaggaggaaaggcactctgctttttagagtttccagttttcctgctctgttttttccccgtctttgtggttttatctacttttggtctttgatgatgtgatgtacagatgggtttttggtgtggatatcctttctgtttgttagttttccttctaacagacaggatcctcagctgcaggtctgttggagtttgctagaggtccactccagaccctgtttgcctgggtaccagcagcggtggctgcagaacagcggattttcgtgaactgtgaatgctgctgtctgatcgttcctctggaagttttgtctcagaggagtacccggccgtgtgaggtgtcattctgccgctactggggggtgcctcccagttaggctgctcagaggtcagggatcagggacccacttgaggaggcagtctgcccattctcagatctccagctgcatgctgggagaaccactgctctcttcaaagctgtcagacagggacatttaagtctgcggaggttactgcagtctttttgtttgtctgtgccctgaccccagaggtggagcctacagagacaggcaggcctccttgagctgtggtgggctccacccagttcgagcttccaggctgctttgtttacctaagcaagcctgggcaatggcgggtgcctctcccccagcctcgctgccaccttgcagtttgatctcagactgctgtgctagcaatcagtgatactccatgggcataggaccctccgagcctggtgcgggatataatctcctggtgcaccattttttaagcccgttggaaaagcacagtattggggtgggagtgacctgattttccaggtgccgtctgttacccctttctttgactaggaaagggaactccctgtccccttgcgcttcccgagtgaggcaatgcctcgccctgcttcggctagcacatggcgtgctgcacccactgtcctgcgcccactgtctggcactccctagtgagacgaacccggtacctcagatggaaatgcagaaatcacccgtcttctgcgtcgctcacgctgggagctgtagactggcgctgttcctatttggccatcttggcttgtatgtttattgcggcactattcacaacagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaagaaaccaaacactgcatattctcactcataggtaggaactgaacaatgagaacacatggacacaggaaggggaacatcacactctggggactgttgtggggtggtgggaggggggagggatagctttaggagatatacctaatgctaattgatgagttaatgggcgcagcacaccagcatggtacatgtatacatatgtaactaacatgcacattgtgcacatgtaccctaaaacttaaagtataataataataaaataaataaataaataaaagaaagaaatggcccctaaaatttcataacattaatctaatccttacatagtttatcaggctggattttacactatttttattgccccatatcccaaaacaatagcttactttaaggtagtcatagctgtaacacacacacacacacacacatacacacacacacaccctttaaattacatatctgctaaattaaaactgtactgagaaactatttctcaactaccagactgggaaattttaaaacctgaacagtacatactgttggtgaggctgtgtggaaatatgcactcccatatattgctggtgagaatgcaaattggtgcaatcccgaaatagaggaatttagcaatatctaacaatactatatatataattttatatatatatgtatatatatatattccctttctcccctctccccataatctgactttcaggagtttatcctgaacatattaggccaacaataagaaaagagatttgcacaaggctattaatttcagcaatatttacaattgcaaaatactgggatgtccaaatataggaaattggttaaataaactatgctggatttacacattgaagttccatgtggctgtaagaagagtaaggaagttttctatgaattgatatggagggttcttcattaacatgtgtaaaacatcaaaggacaaaagatatattgtatattacatatagataaaataaagaataaaagatataccgcatgttgtatatgtgtatagcatatgtacattatatgacctttgtgtaaggaaataggagcaaaagaatatatagatatgtgcatttaacaaaagaaactgaagaatgataaaccagaaatcaagaaattatttacctacaaagagtaggagccctattgaaccaggtggaaaaggttggagtgaatacagtttctccaagtatacactgttgcatagttttgacttttagaagcacagcagtgtttttcatattagaaacatagtggatgcaaacagtgacaaatgaaccaactttcatttcaaatgaataacatagccacactgagagggaaaaacaaaaacataaacaaaactaatgcccagcgtttgaacatactttaaaaaaaattagtccaaaagaaaagaaaacataaacaaattttgaactcgtcttagtaggttgttttttctttttctttttcacagatatattgggtattaccatcctgaaactttttttgtgcatggtactgttgataaagtgaataaatgtgttgttgatttcaggacatggttaagcaaatgagtaaatgtgttgatgttacatctcacattggaagaatcaagttatgagtatgtaatagtggaagggagaaagacaagagccctgtagtgggtgatcatgtgaatggagacaagtattgacatatatatgtgtgtgtgtgtctctctctctcacacacacatgcactctgctgagagggctggaaacaaccatacatactgcagtagcaatgagcacatttagcacccagatcttaatttctaaatactattacccactaaaaaacaaaggagcaaagagcaatagataataataattaaaaaaaacaggctacccaaacaaatgactgagtccagaacttgagcaaggaagatacaaaatgatcccaaacattctcttgtaccagaaattacattcccaaaaagtgctaataacaaacaaacaacaacaacaaatgatgggtagaggcatgtcaaaagatcctagcagttgtttgaaggggttagccctggccaaatgtgaatgaacattaatttcttttcttttctttcttttgttttttgttttgtttttttttttgtttgtttgttttgttttgcagttgttactggaaaggggtagcaatccagaccccaaaaaagggttcttgggcatcgtgcaagaaagactttgaggcaagtccataaagtgaaagcaagtttattaagtaaacgaataaaagaatggctattccataggcagagcagagacatgggctgctcaactgagtatacttgtagttatttcttgattatatgctaaacaattggtggattactcatgagttttctgggaaaggagtgggcaattcctggaactgaagttttctccccttttaagaccacataggtaacttctggacattgccagggcgtttgtaaactgtcatggtgctcctgggagtgtgttttagcataccaatgcattataattagtgtactatgagcagtgaggacaataagacgtcacttttgtcaccatcttggttttggccagcttctttgctgcaatcaatttgatcagcaacgtctttatgacctgtactttgtgctgacctcctatcttaacctgtgactaagaatgcctaacctcctggaaatgcagcccaggtgtcagccttaacccagcccctattcaagatggaatcgcctcgattcaaaggcctctgacacagtgatggattagaatcaactgaatataacagaaatccattagttcatactgataataaattgatagtagattaacaagtaaagtagaagggagggctcttctttatagtaaatagctaataatataattgaaattagtggcagggttggaaaagattttatttgataaccattatattaaggattggagtggataaaaatcatcaattgatgctaaatataggtaaggaaaagttaatgaggaacagaatatttacacagtctcaaagtatctccctataaattattaattataaaaggaaatgatatctatacagtggagaaaatgagcaaaattttaaccaaatgatgaaaattaatctcatcaaaaagagacaaatagtaattatgtgcctccatatgtaatatatcctgaaaagtacatacattacttatatattactccaacaaaaagtacataatctgatgctaatcataaggaaataccagaaaaacccaaattgagaaacatttctcaattttttaaggattgtcactgtcatgaaagacaaagcctctttcagattaaagaaaactaaagatacatgaaaactaaatgcagtataagatcctggattgaatattgtatttcccaaaaatgcttcagataacattattgtgataatggacaaaattaaagtgtgaattattaattacctaaagctattctatcagtgttaccttttctaaatttgatagctaaactcggttttataatacatatattgttattctttggaaatgcacactaaaatttcaaggcattggggtggcatgatgtatacaactatgggaagtcaggattttcttccccaaaatataaatgattgttgagctgaagacaactaacaagaagacacaggaaatctccttgcccgtcctcaatttgcctaaaagcaggccaaagataaaagataccactctctactctagctatcctggcccactctaggtattctagatttgcaaaaacaaaagtttttttttttttcctgcccccactcccactgctaccagggggaacaaaggttaaccactgaagacaattttggagtcttatggaaatggagatggtacagaggaatctacattaacaaggtttactcactaacctttatctaccacttattagccttcccccaagttgctgcctcaacagactcaaaggtttttttcctttgatttctcacttctctaaaaatttgttattttttattgaagatgctatgtaaactggaatccaaagccatctgagaactactcattccttgggtgtcttccacatatctgtgaaatatacgcattcataaacttctgtttgtcttttttgtgttaatcagtctttcgttacaggggttcatttcagtcctatggggtttatttttcccctgcagaacttaatctcaactggttccaaaaactttctacttttgttgccatctttctgtaaaatatttaaaaatacatggttaaaacatttaatataatgctaaagttgaacttcttggatggtatagtatttaaatgtaattaaaataattttaattatttttaaatttttatttccccaaatataagtattaattattaaaagtttgacattatagcacaggtaaaataattagtcttgttactgtaaatatgtgaaattcaatagatgatagccttcgactgaaactggtagaaggactagtatccataaaccaaaaataaagttctaaggctccccaaccatctgaatgcagcacctgacagccagggctcttaaaatttaacccaagagactgtttcaggccatgaagggaagtggaggtcgaacgtgcctcattatacctctacggcactaacatcaacacagactttaaatctgataaggaacattttacaacctattctctctgaagcctgccagctaaaagtttcatctacctggtaaagctttgctctccaccacctcttatagcaacccagacattcccttctattgatcccaggtctttggataaactcaaccaattgtcaaccagaaaacatttaaatttacctgtagcctggaagtccttgtcttgagttgtcccacctttctggaccaaaccaatgtatttcttaaatgtatttgatagatgtatcatgcctccctaaaatgtatcaaaccaagctgcgccccgaccaccttggacacaagttctcaggacctcctgagggttgtgtcatgggccatggtcattcatatttggctcacaataaatctcttcaaatattttagtttgactcttttcgttgacatatcttttggctttttctgcaagtatatgtatgacattgtcaccaagcttattacttgattagtaactatccaaggtatatatctatgttcttcttaactcctggacttcaccatttgctacacaatggtgtggcaaattaagtgaaataatcgctcaaaatgaagttttgtacactgcttgaatacaatgctttctgaacatttttaaggttctcatcagactattggtcttaactatgtattttatttctaatacttttgcatgcacttgcttgtttacacaatcacttgtctgcatttcagttttcatttgattcattttttcagtatgaccatggagtgaaatggcaggaggatctgtggactgtgtatcatgtaagaaatacctgtactctcaagatacagccattcagttacttcagcagtttccaacaaactattttctctgttagtaaccactgcttattactcattcctgtcatcatagatttgttaagattttctctttctttcaagtaacttttttacatgcagcagctattatatcttggttgaagatcttgtataagttgaacatctcatataagaacagtttttgaaatctctaaagtcatgacaaaatttcaaaatataatgcacattctaaatgacatcttgtatgtttatttatatttgaaaatgaatctttggttattaacataagggaaatatcatgccttatttatgcaaatgatagtgtgcttttgtaaacccacatgatcccatgactgctactcacaggtaagttcaaggatgtcggaaataacttgcaatcagcattttcccattctatcctccaaactgtgagacctgaagttgaaggtgaatagtacatttagcactgaacactaaaacagaatcccaatttccattcatttctggtttatatggatgtcaaggttttgtgaaacatactttaaataggagaaataagaaaacatggttagtattagagatgataattttttaataaattttacctactattattcaaattcatatgtaaatgaatgcaaaatgaattcaataggcgtttaactagttttatcccatgtagagttaggtattttatctttaacactagaaaaatcctcagggtaatttgtagttgttaagacagaagcctagtttgttatcgtccctctgcagtggcttaataaaaatgcctcagacattttctgagcctaaatacgatatgcattttcattcttctatatgggtaatttttaattttcttctttacctcaagtttctgaatttattatttttctgtaattcttcctaatttctatagcaaactttttataattggaaaataactatacacgttatataaaacttactttgataaaatgaaaattgttatatgtattataaaataaaaactatagctaatataaggttttaaataagctctacaactcaatagcatatttattcacccaaaccgcacaagtaacagaccaattctggcaattctgtcagatgcctaaagtcaaataaaacgagatagctttaaatcaccatgtgtgaaatctgaagagaaaagaaggaaacattcagtgttagctataaaggctgcatggtagaaacaaggatttattatatatttattattaacatagtaatcattttaaattataatataaaaaatggaaatataaacaaattttaaagttttgaactttaattgaaattgtctgcactcttctatggggagaaaaagacaatttaaaacaatgatatttgaaacataaatgaataaataaattttaaaatgtcctcaatatctacatatccacatatattaattatcattttcttcatctataggaagcatggcttagtggaaattataaagcattatgagctaatgtggcaggccaggtctcactaacagctgaaatggcaggcctctgtgacaaatatgtcagcactgactgagtggttaagttaaatattaaaagctgatagagccagtgcccttatacaaagcctggaatgtaacaaaagcccaccaagagttttgcctaggcttttcctgggccttgaagcatgacaagataatgaaggaattgttaacaggacccctctaggattcaacaagttttcttacggatctgaagaatcttcatttgccatgaaggtaacacatttactaattccagggattagggcatggatagttttgaggggactttattctacctatcacagagtacttcatgtgactgcagttgaggaacataattattaatctctaagaaataataattatgtgtttaaataaactcgtgaaaccctctgttaaaaaaaagtcacttctagagagctgaagtatacaactattgtagaagggaaaatatttcttccttcactcattgcaaggttcatggctgacatccctaaaataaaagacagattgacaagaggaaaacatacaaatttatataagttttatgtgacacaggaaccttcagaaatgaagatagaaaagacccagagaaaacaatttatctttatagacagttgtaaaaaaaaaaagtatgattggcagacaaaagagtatgacttaatgataataaactgaggggaactcagcaaggcttgcttgttcagattctttttggcatctctgtgtcaaactccatctctctgggtttaggacagacacttgtcacatgaaggcctttaggagaagagagggattacatcagagagtaaccgtcccaggttttatggtttgtttcagggtgaaaggggctggtagaattctggttttcatgatccttttcagcaaaaaagtggtgggaggaggtcagaaagacctttctgcttctgtggatttttaactttctttcgggttaaatgattaagtatgctaagatgccatattttgggatagtgttttttgcatcccacttcatcactattttaagaactctaaaaagtttccaatgtatatgtaaaaaattttatttaatagttaatcttcaaagaaaaaagaaggtccaaataaggacaatcagaaatgactaaggtgaaattacaaaaaaatcacacggaaatacaaaagatccttagagactactatgaatgtttctatgaatacaaactagacaattcagaaaaaaaaattaatttttggaaacacacaagctccccagattgaatcacgaagaaatcaaaatgctgaacagactgctaatgagttccaaaattgaatcagtgataaaaaaaaacctaacaatgaataaaagccctggaccagatagactcagaacccaattctcccagacatacaaagaagaactggtaccaattcttctgaaaccattctgaaaaaatcaaggaggaatgattcctccccaactcattctacaaagtcagcatcattctgatcccaaaacctggtagagacacaatgaaaaaagaaaacaacaggccaatatctaaatcctcaacaaaatactagcaaaccaaatccagcagcacatcaaaaagttaattcaccaaagtcgagtaggctttattcctaaaatttaaggttggtccgacatatacaagtcaataaatgtgattcaccacacaaacaaaattaaaaacaaaaaccacatgatcatctcaatagatgcagaaaaagcttttgataaaaatctaacatattttcatgataaaaacccacaacaaatgggacatcaaaggaacacataataagagccatctatgacaaactcacagccaacaacatagtaaacatgcaaaagctgaaagcattgcccttaagaactaaaacaagaaaaggatacccactctcaccactcttatttgccatagtactagaagtcctagccagagcaatcaggcaagacaaataaataaaaggcatttaaacaggaaaagaagatgtcaaattatctcttttcactgacaatatgattctatacctcaaatagcctaatggctctgccaaagagcccctagaactgatgaataacttcagtaaagtactagcacacaaaatcaatatataaaaatctagcatttttgtatagcaacaatgtttaagctgagagtcaaatagagaatgcaatcccatttaccatagccacatgcataaaaaaatctagaaatatatctaaccaaggaggtgaaagatctctataaggagaactacaaaacactgctgaaagtaatcatagatgatataaacaaatggaaaaacaatccatgctcatgaataggcagaatcaatattggtaaaatggccatgctgcccaaagcaatttacagattcaatgatattgctatcaaactaccaaggtcatttttcacggaattagaaaaaaactatactaatatatatggaatgaaaaaaaaaaaaagccccaatagccagagcagtcctaacaaaacagaacaaagttagaggcatcacattacctgactacaagccatactacgaggctatggtaaccaaaacagcatgcaactggcaccaaaacaggcacacagacttatggaacagaatagagaacccagaaataaagccacacacttagacaaagttgacaaaaataagcaatggggaaaggactcccttttcaatacatggtgctaggataacttgctagccatatgcagaagaatgaaatcgacctctacatatcatctaaagaaattaactcaagatagattaaagacttaaattaaagacctaaaactataaaaaatcctagaagaaaacttagaaaatacccttctggacactggctttgacaaagaatttatcattaagtcctccaaagcaactgcaacaaaaatgataattggcaagtggtacctcattaaattaaagagattctgcacagtaaaacagactatcaacatagaaaatatacaacctacagaacaagagaaaacattcacaaatgaggcatctcacagaggtctagtgtccaaaatctataaaaaacttaaacaattgaacaagtaaaaagcaaatagcctcattaaaaactgggcaaagggcatgaacagaaacttctcaaaagaagatctaccaataaacatatgaaaaatgctcatcatcactaatcatcagagaaatgcagattgaaaccacaatgatatgccatcttacaccagtcagaatggctattactaaaaagtaaaaaaataacagatgttagtaacgctgaggagaaaagggaacactcatacactgttgatggtaatgtaaatttgttcagccactgtggaaagtggtttggcaatttctcaaagaactaatattagaactgccattcaacctagcagtcccattactgggtatacagccaaaggaaaagaaataattctatgaaaaggacacatgctcttttatgttcattgcaatactattcacaatagcaatgtcatggaatcaacctaggtatccatacgtggaggactggacaaataaaatgtgttacatatacactatggaacaccaacagccataaaaaaaaatcacactttttgcagcaacatggatgcagctggaggccaatatcctaaatgaattaacctagaaacagaaaaacaaataccgcctgttctcagttgtgggagctaaacattgggtacacatggacttaaacatgggaacaacagacactgggactattagagaggggagtgagggaggtggtaaggactgaaaaactacctattgggtattatgctcagtacatgggtgacaggatcaatcataccccaaacctcagcctcataccatatgtcatataacaaacctgcacatgtattcctgaatctaaaacaaacatataaaaataaatagttcatctttttctttcttttcacatctattaaccaggacagatttctcttaacactaattataaagtacttaactaaactattttaattgttaattgttaatttcaacaataactgtcagtaatgtatacaatacagttaataatgatcatggatgttcaaaaattataatccaaaatatactaaaggtcctcaaaaaataaagttattatctttgcagacatatatccattttcagaaatttatagaattacacactggcaagaagatattacgaatataacacgcctcctgttagatttaattaacctctcagtttaccaaaggaaaataatttatcctttctttctttcttttttttttttttttttgagatggagtctcttatgctgtcacccagactggagtgcagtgctgtgatcaaggctcactgcaacatccacctcccaggctcaagcgattgtcccacctcaacctcccgagtagctgggaccacagatgtgtgccaccactcccagctaaatttgtgtatttttggtaaatatggggtttctagtgagtgaaactagagttttactgttttctatgaccaaattatctggcctaaagaggaggtcatgggaagtttcaatatgtagccaactgagacagaagtagtgggtagcctgaggatccaatacttcaattgcatctgaagaagggagcagtgttatggaactgagcccttaatccatggaatctaaagctaactccaggtagataacgtcagaattgaactgagttgtaggacacccagttgatgtctgcatagaattggagacttacttggtgtgaaaacaaacccacactttttttttttttttgccagaattattggcatgaacatagcagagagaaaaaccaagagttttggtttgttgagttttttcccctttatccacataatagccaatttccctgcaattttcaacaatggtttaaaccaaaaagaaagggttccagtaaatattaactaaatcagaagttctaattgtgagagtagttcttcttcttacagcaatctaaaattgatcttacctatattaagcacctcgttacttaggtattgggttcaaagctatggcatagtcaggcctccactggctaggaactgaaaatttaaaaatgtctgggagcagaattaattaagatttaagaattttaaattttcctactcatttagcatcaaacgaacaatatcagtgccatctaaaaaataaatcactcatctgttttcagctaagaactcaagtttaagtgagaaaagaagaaaatatctacaataatcaatctttaaattgcaagtgacttttagacaaaacacctacttctgcaaagaacttgcatgaatttttagtaagttgataataataatcattagttatggctattaaatgatatctaagtgtgttcaatgttgctttcctattagtagaaaagtacatattgagatacacaggagctttatagtatatatgtgaatacacatacatacacaccctgaatatacaaaacattatctatgggagttaaaatattaactattttgactaattatcctattcaggaaagcatcttaaaaaattttctaagcatcttagaaaaaatttaatctcaaaatttgaaatatatctaaataggagttttggagtgaataaaatacttatcttgtttgaaaaattttctgctaaatttattacttaattttacaaggtccatttatatttaaactccattttaaaataatcacaaagttaagaatggattaaaattaaatattgctggtgaaacttcaaaactctggcccttcatcttctaaattggaacttctgccacctttacaaaagaaacaaacttttaattcatctatttacttgcatagatctccctttggctgtgttttaaagtgtaccacactaaggtgatctacattcattaagttcatgctctggtctccaataatggagcttgattttctctcatttaatcagatttataaaattttgcacactaattgaggtaaactgtgcaattaaaaaaccaattatattttacaattgaccaaatcttttattgaaaccactaatcccataagttgtagacttatacatatagccatcaaaattaagtgttatatatcaacactttatttatctatcactaattataaatgcccaatctaactgatagaaaatagaaataatgaaagaaagcttggattgacagcttactcatgatcttcatcactctggtaaatatattaactttttcagtgggtatttaatgcactggtgtgtaataaactatactaattaaccgaagtcaaaataataccattccaaatagccaattattacactataagaattaggtagctcttcagcagcagtcaaaatgaagacactcattgtccgtatttattctgcaataaagtcataagacagcgttaactcactcattttagaagataccttatcagaatcaccaggtgacatacacatataatttatataatacaagttataatgattatatgatataataatattatcactgctatagaacaagacataaagattatctgacagaatattacttagaataaattttgtacacatatctctaaaggaaatttaaagattctcctacttatttacttgattgtttaagaaggatcaatcatgaatggtttcctacatagattattagaagccatggtaaacatttcaccctctctgtctctctgtctctgtctctctgtctctgtctctctccctctcacacacacacacacaaagagaattatttaaattcctcaaagaaatactattttaattactaatcaagaaaacttccagcctccaaataacgacaaactgctttaaagaaaaaggaaagtttatgactataatcctactctatcctagctaaatatttaagtgcaagacaaccaccatttgatgtgggttgggtcagttaacaaaatactttattctcactaatttttcaggtatgttgatgaagagtctgattcattatgtgaaatataattaaattttcatggagatacaggtatttcaaataaacatcaaggctcattttaaagcctgctttgtaaaaaatatgcgttcctttgcattttcctatgagtaaattcagggttttttaatcagaaaaaatacaattataaattttgattaaaagttaaggtttttcatttatttacttatatttatttggatatgattgtaatgatggttaatttttcacttttacactctagagctgtggtgtctaatagagtagccactagccatttgtggctatttccatttcaatgaattaatattaaaataaattacaaattcatttctttggtcacactaaacacactttagttgctcaactgacaggtaataagaaatatttccattctctcagaaagtttttttgagcaatgccactccagaagcaccacaaagagtgaaaggattacaagcttgggcagttagcacttttaagtaacataaccaagattcaaacccaggcatatctctggagtctctgcttttacccattagccaactagttttaggaaaatttataacacttactaaaaattatatttggcctaactctgtagctacggagaacaatgcagaaatcatttaaaagcagattaggcagtgtaagtttagattaatttatacttaactaataatgatgatagttacatgtaagtctggactcagcctactttcaaaaataatttggaactattaattacactataaagtctaaatatctagcatcttattagaacatttatcatttaactcatcaattaaatttcaccttgccgttcagccaggagaaaaatgattattgtaatattatggtcaaacacaaatgggacaggagaactgtatgctctgaaaccagatccttgaaattcttttcaaaatagctataacgtgcttagaaaatattcagaaaatgagattattttataaaacatctgtcaaaggatctaaagttccaaagaattataattgtattttggctgatctgatctgaaagcttcacattatccttccagcctggccataaattcctgtttcctacatctagtagctctaggaatctttccagtgtccacaatgggaaaaaaattattccacttattctgttccgagtttataattatttcttatttggtcttattattttataactattttaaatagaaatttaaccttaaaataattttctttttgccaagcatctgcagctacattcaacactggctcctggaaccaccccctctgccccaaccccatctcctacttctgctctatggttccctctcattatgcaagaagtcagacattgactttagaaccaatactttctgcaaatgttttctaaacaacaaactgccaatatctatataatgtgcatacacctaatcagtgtatttgtcaaatacgcgttgttggttgaatcagttagtggattagaaaatcaattcagtgataagcttgaaaaaatagtaaacatcatgatgcaatataaacaacacttttttggtaaaaatgtcatggcaagcaatagtgaatgaagacaaaagtgagtcaattcagtaataagtagaagatattatctttattataataaaaatttgtttgcctatatattctaatgtttctctttcatctgctaatcatactcataattttatctttctgattatgtttttgtcaaccatcaataaatctatttctctgacaaatatgaaatatgatttctcagaaagagtatttttgagaaatgggaaagaaaaagcctaaatcagaacacagtccacataactgagcaaaagatataggctagaatgataagtaaatttgtggcacaattataagttcaactgctgtatttactgaatgcaaacaaatgccagtagtaatcctaaaagctatcaaaatataaattttaggttaactgactcactagcaagctctatattatttacactgcagagtggagataaatgaggtcagtgctatgtgaaatgctatcataagctgggaggaaaaaaggtctgcaaactgccaaatattaccaagaatgtgacaatttcctgatctttttgaacactgtagtttgcttatcggtaaaacattctgggaaatgtatttttttgcagaaacataaaattcttgacattactgatgaaaatgcctttacattattactgtgattctacttgttaagtctcatcatttgtcaacttgtaagcaaatgtagatttgatgatttcagctgtcatggtttcttgccaagactgcaaacagacttataggaaatttctaaccactagaagaagagataagtgtccagaacactaattttcacaatagccagctaccagctccaccccattatcaactacaaaaatttctaaagtagcaatggaagaggtgtttttaggatccctcagaacaaattaaaagaatagctactgtacactgtcagttaactagcaggccctttacaatgctacactaaagtagagaactagtctcatcatgatgcagccattaacagaaattgaattaacagaacctttaaaaattagcagcattgagccttcactttacaaatttggaaaatatatttgcttaaccaagagttcctgctattttcacatgaactgacagaaaaacatcctagtgtaatcactgcttctcatagtcaacttagagtgttattattcccagtgcaatgggccatttaggactatttggttggagaaaaagacaggaaacactgtccagggactcaagtaatgcatacaaactcacataaacttaaggtaaagagatgtaaaaagatattccatgcaatggaaaccaaaggtgagcaggtatagctatttttatatcagattaaacagacattaaagcaacaatgttaaaaaagacacagagaaacatcatacaatgataaaagaatcagtccaacaggaaaatatcataatcctaaatatatatgcacctaacatgggagctcccaaatttataaaacaattattactagacattagaaatgagatacacagcaagacaatagtagtggggggcttcagcactccactgacagcactagatatacaggttatcaagatagagtgtcaacaaagaaacaatggacttaaactataccctagaacaaatggactcaactggtatttacagaacattctacccaacaactgcagaatgctcattattttcattagcatatggaacattccccaagatacaccacatgatagaccacaaaacaagtctcaataaatttaagaaaatcaaaattatattgactaccctctcagaacgcagtgtaataaaactggtcattaactccaaaagaaaccctcaaaattatacaaatacatggaaattaaataatctgctcctgaaggatctttgcatcaacaatgaaatcaagatggaaatctaaaaattcttagaactgaatgataatagtgacaaaacttatcaaaacctctgggatacagcaaaagtggtgtaaagaggaaagttcatagcattaaatacctacatcaaaaagtctgagagagcagaaacagacaatctaaggtcacacctcaaggaaacagagaaacaagaacacaccaaatccaaacccagcaaaagaaaagaaataacaaagatcagagcagaactaaatgaaattgaagcaaaataatacaaaagataaatgaaacaaaaagctgattctttgaaaagataaacaaaaatgatagaccattagcaggattactcaagaaaacagagaagatccaaataagctcaattagaaatgaaacaggagatattacaccaatacagcagaaatacaaaagatcattcaaggctactatgaagacctcaagtaaatctagaggagatggaaaaaatcctccaaatatacaaccctcctagattaaatcaggaaaaaaatagaaactctgaacagaccaataacaggtagcaagattaaaatagtaataacaaaaattgccaacaaaaaaagtccagaaccagatggattcacagctgaattctttcaggcactcagagaataattggtaccaatcttactgaaactattccaaaatataaagaaaggaggaatcctctgaaaatgattccatgaagccagtattcccctaatactaaaaccaggaaaggacataaaagtccccctaatactaaaaccaggaaaggacataaaatattctcaaaaaaaaaaaaaaaaaaaaaaacaaaactacaagttaacatccaacagcattatcaaaaagataatccaccatgatccagtagatttctaccagggatgcagggatggtttaacatatgcaagtcaataaatgtgatacatcacatgaacagaattaaaaacaaaaatcataaatgcaggatatccagtgaacaccatcaatgggatcaatcaagaaccttatcaacattaagcaaccaggaaaaagttctccttcactgccagatccaaaacttccctcatccagtgagaaacaccaaggtggctgaggtagcattagcaagaaaaatctaaccacaacaagaagcccaacacagaagcctctttgatcctgtgggtctaacactcccctcccttgcccatctaaaaaaaactaatgtggccaaagtgtattggtagagagaatcttgtcacagcaagaacccagactggaaagttttctagatctttcagacagctaactgtgccacagcaagggagcctcactgttttcatatgttttaggttcccctatcactctgggagaatgctcatggcctagtccaggaatcagctcctatcttctcatttagaaacagaaggcacaagtaggatatccagtgataccagataaaccaaaaagcttaatgtaacactgcaaagcatctaaaaattaaactgttattagagccttaaccctcaaaaacagatcaggtactgtgcgctgaacctaaacagagtgactgtctgctaaaataaaaaaaaatttaaataaaacccagacaaaatagaaaaaaatagatgaaatgtctaagatataattaaaaatcgcccatcataccaaaaaccaagatgttcaaaaccataaagagaaaagactgatgccaaactgagaagaattagatgtcacaattatctgtaaggattttaagagacccatcataaaatgattcaacaatcaattgtaaattctcttacaacaaataaaaaatataaaatttcagcaaataaattatttaaaagaaacaaatggaaattatagaacccaaaaattcagtaatagaaaactccctggatggacacaataatagagtgagataacagacaatacaatcagtgaaactgaggacagaccaatacaattcatctaacactaagcaataagaaaaatatactgaaaaaagaacaaagtctaagggacccaagagactatataataataaccgatatttatatcatctaagtcctggaaggaaaagagaaagacaataaggttaaaagtatattcaaataattaatggcttaaaacttccaaaatttgatggaagacacataattacatattcaaagagctgagtaaactccaaacaggataaactcaaagaaattactgcaagtcaaatcttaatcaaacttttgaaaatgaaagacaaaataaaaatctttaaagcacctagagagaaaggcatcttatttatggggaaacaccaatttgaaggccagcagatttgtcttataaaacaaaggatgccagaaagaaatagaataatgtttttaaagtattgaaaggaaaacaccatcaacatgaattctatattggaaaaattatccttcaggaatcaaggggaactaaagatattctcaggtgaaggcaaactaaaagaatttgttgctaatcaacttaccattaaacatcatgtaacagaagttctgtagagagaaaggaaataataaaagaatcttggagcatcggcaaggaagaagaaaccacagagcagaaatatggatacactcaatagactttcctttttctcatgagttttataaatcacatttgatgattaaaacaaaaattataacaaatatcattcagattttatgccactcttatgtatggcaattatcaaagtggctataaaggtaatgtttgtctttgctagtaaaacacaagtatctagagaattaacttcataattcactcatcttaatatgtccattgtatttttcagaatgattaacacatattagtgtttaataaatatttagtaaatggatgaatgaaatgggtaaatttttatttaccatcattttccctcttcctctaaataactagttaaatatttcaaatattaaagtaattattatgcaaagcattttttaaagctctgatttcctaagaaattatattgtttataattaggtaccattgtagcccacattactttggaccaacaggtttctttgtgttatactattctaaagataacattcaataatattccatggatatgtggctttatagcttcttggtaactgaagaagtacaatgaggatatttcagaaatgagaaaaatatccagaattttaaaaacaataagaaccttcaagtttgataatataggtaacattaacagttgaggtgggtcacaggacttagcatacaagtcctgtggccttatttttaacttacggtgtttttaatagtggcccaattccattcctttgtctgagatctgtagaagtttggaagtattttacagaatagtctttgtagtcctaaaatgtcttaaatttctgtttcatatttctcacatccagttcaaggccccacccctattataactctggccccaacatgttacagaatattaaaatggattagtgtttattttctaaaggaattagaaactaggaattaaacattagggataatcctgaccctccttaagtctgaatgaattcctgatagctgtgggcatcagtgtatttacagggatccctaaataaaaattaatttcagaatcccattcatcttcaggtagttttcatcatggctgtgataggaggaagagatgaccctgagatttgctttctgaaattaggctgaaatttgctttctcaacttaggtaatcaaatgtatgatattacaaatagtaaaatgacacagaaagtatatgtgtaagaagtgaatcagaaccaatcatggtgactcacgcctataatcccagcactttgggatgccaaggtgggtagatcacttgaggttaggagttcaagatcagcctggccaatatgacgaaccccatctctagagaaataaatcagaactagcttcctcaaaagactgataaatttgattaaaaaaattaactactctgtacaggaaaaaaataccataaatgcaactgaaaaaaatacattatccaaggaaagcttatttatattacacaaggcagatgtattttgcttaatttatgaagagcttatacatccaattggaaggagataaactatcttagtgtgtattgaatatgagatatgaacaggtatttacagaccaaaatgtacaaatcaataataaatacctgaaaagatattctacctttattacaaaaaggaaattaaaaaggaatcattttcaccaatccaattggcaaatttaaaaactctgatgctatccactgcaggcaagagtgcaataaaaagaagctcatatcatcagagagaatgtaagttggaacacgatttctgaaaaataatttggcaatattttttaaaaattgacagggatatcccttttgactcagaaaacccacaacttggatttgttttaccgatatgattatcaaagttttccaagatatattttaaaagatatcttttgcaaaacaaaaataacaaaaatactgggaacaattaaagtatccaaaaatactatcaaaaacaaaaacagcagctagcacttagcattttctatgctacctactcttcttagcatttaatttgtatagttttacataacccacacaaaattttggaattatacctctactttgcagatgaaaaatgcaaacatgggaagttcttgcccagtgttctacaactctgaattggtagaaatgggatgtaaaccactgcagtctgattccagagtgcctactcttaagtaaatacgatgcagttaaaaacaggtagaagatagatatctatgtgttaatatggaaaaatctccaagaggaaaaataagggataaaatgtagtgaaaggtatgttctcttgtatgtttttgtatgtgcatataattatacatgaagtttatttgctgaataaaatcaccaaaaaaaaaaccaattacccagtttttgcattatatatgtgtgttgtttttatttagcaacatcaatagccattatatgggaaagccattatatagtagggaatagcctacttttattaacatctttgtagttttgtgaattaaaaaatatataaatattttaaagtaataaaagcaatgttaataatccatgatcagtaatttttaacctaacaattgttaaattcattgattcatatattaatttaataattcattcccttaacaaatatttattaaatacttaaccatacgacaattttctaggtcaggagttggcaagcttttcctgtaaaaggctaaatagcaaatattttagcctctgtaaatcctattgtcttggtcataactattcaactcagcctttgtagtgcaaatgcaccataggcaatatacagtaatgtgccacgtcatgaatgttcccggcaatgacggttcgcaaatgtgactgtgatccttcaagcttcatttatattaagtgcacatacaagtgtatcattttttaatcttttatactgtagttctatttttccatttgtttaattctatttagacacacaaacacttaccactgtgttacaattgcctgtagtattcagtacagtaagatgttatccaagtttgtagcttaggagcactaggctataccatctaagtttattaaaccctctatggtgtttgtatagtggtgaaattgactaaagagggatgcatttcttagaatgtttgctcatcattaagtgatgaaactttatttacaaaacttagcatcagatcatatttagcccatgagtcatagtcagctaactcctgttataggtgcttaaatttagtctgtctaggtgtctttagcctaaaaatacaataaatacatatacttatatagaaaacattctcatataatttatatatgcataggggacactgttccatggagggcaggtctatgcaacctacccccaagagtccaaggaagctgaaaggctgaagaaagaagctgacaaattcagtttcttggaaacatttaataaagacttacgaacagaagcaatcatctgtgtctcggtcagcagcaagacaagatgggggatgcctgtatcattattccttggatccagggcttatatactatagggaaagggtaaattagaaggtatgtgtaggacaactgaagcatgataacatcgaggtcgtttgtcctaagggcaggatttacagtcagtgcctattcttacacaagaaatgatagacaaactggaaatcttagaggtctttcttgaactagggttattcagaagtcaatatggtgaattagtatccaagatggagttgctttggcctacatacacacagacacacagacacacacacacacacacacacacacacacacacagagagaaacattaaaggaccaacaaagaagtatacctgactcaagtattaacaaaaatgcaggtgtaaaaattagaatgataaagaaattaataatattaatgcctatatattgcacaaataagttactacaacacaagaaattagagaagaaaacatgatgcagttttattctcagattttgcataaagaggggatggaaatgtaaagcaaattaattgctttctggattgacattaaaatgcatcaggaaaataggccattgctattttctgataagtacaagacatctcatatcaaaaccaagaagtgaattcttcactaaacaattatattgaagttgcttctggaatatttattttagttgcatacttcaatatcaaaagcatgcagaataaccctgcaagttcttcacagaccaacagtaaaaatagttaaaagacagaagatattaatattagttgatgaaatgataagcatgtaactaacaaataactgtatgatgataaagaaatttaaaactaaagagaaaagatccatttgtcagattacttaaaatgaatttaaataaaaatttaacatttttattttataaatcaatttccattagtaaaccctggatttgaaattaagccagaaaaaaatagttgaatatataacataagggtttactctggtagcaatggatgaatatatgtagctcaattttctttaacattaatcagtttacataataataaaggctaagttatatattatttccatgtgaatcattccataagcagacttgcttgatttctgaagcaaaaggaaaggaagttttagcagtttggagaatttttgtagttataaataaatggtgccctttttggataacctgattcttccacagatcaccacacttgaaggtgaaaaatgatgtgaaataagagatagagggataaaattctgaccagtgtacttttttatttctttcaagcaatgttgtaccccagtctgccatggttcactgcaaccaaattggttttctcttcttgcatcaatatccaaatcatggtttcctcagaaggcatacactaaccttctcattaatcctgtgaatgtcatcagtcaggatgttggtagctaacccaaaatgccttctcagaggaggtacattaagatttccagagtagaatttgttgcgattcataagaaatgctaaaaaatatgctcttaactagatgttctttttatgaattccctgtacatagtatatctttgaaaaatttagaaaaatatcccagtacctgaaaatcatttttgtgattaaatgatatgcctaaaactaaaaacatgtgaattgtacaaaaaggaaatatattaacatgtagtcttctaataagtaagttacatttaacaaaagttgagaagaaacagtaattggaaagggcaatagaaaaatcgccatcttaataaatataattaacacttaaataataacataaaaattggtaaaattttttaattaccatactgggactggagaacccaaactaatactcattttttatttattatgtaaaagaatatatcaatccattcttaaaatctaataaatgaaagccaaaaaatattagaattctcacttaaaaggtctgcttcattacagttgtttatgtattatgataatgaaatgattatacacatttttttatacctaggcccatgccaatatgttttttgagatctcaatacatcaagctcaagtaattaattcacacatataaagcctacttttattatgaaaattttaatcaaatctcttttttatattaaaactatattctaattaaacaaagttaagaatttaactcaggcagattcaaaacagccaactagctgtagccaggaagaacatctcccactaagagacctgaacatcaggaagactggtacactccaagcagatatttggaagaaaggcattaacagtcaacagagggaagacacaggtgctgggctgaagggcaaggaagctgggaacacaccatggggctactgtgcaccagaactcgtttttggccaccagtgactcctggggaatgggtgagttaaataggcaagatgatcccctctcaccatagaccactggaatcctggcagctggagaccccacaacccccaagggcacttgaggtggcagagagagctgcttagagaggtggtagggacaggactccagcctctgtagagcccagagtgtttgtggtgggagcgtcttcagtagagcattaccagggatgcccaaggcacatcatgctcctctaagagactttaaccacaagggactacctggacagaacagaacagtcttgcctttgaaacaaggccagtttgatctgagcactcccttgtttgctggccttccccagggtcccagcctggccacacctattgcagtgcagcctcagatgcccaactagggtgcttcccaggagtcctcatcatagctccttcactgggagattatgtctgaccatcagggaattccagcagagcagcccctgccgacaggcaccagcccacccccactcttctcccacagtagcctcctcatgctactttgccagcaagcacttgtccacagccaccccttccactgctttgccagtgtacatgggcagacgtcacctcccctccgacaatggtgtgcgtgtgtgcacatcctgcatgacactgatgctagcatcctggtgtcagcgcatcctgggtctcgcacacccaaccgcaattcttgcctagctatgccaccattgcacgtgagaatttgtacacggatgccaacaaccccacctccccatgccaacaccaccatcactgcatgggtgagcatggagttcagcagcccaacgcctgtcagcaccctgctgccactgtgggcatgagcacatgcagaaacactgcagccccagacccactgctacaccaccccagccaatgcccctgtaccccaccacactgtcactgatgctggaacgcatgaaggagcatggatcccactgacactgctctaaggaagcactttagcgagcactacacatcagagtgctgtggccagtggtacaagaacacctcagcccctcaaatgcagaaggttcacaaccttgaggggccagagaacaaaaccaggggctaggtaaccgccccccaagatttggagcatgtagcccagaaatgctgagccgagccatgatgccttaagttcttccagaaatgaagccagtcaactgaacccacaatcaaaactcccaaggacagcaaagaagataaaagcataaagccccatccaaaggccagcaacttcaaagactgaaggaacgtcagcccatacagatgagaaagaagcagcacaataactctggaaattcaaaaagccagtgtcttctaacctccaaaactgtactcgttccccagcaatggtttttaacaaggctgaaatggctgaaatgacagaaatagaattcagaataaggataggaatgaacttcatcaagattcagaagaaagtgaaaacccaattcaaggattctaaggaatacaataaaatgatgcaggagatgaaacacaaaataaccattttaagaaagaaccaaactgatctgatagagctgaaaaactcatgtcaagaatttcagaatataatccgaagtattaacagcagaatcagcaaagctgaggaaagaatctcagagctcgaagactggttctccacaatagccaaacaaaaataaagaaaaaagattaaagaagaaagaatgaaacctctggcaaatataggactaggtaaagagaccaaatctacatctcactggcatccctggaagagagggagagaaatcaagcaagttgaaaaacctacttcagaatattgttcatgaaaatttctccaacctcaccggaaaagccaacattcacattcaggaaatccagataagacttctgagaaactatacaaaatgaccatccccaacacacagattctccaagaatgaaattaaagaaaaatcattaaaggcagataaagagaaggggcaggtcaccatcaaagggaaccccatcaggttaacagaggacccttcagcagaaattctacaagccagaaaagattgggagcatatattcagtattcttaaaatgctcatcatcactggccttcagagaaatgcaaatcaaaaccacaaggagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcaaggatctagacctagaaataccatttgactcagcaatctcattactgggtatacacccaaaggattataaatcatgctgctataaagacacatgcacacatatgtttactgcagcactattcacaatagcaaagacttggaaccaacccaaatgtccaacaatgatagactggattaagaaaatgtggcacatatacaccatggaatactatgcagccataaaaaaggatgagttcatgtcctttgtagggacatggatgaagctggaaaccatcattctcagcgaactatcgcaaggacaaaaaacaaacaccacatgttctcactcataggtgggaattgaacaatgagaacacttggacacaggaaggggaacatcacacaccggggcctgtcatggggtagggggagaggggagggttagcattaggagatatacctaatgtaaatgatgagttaatgggtacagcacaccaacatgtcacatgtatacatatgtaacaaacctgcatgttgtgcacatgtaccctagaacttaaagtataataaaaataaaaaaacaaaaaaagaaaaaaaaagaaaaattccaaccaagaatttaatatccagccaaagtaagcctcataagcaaaggacaaaaaagatccttttcaagtaagcaaatgctaagggaatttgttaccaccagacctatcttacaagtggtcctgaaggaggtgctcagtataaaaatgaaagacaattacttgccaccacaaaaacacacttacgtacatagactattgacactataaagcaactacacaataaagtctgcataataactagctaacaacatgatcaccgaatcaaattcacatacatcaatattaaccttgaatgtaaatgggctaaatgccccaagtaaaaggcacagactggcaagttcaataaagaagcaaaaaccaacaatacgctttcttcaagagatccacctcacatgcaataacacacaaatgctcaaagtaaatatatgaagaaaaatctaccaagcaaacagaaaacagaaaaaaatcaggggttgctattctaatttcagatgaaacagacttcaaactaacaaagataaaaaaagaagggcattacacaatggtaaaggcttcaatttaacaagaagacctaactgtcctaaatatatttgcatccaatacaggagcaccagattaaaaagtaagttctttgagatgtaagaagagacttagatttccacccaataatagtagtattacactgacaccattagacagatcactgagacagaaaaaaataaattaaaaatatacaaagacatttggaacctgaacttgacacttgaccaagctacctaacagacatctactgaactctctacccaaaacaacagaatatactttcctctcatttgcacatagcacatattctaaaatggaccacataattggccataaaacaatcctcagtagattcaaaaaagccaaaatcataccacccacactctcagatcataacacaataaaaactgaaatagatagtaagaagattgctcaaaactatacaattgcaggaaaatgaaacaacctgctccagaatgacttttgaataaacaatgaaattaaggcagtaatcaaaatattgtttgaaactaatgagaaaaaaagataaaacataacagaacctctgggacatagctaaagcagagttaagagagaagtttaatagcactaactgccctcaccaaaaagtgagaaaaatctaaaattaacaacctaacattaaatttaaaggagctagagaaacaagagcaaacaaatccccaagctagcagaaaacaagaaataaccaaaatcagagctgaactgaaaaaaaaatgggacgagaaaccacacaaagatcaatacatccaagagtttgttttcatgaaagaataaataaaatggacagatgcccagctagactaagagaaaaacagagaaggtccaaataaacacaagaaaaaatgacaaaggagtcattaccaccatctgcacagaaatacaagaattctgagattactacgaacacctctatgcacaaaaattagaaaacttagaataatagataaattcctgtacacattcaacctcctgagaatgcgctaggaagaaactgaattcctgaacagaccaataatgagttgcaaaattgaatcagttataaaaatcctaccaatgaaaaaaagcccacaaccagatggattcacagccaaatcctaccagatgtataagaaagagctgataccattcctaccgaaactattccaaaaaattgaggagaatggactcctcactaactcattctacgaagccagcatcatcctgataccaaaacctggcagagattcaactaagaaagaaaacttttacccagtatccttcaacgaaactctagcaaagaaaatccagcagtgatcaaaaagctaatccaccaagattaagtagactttttccctgggatgcaaggttgtttcaatatatgcaaatcaataaatgtgatttattacataaacagaaataaaataaaaaaccacatgatcatctcactagatgcagaaaaggcttttgataaaattcaacatcccttcatgttaaaaactctcaacaaatgaggcattgaaacaacatacatcggaagtataagagccatctatgacaaacccacaacctacatcatactgaatgggcaaaaggtggtagcatttcccttgagaatcagaagaagacaatgatgcccactctcaccactcctgtccaaaatagtattggaaccctagccaaagaaaccaggtaagagaaagaaataaaaggcatccaaagagaagagaggaaatcaaactatctctggttgcagatgatatgattctatacctagaaaatcaatcatctctgtctgaaagccccttgatctgatttaaaaaaaaaaacttcagcagaatttcaagatacaaaaataatgtacaaaatcagtagcattctcatacaccaacaacatccaagctgagagtcaaatcaataatgcaatcccattcacaatagccacaaaaagaaacaaatacgtaggaatacagctaacagggaaggtgaaatatctctacagaaaaattacaaaagactgctaaaagaaatcagagatgaaacatacaaatggaaaaacagtccatgcttactgataggaagaatcaatattgttaaaacgacagtactgcccaaagcagtttatagattcaacactattccaaactaccaatgacattcttcacggaattagaaaaaaaaacattttaaaattcatatggaaccaaaaaagaaactaaatagccaaagcaatcctaagcaaaaacaagcaaacacacaacaacaacaacagcaaaaaccaaagctgcaggcttcacactacccaacttcaaactacactacaagactacagtagcccaaacagcatggtactggtaaaaaaaaaaaaaacagacatatagaacaatggaacagggtagagagcccaatatcaagctgcacacctacaaccctctgatctttgaagaagttgacaaaaacaagcaacgggaaaataattccctattcaataaatggtgctgggataactgactagccatatacagaagattgaaattggagcccttccttacaccatatagaaaagtcaactcaagatggattaaagccttaaatataaaacctaaatctataaaaaccctgagagataacctaataaataccattctggacatggaacctggcaaagatttcatgacaaagacaccaaaagcaactgcaacaacaacaacaaaaaaatgacaaatgggacctgattaaactaaagagcttctgccagcaaaagatttcaacagacaacctgcagaatgggagaaaatatttgcaagctatgcattctacaaaggtctaatatccagcatctataagtaacttaaacaattctacaagcaaaaaccaagtaaccccattgaaagtgggcagaggacccttatcaaaagaagacatatttgcggccagcaagcatatgaaaaaaacactcaacagcactgatcgttagagaaatgcaagtctaaaccaccatctcacaccagtcagagtgactattattaaaaagtcaaaaaataagagatgctggcaaggttgcagagaaaaggcagtgcttatacacctctggtgggaatggaaattagttaagcccttgtggaaagcagtgttttgtgattcctcaaagaacttagaacagaactaccatttgactcagcaatcccattattgggtatgttcccaaatgaatataaatcattctaccataaagacatatgcatacatatgttcatcacagcactattcacagtagcaagaatggaatcaacctaaatgcctatcaatggtagattggataaagaaaatgtggtacatataggccgggtgcggtggctcatgcctgtaatcccagcactttgggaggccgaggcgggcagatcatcaggtcaggagatcaagaccatcctgggtaacacggtgaaaccccgtctctactaaagaatacaaaaaattaccagggcgtggtggcgggcacccatagtcccagctactcgggaggctgaggcaggagaatggcgtgaacctcggaggtggagcttgcagtgagtggagatcgtgccactgaactccagcctgggtgacagtgtgagattctgtctcaaaaaaaaaaaaaagaaaagaaaagaaaaggaaaaaaaagaaaagaaaatgtggcacatatactccatgaaatactgcttagtcataggaagaaggagatcacgttctttgctgcaacatggatggagctggaggccattatcctaaatgaactaacacagacacagaaaaccaaatagtgcatgtcctcacttataaatggaagctaaacattgagtacacatggacacaaagggaaaaacaacaaatattaggacctacttgagggtggaaggttggtggagcgtgaggatcaaaaaactgtctatcagataatatgctttattacctgggttatgaaagaatctgtacaccaaacccctatgacacacaatttatctatgcaaaaatctgtacatgtgccccaaccctaaaataaaaattaaaaaataataatagcacatgtaaaaagaatttaattcaatgcaacaagtatttatcaaatcatttttcccttgtaccagaacatgctaggtgctagaatataaacatgtctaaaataaagtcctttcttcaaagggcttaaaataaaatactatgtataaaataagcatacatatagttacaaagcaaaaaccagaaaaaaggaaatgttttgaaagagttcaaataaatattgatctccaatgacgttaatgcctattttacattggcgagggctcataatggatttcataaaagaaacagcatttaaattgggctttgaagcttagattggatttttacagacctatgcagataatatttatctgtggatgacactgtgtgagcaaactaatgaggcagtgtctagaagatatagtcacacacagacacacacatacacacacaaaaaatagctatagcacaggctatgcatatgcatagtgggggaaagttcaaaaatagcgcaatagttttatatagaccgttaaagcctaaaatgagaaatttagacttagtttaaagagtaacagaaagtcagtcagtactttggggcacagctaatctgaatttccaggactgacaaatcctaggatttgtctacacataggattcataaattggaatgcagagaaattttagccaaagaggttattttggaggttattgaaataacctagcaaagtgaggatgactatcacatatcagaagaagaaatagaagggaaaagatgatgtgaaaaaatgtgatgaaagtgattgggataggagtgggatggatgagatgaagacaaaattgaccttaagattttttcatggtttcattattccaattgttgcaggaacttcaaaataatgtgccttcgtatttatttgtgcttttgtttttgcttgcttttccattaagtgtaccaggacattggcaggttccttcactccagagatgaatgcctttaagtcaagggagaatttttcatattgtctctttgttaaattccttattttatttgctcattctaaagcttatattagatatttagtatcccagacttcttctaatatgttaagcaaaaaaagaatcttatataagtatagattctacatattcttatcaaagtttttaaattgtgcttttcaagttatttcatctaaccagaattgatttttgcatatggcatgttgtaaaaatccaatttctttttttcccgtatgggtgattgaattttttgtggtataactctcaaagtccatctttttcccactgatctgtaagtgggacttatatttaagtctttaatccatcttgagctgatttttctatatggtgtaaggaagggctccatgtccctgtttcatatcaaggatccatatatgcatacatctgttttgaggaattctattccataggtctgatatctcactgattgaattactattgcactataaaatcttgtaatgtggtatggaaatttctccagaatgttcttccttaggagtgtgttatatattctttataattgcaaataaattttaaacaaacttgtcaagttcctcaagaaatccttagttactaaatttatagatcaagttgggagaattgaaacttgagaatcttcctactcatgaacatggcacatttttccatttattttggtcatttaaatatatgtttatacttcttttgttagatttatttctatgtaccccatattttgttgctatttacatagtaggttttaaataattttacatattctaattactaccaggatatagacatgcaattgcttttaatataatgatcttatgactgaagattgccaaaatctctcataaattttattatttgcccatagattattttactttttttctatgttgtcaacatcatcttcaaataatgtcagttgttgaacttattttttcattttatccatgtactatgtatctatcactaatgtttcccatatttcaccaaatctaatagctatcaattttatttttcaaaatctaaaatgcatctgatgaccttgtcagtcaaaggacagtttttgttctttaaaactccatccatcctcctgctccaatctgtatagacctattccataccaatctccacacacacttattttccctttttcttactgctcaagatagtgcctctattactttgttaagtagaagtaaaaatatcacgcatctttttctctttcttgaatttaaataaaatgcttctaacattataacattgaatacaatgtttactctatgtttttggatagatactcttaattacattaacaaaaattccttctaacactgatttcctaggaatttttattaaaaatgtatgttgagttttatgggacactttttgtcatggttttttggcatctactgagattattgcatgattttctcttatttcttctaacatattaatgcacaaatgtattttctaatcctccattatcttagtctgtacaaggattcattattttacgcctttattgcatagtaaaattttggaattgagagaagttaaagtgcacataatcaattggccatttttaaccagaaaatgtaaatcataaggatagaaaaaacaaaatagaaatacataacatcatctagacataaccaatgtagttctgttacatttctggctggtttatcaatttcaacagtttacattaaattagttttaaagcatgcttcaaagaatacaatcaacagaaaagatggcctatgaaatagaaacaaatatttgcaaataatatatctgataaggagtttgtgtccagaatatataaaaacttttaaaactcaactacaaaaaacaaacaaaccaatttaaaaaacaggcaaaaaacttaaataggtatttctccaaagaagatatacaaatatccaacaaacacacaaaaagatgctcaatattacatatcagggaaatacacatcaaaaccaaaatgagataccacctcacattcaacaggatggctactatcaaaaaaatagaaaacaacaaattttggcaagaatgtgtacaaattggaacagttgtacatggctgttgggaatgtagaatagtgtagctactatggtaaacagtatggctgttacttaaaaaattaaaaatagaattaccataagatcaagcaattatacttctgggtatatatccaaaagaattgaaagcagggtctcaaaaagatagctgtacctccacagtagcattattcaagatagctaaaatgtggaagcaacccaagtgctcatcaacacatgaatgggtaaacacaatgtgatatatctatatatatacacacacatatatatatcgttatatatataaaatgcaatattattcaggaaggaaattctgatacatgctaaatcatggatgaaccttgagggtctcatggtaagtaaaataagtcagtcacaaaaaggcaaatactgtatgatttcacttatgtgaagtacttagaatagtaaaattaatagagacagaaagtagaatggtgattgccacaagctggctgaagggagagatggtgagttgcttaatggatataaagtttcagttttgcaagatgaaaagagttctggagattggttgcacaaaaaatgtcaatgtacttaacattactaaaccactataaatggttaaaagggtaaattttatgttatatatattgcaccgcaattgaaaataaaagtgaaaattaatcttaaaatatactctccatttctgaaaactttatatgggaaaatcttttccatagttgaaaagacttagtcatgaaactcggaatctgggtatgcttttatattaatttttggactcagttttactctagggcagccctgtatttgaaatagtaatctagtaatccatattctagaaggatagcctcatatctttcaagtcatctgagttttagggagaaatttggaaaagggaagatgacatttcaaaaatattttatagtatatccacattgaattgaactgggaacgctttaataattggcatttaaaaaagaagcatatgtctaaacagacaattgaagagtgctccttgaaacaaaaaggagaaaagagatgtagtggcaccaacaatttaggtttctagtttccaatacctagttccaaggcacagtctgagcattctgtctcaaaacagatgtgatgttgaatgacaggatgcccctcttgagcaattatttgactgagagtcaaaatatcatctgaatgagtttaatcctcttagagttctcctctacccttctgctacccataagaaaagagcccaatctttaccggttctctctagtgtaaaagctcatatttcgttgactcatttttttctagaaaattcaaagaaataaggctttagaatgtgaagagagataaatttgttaataatacttgagaaatgaaatattttaatggccaggtctggctgccaaaaaggctgcttctgatttatcttacattctaaaccaaacatactaagtatctgagcataatcatatttaatatgcctttcccttctccatttcaaaggcaagataatctgtctagtattctttaagaaatactacagacagcaaatatcttctccttttccctcgtcttcttaaggaaaagtaaataaaatagaactttagaatatatccttatactctctaaaaaataaaccaaagcttctcccattggcctaagacgctgtattaacctttaaactgccttcagtaacggaaaataacccattaaagaacaatgcttaattctatcatgtatgcatttacttagtttgacagttatacccatttgcttcttttctttcttgataaaaagaaacgacattcagctctacactgtatttcattacctttttagcttttacaagcatagggatgtgaacttctatatcaaatatacttttctaaagaaaagaatttccaaaatcataggaaacttcccaaactagtgaaaaatttacataaagtacttcaatatacaatatacttagtagtgctgaaagcatttagagtttaaaatatgctttcatgcatttgaaacacacactatctctatgaaacatttaagaaggaaatatcagaagcctaaaaagtttgtgctagttgtctaaaattgcaaaaatatgaatagatagatttgggactaagatccagttcatggttttaagacctgcactttgaatattgaataaaatatgttgccacttattattaatatcattttaacaattaaattaataattgagaaatgactgtgacttggaagttttgcatagaggtattgtgttttaacagtaagttgttgatgctaataggaaattaataacaatatatgtaaatatactagaatcattatgattcctatactgtaatcaggttgtatttataaacttagagagtttcaatacctatcagacaatttagacatttttcaaagccaaatcagggatttcaataatatttgcattaatacaaaaaaaagaaaaaaaaaatctgtgtttagaaacaaagaacaaacccactacaagttcctcagtctcatctcaaaacgttccacaaaaaaaattatttaaaaaactagttcaaagccatggcaatttaattgctgtgagttttataggtgtcataaagcctcctgctatggaatttttagatctaatttttattcctagataagaactgaaaaacaaactacttcaaagcagcagctcagctctattcaccttctttagaatgatttgaaatgatttaggacctttcaaaatacaggatgctgatgatgcctatttttaaatgtgtgcttttcccatcacgtggggcattttgtgattttattgcatgacctttggctgcatcattgtatgtgttcttaagcatagcaatgctcgttaaaatgaacactattttctaaataaagactctgttaaatattcctatttttaagtaagttttgtttattttattttagactttaactggtttccttactgaatatgactataaccatgagactttaagaggcctgctgtcctgtgaatacatattttctgcaaatcctataagtggtactctctatcagtgagctgcattgtaccaaaaatacagaaagtgtaaaaatattttattggaaaaaacaaatatatatagagagagagatagatcaagttcagagatacatataaattctgtgtacattttctctgagatgtgcttcaacaagaaaactaattaaatgtaatacaagtttgagtcattcactggctgtttttatttctagcatagcaatttttgtgaaagatattctttaaaaatcacaatgtgttattttgtatatattgtaattatttttattgagtccaaatgaattgttaatgatggtgattatttagctttaagactctttatgctattttgtcttttacctctaaacatatgtgtttttaagtacttccattttaccatctttcttgttatgtaaaaaatgcctataattctataaatacaatttacaaagatagtgctaagagaaatgaaaaacagttggacatattttaaattaaatttcaaatgtactggcacttataggctaaaattcatatcagatgtactgacatggaactacagttatctccattctacatgataaaagaataggaataaaactaagatataattataacttaaaaattttggaaatacttctggttttccttcaaacagaaagaaaccttcaataaataacttcattgagattttccttttaaaaaggtattgattttgcccacaatttgatatacattattttaaaattttgtattactgcaataatagcagcagccacaataaaaatggtaaaatcagctgctgctgctgctgctacagaatccaatgcctcagaatattttatctcagctgtgtttcctctctctctctccctctctttttctctgcaactgtttctctcaatttctctctctttcattaggatcccagacttatataaggagcggatcttcctgggaccatcttgtagatgtaaggaatttacaagaacattgttgaagaacttgttccataactcttggattcaccacccaaatcaaagacagtaaaaggcatcacagagggtggaagaaaatattggttaaaagaactatcactgttctataaatccctcactccatccatttagagaaaggttaggggtctatccttttaacaagtctagaaaggagccttaggaaaatgacttacaggttttggaaatacattgcccgaactaactagatgcctagataggatattgggattggcatgtactgccagaccttgaagactagaaatgcacaagtttttctcataaatcaaatatgtgtcagaagagatggaaaaccgtaatagaattgtgttgactgttgtctaatacagccatctagagtggcaagtggacatcagcagaaagaggctagatgttacccagttgctgcagaggagaataaataggtatctgcctgggtcatgaaaatagaggtttaggaaagagcccctagaccccacacaagtacacatgaggttcagttttatacacctgtcagcccagagggcttaaagccaactaattattcaatacacgtgggaactattctcttttccctgtccatacttcccatccctataaagtccaaaccacagctaaaaggtggggggaaaggaggcaaggagaagctcaagttaaaggaaaagagatagcaactacacaatatcctcttcacactgctggagaaaggaaggaaaaacaagtgcagtcgagtcagtttcacagttttgggattataaatgggactggaacattttaatctctctttggaggcttgtttcaggacaaactgactacattgtaacatggcctgttttctaaaggtgggcagaaaattcatgggctagtacttgccattgtattactaataatgtagcataaaattgaaggtgcctaactgattaaaaaaaaatttggccatcacattgtaatgctcagaggaatgaacagtggcacaggtataagtgagctgagcccgtgtgaagagaagggaggaatcgctgcatccttgctgtacatttgctgctgtgcacgtgtctttcttgcctacctttggttttcttcggttgtgttcaaagtatcttctggagtcaacagtgtcctgtattttaaagtgcctaaaatgttgaaatgtaaacagggtaaagcaactttccctcggctttacaaaagctgtaattgagaacactgaccagagtgggctgggactttaaggagtctgtttttcagaaaattaagcaggagagatatatgtgatgtttcactctcagttttgtatttaaaatcttcatttaaaatgctaagctgcaatatcattcattttgagccaggaaaaagaaaaattgtattgcccttttatctaggcattcctgcagaaatgtattttttaaatatgtgttctaaaaggttttttatgctgcattactgctttggcatgtcgctctcatgaatttcagtgtaccagattctcagctccctgaaatgtggagacaacaaactctagaattacagcaaggtatattccatgagcacaacactgcatcatgaacatttttaatggtatggattttataccatctgtttaggtttgcaaatatgaaatgattacattttaaaataagcatttttttatccttaattctatatgtttacaaatatattttaactaaatttcaaaacaaagttttaatacctaaaaaacttacagaactttttgagtttttaatctagaggcaagggaatattgttgctgattaagtttaaacggacagtaaaagacaaaaatccacacattgtgctttcttagcatgttagctacatgtatatcttcttagtttacctactccggtagtggaagtagatagtattcccactatgtgaaatagaaagttcccagtgtggtgtctcacagaaccttcccaagtcatttggtcatccctactttaatcattctggccaagggattgtagttctctgaccaagcatagatcatttccctattcaggagaagagattctgctgtcataagaaaggaggaagaggtagaagacagaaatagcaaatgtccattaaggtaagtatcatcataacatcctgagcatatcagtgagaaactagaggctcaaaagaaccacagttcacagatgaaaggaagaactttattgtatgcagctttatgatctctcttgtccatggaatctgtctaatggggatgtttgtaatgccctataaaaagtgcttctaataaaattacttataatttccatatatttcgaaattaaaattaaatttttctcttcaagggatctctaaaaatttagaggatcacaaatataattcagattaaatcatgtaagaatttatatttgaattaatgttacgtacatgttgaattcatttcaaattcaaacgtctgtccctaagtgggtttatattaaagatcatatatacatttttatcttgatttatcatcagtaaaaactgagcaaaaatgtatatgtatatatatattatatgtgtatttttgatgttatacatgtgtatacacatataacatcatataataggaccatttacagttcactaagcaaatcttccattgaaaaaagataattttcctgagaaggttcaggcttaaatgctggctagctaggaagtcctaattttgcttcctcaatttttccatagaaagatattaaaaattaagaaagaaaataaaaccaacaaagcagtgaaaattaggatgagtggccaggcatctgtctgatttcaaagggagtgtctgataattaaagcttacatgtagccactaagtggaatcctttagaaagaaggaaataaattatgtcaatcaaatcttaatgcatattcttacctcagagacatggaactatcactaagtaaagtaaacaattcattgctttaatgagtaacaacagtgttctgtgcaactcaaagccattctctgttgaccaccattactacaattgagactacaaaaccaataattaacagggctcaaaacagaattgtactggacataacaaattactagaaagaagccagtagcagagggaaataaaggcaagagtagccatgggaagagtgcacactttctaggctatagttttcatgattacttcaaattatccaaaattaattccaatctacacagtcacatagctgatcaggaagtgaaagcaggagatccggcaccagtccagcacatctcactaaagtaatgactaagtagcagagccttttagtttcagatcaggcaggaacattgtaatgaccaccggatattagtgaggcagagcaagtaagatcaatatacttgatgactggcaaatacgactatttccattaaacagtaggaacaaaaacaataacatgccagttataatataaatgaaggaaaatagtgcaactgcgttgtgagaataaaaatattcttattgagtaactggaactacagtaaaataaaagtaaattttagaaaacacataggtgaaatatttttccattcataatataatactatttataagtatccactaagatattttaaaatttgaattaaaatattttctgggaaaaaatcaattctcagataaaatgtaaacatttatgaagaatttttttaatgtcatagaatttctgccttcacaaggcttttatcacataagaatttcaaacgtgtgtttttaatctttcaaataacagataaagtacaaacttaacaaattcattcattctgtgttacctactaggtgctgataggctgctaggcactaataataaagtggtggtcaagaaaaccatgatccctaacctcatggaaattgcaaatctagtatgtggagagatcacagattcagagcacagaaaacaaaacaaggaagccagatgatggtaacacacacacaaaaaaacagataaaactcacctatgaacagagatgctaatttgggaaataaaaattccagtaaacaatatctaggcttttataataaaagactataccaaaagcaagtttggtttattccaatattaaagttgtggtataatattaaaaaatatattacatttaggccaaccatgtgtttagctaagaagtaaaatagatttaggaaagctaaatatgcaaaagcaatgactagaattagctagaatttgcagaaaataaggtgtcaaaagtaataatgtaagaactgagcatttaaaaatatagaataaatagatctaacatagcctacaataaaggtgacatgaatcagtggggaaaatatgagtaaataatcagttatgagactattaattatttattaccaaaaagaaaattaattacctcacagtacaaaataaaataaatttcatatggattatagttacatgcaaaaaaagtataatattaaaaagaggagaaaatgtaaatgaatatgtattgaatttcaggttatgaaaggtctttgtaagaacaaaagtagaagaagcactcacagagagaaagagtgaatctctgaaattatgtaaatcatatattacaaatcaatataaaattcaagtaagttataaaatatttgcaaaacataagattacaaatgttttaatctgcttaatatatctgaaggtctttaaaaatcaagaaaagaatttaataattgaaaaatggcactaatacatgactagacatttcacatacaaaaaaaataaaattggttaataaatatttaagaatggcatcattatttatcccataataccacacacttaaacaagatacattttcttgttgtaaaatgtgtaaaatggcaaaaaaaaaaacaaaaaaaaacacaacatgcacacaaaggaaaacagaattgtcaacattgtggattttgtgaaacagaaggattcatttactgctggccagaaggaatcagtataaccattctagaaaataattcagcaaaaaaaagaaaacaaattggcaatgtatgtaaattacactataaatactcagacgattgaccctataatcctcttgcaaataggtgtaccaaagtaaacagttctaaatctttggtgtcctctctcttcagcttgtagaggggaacagaacgatgaacatatatgggaagtttcaatggccttagtgtaaaactggcattttattacctctgaccatactgtggccagaaggcagtcatgtagtctcacttacaaaggaggctggggaatatagcccaggcgtgtgcccagaaaaaggatcagacagattttagttaagacagaggaaaatctgccacaccacggatctcaattataagtagtcaagtgtagatagtgtaaatgcaaatatacttaactacactacagcataaataaaacaaaaaataatgagggagcagtactccaaagtaataataaatgatgtcatgagccttaggacaatgagttatttcaactatttatataatgataattaaaaatatattttataataataatccatactgagaaaagtttaccaagccaattttaataaacatttattttttaataactttaaattcacataaaaattgcaaaaatagtacacagttcctgtgtttgatctattacttctcctaatgttaacatcttacataccatttaccaaaactaaaaagttaacattggtacatcactatggattaaactccagaattttctttttcaacagtttttccactaatgtcctcttcctttttaaggatctaatccagaatataacagtgcagttagtcaagtttctttagtttcatctggtctgtcatagttcctcagtctttccttatcatgaccttggcagtattgaagagtactggtcaggtgttttgcagaatgtccttcagtgtgtgattgcgtgattgtgtgatgttcttataattaaactggggttatgggttttgaggaagaataataaaaaggtgaaatgcccttattatcacactgtataagaaagtacatgataactttattctttggaagtgagccactgtctagtcatcacccgtgtgtgtgtgtgtgtgtgtgtgtgtgtgtgtgtgtgtgtgtgtatgcacgtgcgtgtgtgtgtattagggaatggggggcatggtttacattccatctcctggaggtggaagtttctatatagaatatttaaatttttctctattgacaatttatctcttctgcttcatttgttaaatcattaatttgtgtcagtctgaactgatgtatatttatttcatattatggattatactccagtacaatacaaaaatataatctatattattatttattgctcaagtttctccagttttgaccatttagatgcttctatccttttgaggtttttttctaccactttcttattttctggcactatgtaagatgctctagattcatgttgtattgcccaagtcctagaatcaataattttcccaatgagctctggcttattttattaaaaaatggtatttagaaaataagatctgggtcaagcctagcttcatctacagctacaactaataatggcttattgttcattatggtgaaataaaatataacatcaatgacaattagttcaaatgaatgtgtattatgtgtatatacttgtataccaggggatttcaaaaagttcatggaaaaagggaatcaaaagataaaaataaaaaatataaaattcatttattaatatgagttccataaagttaaactcactttttaaagtgataataccagccatttaggccatccctaaagaactgagggtcctgtgaatttaaccatgtcattgcagtattctctacattattagctgaagaaaaatatgtgccctctaaagagattttttttttttttaagattaggaaacaaaaagaagtcaaaggagccaaatcaggactataaagtgaatggctaaggattttccatagaaattcttgcagaaggaatgagcaggagcattgtcatggtagagaagactctctggtgaagctttcccagtaatttttctgctagagctttggctaactttctcgaaacactctcatattacacagatgttatcagtctttggccctgcagaaagtcaacaagcaaaatgccttgagcatcccaaaaaactgttgccatgctcttcactcttgaccagttatccacttttgctttgactggaccacttctacctctccatagtcatcactttgtgctttaccttcaagatcatactggtaaagtcatgtttcatctcctgttacaattattcaaagaaatgcttcagaatcctacttgttgaaaattttcactgaaagctctgcttttgtctgcagctgattagggtccaacagttttgatacccataacatggaaagtttttgctcaactttaatgtttcagtcagacttgtgtaagctaaacgaattgaaatgtctatggtgttggctattgttcctgctgttgtcagtccttttcagttagggtacaaataaggtgaacttttttccttgcaaattgatgtgaatactctgccactacagttttcaacttcaacataatcttgttccttcttaaaaggagttctccatttgtaaactgtggatttctttgggggcactgtccccattaaccttttgtgaagcattaatggtttcaccattcttccactcaagcatcgccataaatgtgatgtttgttcttgcttcaattttagcagaatgcatgttgctttgaaagggtctctttttaaactgatgacttatcttttttaatgcctcaaactagatcttgttcagacatattaaaacaagttagcatgaatttatttgaatgtatttttttaaagatccatgcatagttttttcaaaatacacatttttcatgaactttttgaaaacccctcatatgtagagaattaatctttgatttgacaatatattggcatttttgatataataaaatttttcatttactaatctttcccattcactgttttaatgatagtaattttaaaaattttttagagacgaaatcttgctgtattgctcaggctggccttgaactcctagcctcatgagatcctcccatattggcctcctaagtagcgaggatgactactgcatctggcttaatcatagtatttttaaaatcccaaaacttaccatggtacatgatatgatagatacaatatataatgtatatttttaccgatatatcaattgtttgtggccagatattgcagaaatgttggaatggttcatgaatttcattatacaatgaaaagctgtgtaccattgagcagaccaaaaataaaagatagtggctcacttctctaatcccaacactgggaggccgagacaggtgatcacttaaggtcaggagttcaagaccagcctggctaacatggcgaaacccgatctctactgaaaatacaaaaaattagccaggtgtggtggcacacacctgtaatcccagttactcaggaggctgaggtagaagaatcacttgaacctgggaagtaaaggttgcagtaagctgagatcacgccactgtactccagcctgggtgacagagcaagactctgtctcaaaaaaaaaaaatacatataaatatatatatatatatatatatatatatatatatatatgtatgtatatttaatagtaagacaaaataaagccatgttaagtgcagttttcatggaaggtgatataaagatgagatcatttggaaaaccatagagaaatatgaaggttcctaaagaagtcatgatgattaaaatatccaatgttttgtttttggaaatattccatattatttcctaaatgcttttagtgagatcaagaagaaaaaatattaagcaatgtaaccttaattagcaaggaaagaatgggatcaatacttcctgtctaacttttcatttctttcctaccaaggtttcaacttttatacttcaattttcataggcaaagtagcactagaactgtaactattcacaacagattttgaaaaataacatgattttgtatctatctagaaacagaaggctttagagtttcattttcattgtaacattctcttggagactaggatatcacttttattttagtattgcttttatctttttctatttggcattattggtttgtttctactccatttatgctggaactcagaattgcatgataactgattatttaatttgttgtttgtcaaaaacatcactagtgatgatgtcagtatggcttggttaactttggctcaactatatgttacatctaaatttcctctccccaaaaagacttgaaatttgtacaataatggaggttacattttagtgaattatttcttaacaaaatttaaccaatgtatgccaatgtatatgtgccctctaaagacccttaccagattataaaataagcaagaggtaaaaatgattttgttttcaggaagaaagggggcatattattttaaattcatgaagtttaaaaacataaatacaattaatctatcctatcaaattttctcaaattctaaaaatgcatgccactgtatattgtcccagtatgttagtttataaagctaactaaccaaattagtctatatttgtttctcttgtagcagaaaatgaaggctagaaagaattaggtaaaatgtggacacttaactatataatttaaagtgtgtgtgtgtgtgtgtgtatgtaaatctaaactgttgttcatgaaggcaaggatttctgtctgttttgtttaaagctgtatacccaatatctggcattaattaagtgcacacattaataaataacaagcagaaaaaagtgtcatcaaccccattacaagcctaaaaaaaaggtacatattttattgttgggattcaattttctgaattcttgtaagaaaaatactagctctcagattggaaatgttttattctgtggccaagtttaaggttcagaattagaatcaattacatttccctaatatttaaaaggaactatatttgccgggaagtacacaggaactttcccacttttctggaagatccacttgcattgcaaacactttttaagattttatgctttggtggcgttagtaggtttgacagagattcaagggttaagcagagacaactcccagaaccaaaatattttttgcactccctctcttttttctcactaagtgaagaaccagacagaataaggatatgctagtaagatacacagactattcctttcccttttctgagcaatggaactttctttaagtgaaaaagaaagtgatacactagcaagttggcccaggaaagaaatgtgagttagataccagcaccggatatagtccagatagtgttaagaaagagtgccagaataatagagggagatacatatgctagaaactgggaaaccctatactacattatgatgatatacatcatagtctttaagaatagtggttagataggtctctattattattcagttttgttgaatcagcattgatggcagttaatctttattgtaaaagtctagacttatcaaccaaagtaagtaaccctaaggaacttcagcagaatatattttccaaagagcatccaacatgctcttctgcaatatgaacttgtcaatcctccactgagttggagtttaacttccctgccattgaatctagggtggctttcttggcctgtcttactgatagaatgttgcagacaagatattttgggacttccagagctaagctgtaaaaaatctacagcttctgcctgggtctcttagaatgcgcctttttgggaagcttcctctggtaacccagttgctatgttgtgagaagccagcatcaacttccagtcatgaaagtgatccttcttgactctgtcaagtctttagattatatcagctgcagctcacatcttattgcaacacagtaggaaattccaacttcccaactgaacccagtcaactcccagaatcatgggaaattaaaaaaaaatgttttaagccacaaaacatttgagttgttaaatatatagcagtaggtaatagatatggaaatacagtgcttttaacacatcatgaatataaaatagatcagaaaatgacaaaccttgaataaatgagtacttttatggttctagcttgttcagaaaatagctcatccataacattttaatatcatctgaagagtgacctgtgtataaatacatgatgcactgtgtttctcaatataatgctgttttcttgttaatcaagacttctcattcactacaaggagtttacttgctaggttcaatttgaggactcatgctgtggtgtctgttttgctgtgtattttattctcttttgttgttaggtaagtagaacagcagcaatagcacccattactagtaagccttttattgttatgagttgttacttgacattcatcaacagagtggtgttagatataagtggggtgtaaatttctatcttcatacatatgagagatacataacatagctcaatgatttattactaagtaacttacaaacatcagttcaaaagtgacatataatttggcacaggacctaactagggagttatttgttcttgttttcttatttcctaggctgattacagatgctccttctcatttcccctaaaactacatataccccttctattaaggataaaacagtaagtgctgaagatcatctgaaaagctgtttttgcataaatgtcaaagtatccctattcaaatagtggtcaatggttggaataaaagaaaaaatttaaaggttgtgtgtgtgtgtatgtgtgtgtgtgtgtatatctatatgtgtatttaatgcctattatctgattatctcaaaattcaaatgaaaacctcattttgtccaagagaaaatataaaaaagcagtacctggacactactttcatgttctatctggaagctttatcatggtaacctgctcaacttcataagcttatgcaaacctaaatatgggttttaaatttttgaaacattaactagagaactattatatgttttgatttgagggctgataggaagataatattttgacatgattccagtgttttttttttttttctcacctctgggcacctctagggccttcccatatgctgtttctctgataaaaacaattgtaccctgttatctttttcctaacacacaaaatgcaccccatgccctccactcaacacatataatttccagattaaacatttctccttcagaagccgtctgttagtcattccaagaagcttcgaataccccttgaagttcttctctcttgcccttcctaagtactactaaagtgccttgtgcttttcacatcagagtcttcatcacattattataatttctttttctatttttttttttttttttgagacagagtctcgctctctctctcagtttggagtgcagtggcgcaatctcggctcactgcaagctccacctcccgggttcacgccattctcctgcctcagcttcccgagtagctgggactacaggcacccaccatcatgcctggctaattttttgtattttttagtagagacggggtttcaccgtgtaagccaggatggtctcgatctcctgaccttgtgatctgcctgcctcggcctcccaaagtgctgggattacaggcgtgagccactgcacccagccacattattataatttcttattcacatactatttcacccactagacttcaagcttcttaaaggtaggttccgaaataacattatcaatgcttaggataataactggcatgtaacaaagtcttaataaatatttttgaaagagttataaaagttgcaggaaaattcccttctttgtgatattttggttggtttttcaaagaaattatttttgagcactaatctataattatgtagtgctttaaaaacttaatgagtgagaaaacacaaggcctcaatattttgatttcacattatatttccacaaagattctccctatttagttggctcagtttgagacttgaagaatgtttttttcaaatcaagggtggctggtctaatttcagataaaggggactttaaacaaacaaagatcacaagagaaagaagggcaacacatatcggtaaagagttcaattcaataagaggacctaagtatcctaaatgtatatgcacccaacataggagtacccagattcataaagcaaggtcttaggcacttatgaagagacttagattttcaaacagtaacagtgggagacttcaacaccctcctgacaatattagacagatcatcaaggcagaaaattaccaaggatattcaggacttgaactcaacgatagacataattgacatacagaactcttcacccaacaataacagaatatacattctctcatcaccacatggcacataatcaaaaattgaccacacaattggacataaaacaatcctcaacaaatttaaaaaaaacctaaaatcatactgagcatactcatagaccacagtgtaataaaaatggaaatcaatagtaagaaaattgctcaaaactatataattacatggactttacacaacctgctcctgaatgaccgagggtggggagagtaataaaatcaagacagaaatccagaaactctttgaaattaatgagaacaaagatacaacataccagaatctctgggacacgctaaggcaatgttaagagcacaatttattatagtactgaattcccacatcaaaaagatacaaagatctaaaattaacaatctaacatcacaactagaggaactagagacacaagagcaaataaaccccaaaactagcagaggacaagaaataactaaaatcagaactgaactgaaagaaattgagatgtaataaaacataaaaagattaatgaatccagagttggtagtttgaaaacattactaagattgacagaccactagctagactaataaagagaagattcaaataaatgcaatcagaaatgacaaaggagatgttatcactgaccccacagacatacaagaacgctgagacattactattaatacttctacgtacacaaattagaaaactagagaaaattgataaattcctggacacatacaacctaccaagactaaacaaaaaagaaactgaatccttgaacagaccaacagtgagttccaaatttaaatcagtaataaaaagcctaccagtgaaaagaagctcagggccaaacagattcacagccaaattctactaatgtataaagaagagctggtatcattcctgctaaaacaatgccaaaaatttaagaaggagggactcctctctaactcattctatgaggacagcattatccttatacccaggcctggtagccacacaacaaaaaacgaaagcttcaggccaatatctttgatgaacatacatgcaaaaaccttcaacaaaatactagcaaactaaacccaccagtgcatcaaaaaactaatccaccatatcaagtaggctttatccttgggatgcaaatttggttcagcacatgcaaatcaagaaatgtaattcattacataaatagaactttaaaagaccacatgattatttatctcaatagaggcagaaaacagttacaatagaattcaatatcgcttcatatcgaacatctcaacaaattaggcactgaaggaacatatttcaaaataataagagccacctatgacaaactcacagccaacatcatactaagtgggcaaaagctagaagcattccccttgaatactggaacaagacaaggatgttatttctcaccattcctattcaacatagtactctaagtcctagcaagagcaatcaggcaagagaaagaaataaaaggcatccaaataggaagagaggaagtcaaaccacccttgtttaccaatgatatgactctatacctagaaaaccccatagtctctgcccaaaagtttcttgattagataaacaaattcagcagtttcaggatacaaaatcagtgtaaaaaaacagcattcctatacacaacatataagctgacagccaaatcaagaatgtaatcccattcacaatagtcacaaaagaataaaatatctaggaatacagctaacaagggagttgaaagatcagtacaacaagaattacaaaacactgcacaaagaaatcagaaatggcacaaataaatggaaaaacattccatgctcagataggaagcatcaataatgttcaaatggccataccacccaaaggaatttacagactcaatgctattcctaccaaactaccaatgacattgtttacagaattttttaaaaaaaactatcttaaaatttgtatgggaccataaaagagccccaaaagccaaagtaatcctaagccaaaagaataaacctggtggcatcacattacctgacttcaaactacaatacaagcctatagtaatcaaaacagcacaatactggtacaaaaccagacacatagacaaatggaacagattagagagctcagaaataatgccacacacctacaaccatctaatcttcaacaaagttgacaaaaacaagcaatagagaaaggactccgtattcaacaaatggtgctggaataactggctagccctatgcaggttaaaactggaccctttcatacagcatatacaaaactcaactcaagatagattaaagacttaaaagtaaagcctaaaactataaaaactctggaaaataacctaggaaatatgctttggacataggacctggcaaagatttcatgatgaagacaccaaaaacaattgtgacaaaaataaaaacagataaatgggacctaattaaactaaagagcttctgcacagcaaaataatctatggacaacatgaaaaaaacaacctacagaatggaagaatatatctgcaaactatgcatctgacaaagttctaatattcagactctataagaaccataaatttacaacagaaaaaaaattaaaaagtgggcaaaggtcatgaacatacacttttcaaaggaagacatacatgtggccaacaagcatatgaaaaaaatgcttaatatcactaatcattaaagaaatgcaaatcataaacacatctcacaccagtcagagtggctattattaaaaagtcaaaaaataaccagcgctggagaggtagtggagaaaaaatttttaaaaaatttcactttattttaagttgcaggatacatgtgcatgatgtgcaggtttgttacataggtaaaaatgtgccatagtggtttgctgtgcttatcaacctatcgcctaggtattaagcccagcatgcataggttattttcctgatgctcttcctcccccgacacccccactgacagtccccagtgtgtgtttttcccctccctgtatccatttttcctcattgtttggctcccccttataagtaagaacttgaagtgtttggttttctgtttctgcattagtttgctgaggataatggcttccggctccatccatgtccttgcaaaggacataatctcattcctttttatggctgcatagtattccatggtatatatgtaccacattttctttatccagtctatcattgatgggcatttgggttgattccatgtctttgatactgtgaatagtggtgcagtgaacgtatatgtagaagaatctttgtaatagaatgatttatattcctttgggtgtatacccagtaataggattgcttggccaaatggtatttctggttctaggtctttgaaggagtcaccacactgtcttctacaatggttgaactaatttacattcacacccacaatgtgaaagcattcctatttcgccatagccttggcagtatctgttgtttcctgactttttaataattgccattctgatctcattgtggtttttatttgcatttctctaatgatcactgatgttgagatttttttcatatgtgtgttggccgcataaatgtcttcttttgagaagtatctgttcatgtcttttgcccactatttaatggggttgttcgttttgttcttgtaaatttgtttaagttcctcgtaaattctggatattagacctctgtcaggtggataggttgcaaaaaatttctcccattctgtaggttgtctgttcacttcatagtttcttttgctgtgcaaaatctctttagtttaattatatcccatttgtcaatttttgtttttgttgcaattgcttttgacatattcatcctgaaatctttgcacgtgccaatgtcctgaatggtattgctgaaattgtcttctagggcttttatagttttggatgttccatttaagtctttaatccatcttgagttaatttttgtataaagtgtaaggaaaaggtccagtttcaattttctgtatatggctagccagttctcccagcaccgtttattaaatagggaatccttcccccattgtttgtttttgtcagatttgtcaaagatcagataattaaggttgaatgaggtcatgatcctaatccaacaggactggtgcctttataagaaaaggaaagaaaaggccatgtttgaatgtaggtggccatatggaaagcagaaatagagccttcaccagaatctgaactggaaagaacgtggatcttggacttctagccttcagtactgtgagaaaacaaatttctattgtttaaaccatgtagtctgagatattttgtaatggtagcccaaacagactaatgtaatagacatcttagaaaattcagctttatgtttttcaatacggaaaaacatttataatgctggcagatatacttgaatgaatttggctgcaataaacagggctttataataattaaagtaaatgcattttggaggtatatagatgcaaactggcctcttccaatctctctctgttgcccaggctggagtgcagtggcacaatctcggcccatgcaacctctgcttcctgggttcaagcaattcttctgcctcagcctcccgagtagctgggactacaggtgtgcaccaccacacccagctaatttttgtattttctttttagtagagacagggtttcaccatattggtcaggctggtcttgaactcctgacctcgggatccgcctgcctcagcctcttgaagtgttgagattacaggtgtgagccaccatgcttggccgcctcttcctttcttattgggcacaaggctgtgactgtatttctcagtctatctgataaataaatatggtccatgtgtctatgctctctccagtgaaatatgaatgacacaaatgggtgcaaggaagaatctctaactaaggatttcttctcttctttcctatagctggagtggagatgactagagtgataaccactgtgattccatgaaccaagcctcccaccagcctgaaacattagcttttaagccatttgtggacatccattagatactgttatccaaattctggtccacagatattactgatcccaggtcaaatgatgattttataatacttggaaagtgacttatcacctacagttgagcttcttaaagttggatggcaaattatccataactgctgtgaaaagttaacatttacttacacggtctgaagttatcatatgggcaaagtagtcatcttcaagtacacaatttacatgaaatcccataaatgttattcactctataacatatttacatgtgtcttaatataaaataatatttttatttattgtcaagaaaaatatcataaactctctttttccagaaatccttgagtacattgacccagatataccataatgaccctggccatatgtagctgtaatattgatttacttgcagtccccagtatacacaatgctctttcagactttacactttctttcctttcctgaaatatattcttcttctctattggtaaacacctacttattcttcaaggctcaaattattatctcctttatggagtcttccttaactaactcctgtttccacctaaacataattagcgtcttcaacctcttggtacacttcacccctttgtacacacatctgctatatcataagttggtaattagtcttctttttaagtacacttctccccagggcaaagtctgtctcactcatttcggaatttgaaatattccaaaatattctagtatttatggggagtctcaatattttcaaatatatgtagatattttaaccaaatatattggatttttcctcctccttctcttcctccttttcttcttttgcttatcctcctcttccattttcatttttagataattttaatgtctttccatatacttttacttataattcttgtgttagatttatttctatgtaccgcatattttttgctatttacatagtagcttttaagtaattttacattgcctaatcactactgggatatagaaatgcaattgctttttatataaagatcttatgactacaggttggcaaaatttcttacacattttattgtctataggttccttttttctatgttgtcgacatcatcttcaaataataccagttgttgacttattctttcattttattaattttctatgttctatcactaatgtttctcacatgctctaccaaatccaacatctaccaatattgtttttcaaatactaaaatgcatctgataaccttgttagtcacagtttttgttctttaaaatgccacctgtccttctcttccaatctttattaagttataaagaaagttttaaaaaacagatatctggtaaattgaagagtccgtatttggagaatttaagaacatttaaaggcattccctactcagtcaaaacagataaaagatcactgatcttctaagacttaatatttgcatcaccttgagattcattgcctagtgctgctcaatatggaattctaaaaatataaaaaatatttattttagtaaagcattgggtgttacaaaactgtttttaaaaaatgaaattgcaaagtaatttttccatgctaacacattaagttaaactaggatacttaacatacttaagctatatttgaaagaaaagtactgatgtgaggagagttttgcatttctgaagctctcatgtaagatagtacaaaatgtagagtatcttgaatagttttcctatacatacatattgagagacagtctgtgattagccaaacatttccaaaagtgggtttcctttctcttttcattttctatagtaaaatgtttaaaggatataattatctacagatacatagagaattttggcattaatctgagttccacagagaaacaaaaccaatagtaaatgattcgttataaggaattagctcacataacactggtagctaagaagtaccatgatctgctgtctgcaacatggaaacccaggaaactggttgatgtaattctgagaaacggggctgatggataagttttagttgggagtatgagaagactgatgtctgagctcaagcattcaggcagacagtgaattccctattcctctgtctttttgtcctattcagacattcaaaggattgaatgagacccgcccacattggggagggcaaactgctttactcagaccacaggttcgaatgctaatctcagccagaaacactattatagacacatcagaaataatgtttaatctgggcacctcatgtcccagtcaagttgacacataaaattagccattataattttgcattctattcagtgtgtagtatagtcaggcaaacagtattcttggagaactgtgtgtaaggaggtattgctcctgatattagcaggattatcagtaagaatcctgtgagactgagtaagacatcgtaacatctccttttaaaggtggataataaattgattgcatgagtctatttttcaccaaccatgttaccttgctcaaaaaataaagctgtgccagagtgaataatttgaactacatagttctgattgacaagcctagatttttgcaaacattctcaataaatattaccaaaactaaactgaaagtttgaaagtctgaagaaatggaaactaaatacactcctataatttgtgatttgtattttaaaatcataatactctaatatttattaaatgtttattttatcactgtgcttagcaattaatgtgttactatatttcatcaattgcaagaagcttatgtttatattttaatgcttctaaatatgtatttaccttacaattacagatagcagaattcagttattacagcctgtgtacacacaaacatcgctatttttaatggcatgactgcaaaaataaaacccctcagtcaaccaacagtctaagtaccagagttaaactggtagcatatttttgttcttactgatagataaaataatattgatttttacaatattgtcactcatggtcaatttgactctagattaacttcgtgctggtaagtggaatctatacacaacctgaggggtagcaatcccaattgctcatcattttttaaaggaaatgtcttatttaagctttccaaagcaaagactttgagtatattttgtctccagcttgatatttaaatctttaaatatcactactatctgactttgatttcccatattcatttgtatatgcataaactttaattcagtaggttaactaccttaaataagttttgtgtagcataggttgcaaagatataaaaaaaattggagacagaattttccaataataataataagagtaatagtaatagaccttgaaaagccatcaatatcatatgttgttgaaagagccaaataattattttaacatgcaaattttatataagaaagcaaactactttatgaaggtagtattagtaaaaactgctgagaaaaaaagcatttacaatcaatgacttttattaataatgcagaaaaaagtatcacttttgctacttaagataaaaaactggattaaacagacacatatgtgcgtgcacgcactataggacttctgatagacaagtgtggattcctttagaaacaaaacaagatgaagataacaggaaggaatggctttgttccaacatttactcagttgtgaatcttgaacatgcactttaagaatgacagggctcatattacgtaacaaaaaaaattataagaatgatttgagccaatacagtgaattcatgaacacattaactttcacaaagtaggtattcaataattattggttgaatgaatgtctgaaacagtaaaagttacaacactaaccttgaaaagaaggaaaatacttgacaacaatctaatttcatgtgtaaaatctgggagtagcagtagcatcttgaaatatgttagggtaatagaaggaatgaaagtaggattagaaattaggattgcaaaattgacaaggtgggaataatcactaacatggccaagataatggaaattttgtaagtgaaatagaatttgcaaaggcacagaaaccttggaaagctccatgtgaaactgatatgcccattattccatagacaatatcaaactgttaatcagacaagaaaccaatctttcctgacattgagttgttattaaataaattaacaattatccatgtattaagcaccagctgttaggtttataatccatataaatatgtgagcagctttcagacaaaactaattaagtttatcagtgcaaaataataatgggactcattgcctaattttaaaaacacaaaatgatgatgcagtaggatatgcaaattttgctgtggaactacaaaataatgcttagatttaccaaaaagatgaaagtccaagggctctatttgctttgttttattaatttcctagagttattattaattttgaaacaaaacaattgtggttatttttaatatactttttgttttaaaagtatacttgaagcaattttagctactgtcttccaacttccattatattaaaaagcactattacatacaatgtagcaaagatgaaatcagatcaatttttttaaacaaaataaattactataaagtattctgaaaactgactccacttcttagcttaatgttatattcttctgatatttattgttaatcatagaaaataattttagcatctgttatttatgtatacatttaaaacacattgcatctcacacatcttatcagaagattaatctgaaattcagattttgaaaaacacattcttcctttagcaaaaataaatattagctttctacataaaacaaatggattgaaagcagaaatatcaaaacaattaaattaagtgtattgtaaaaatattatagataagacagagtgctctattaaaggaggtagtcaatctcaaggtggcttctcatgtttgtttttttaatctaaaaaatcatttaaaatacaacaaagaataatattatgtaataactgattcagaaatgcaatttctccagttaatagactacatgattcatatgaaaaataaaacatgaaaacatttataaaatggactatataaagcaatgaatgcagaaagtgataaaatgtttgtggttctgtgatcagataagaagcaaagactttttgaactatagtcttaaagtattttaaaaactactctgaaaatgataacaagacacacacacacatttatgtacatattgtttctgaaaccagacactgctttcctttttaaagaattgattttctattacattgggaaaaagattctatcaaggataagcaattacaaatagagaagaaaagtattacagaaccactatcttaatgttattatttccttgacaaagaaggcaagacattattcaatattaaattcagaagaaagaaattagtttagaaatattcaagtgtcataacttgtttaaatttccatcaacacagtgcaaaaatattcctcagacacttagaatcatttaccaaatgacttggacaatgcttacaagacttcgtaacaattctgaagttaaaattagctttttcaacattaaaaaatattgggttcatgcaaacaaaaagcttgagaattaagaatatattctgtaatttttatagctctcaactgatacaaattttcaagatctctgtagttttagataatcatcaggttagttgaaagtaaaacagaactctgtgaatttgtatttgatgagtgatttgaaattctaaaagcacttgcccttaatggaaaatattgaagacacctaaagcaaaattttgtacaaagttattacacactaaatgctctcacagccaccatattaaaggaacaaagcctgagaatgtcacctggtctagcaagaatgtttttgttagattgtgctaggttgttgagttgtcagaataagataaatggagctgagcagtaccattaacctgtgacatttttgacaatgcaagggtatgtgctgtgcaaaaagtagactacttttttcttttctatctctcaatttataatagaaataagaaaagatagattaaatgttttaatgaaagacaaaaacagttagaaaaagcttatcttgaataatagatgcttgtccatcacatgcaaaaacacattcccaaatcagaatacattaataaagtatatcacatagatttagtctatattcaaaagagataaacattaaaatactccttaatctaggcatttaggaagaataaaatctctctttccttattgataccttcaaaaaaggttaaagttaaaagtaagttatcctttttatggcaataaactccatttcatccttaaaatcactatcaaacttaaaatatacaagtaataatagatttttttgtttttaggtttactaaaatttcacacaaattttaacaagcttattggttttttttttttttatttctgagcttcccactggcatgggaaaagtaaaatagatcacagctatgttttacaaggaaaaactatcaagctgcaataaagactaaatgtctgttaatgttcataataataaaaaatctaataaaatcatcaattagtatcactatttactcataatgtgagaagaaattctaatacctaataatgactttatgccttacatgtttcaataaaatacctttttttataatcctgagttcttgctctgaaatgtaatgtacatatacaccaaatgcagttttcaaaaagaatgtaacacatttattgactcacagatatcaatatgctttatacattcataattaatatgagccaacaaaaaatactgtaccagccaccatgctaaagaatgacaatatgagactgcagtgagatacagaatgtattttcaatgtgaccaagaccaggaagggaagtggaaatagaactaatttctccatcaataatatggtgctaaaatgttgaagtgatcagaataaggtaagtaagcttatatcctataattagaagcttattaacatgacctcagacattatcaattattcattcaacaacaattcaattggatgcttattatatgccatgcactgttctaattatatttagaagggggatggaaagatggtagatagatggcaggtaggtaggtaggtaggtagatcaatagatagacagagatagatatttctcccaaatatataagaaaatattatcaaccatgttacaatatgcatgcatgtgtatatgtacatgtgtatatatgtatacacacatcagttgttttagtttctctgccatttacattcttataataatataataattgaattgatctaaaacttatagaaggacttgccattggatgacagtctttgatgcttctaagtgtcaaatacaaaactttaacgttttattaatttttcagtttttattgacttaattaaatatacaaattaaaaagttggaatattgtttgctacaaacaagctgccaagagaaaattatatgtccctatattaatgtggcaattccagggaaaaatgaaaacatactcaataaagtaatgaaatttaattcaaatttcatttgtttataaatgaaacataaaaagatatttaaaataaaactgattcacctgagggaggcgccaagatggccgaaaaggaacagctccagtctacagctcccagcctgagcgacgcagaagacgggtgatttctgcatttccatctgaggtaccgggttcatctcactagggagtgccagacagtgggcgcaggtcagtgggtgcgcgcaccgtgcgcgagccgaagcagggcgaggcattgcctcactcgggaagcgcaaggggtcagggagttcctttcctaatcaaagaaaggggtgacggacagcacctggaaaatcgggtcactcccacccgaatactgcgcttttccgacgggcttaaaaaacggcgcaccacgagattataccccgcacctggctctgagggtcctaccccacggagtctcgctgattgctagcacagcagtctgagatcaaactgcaaggcagcagccaggctgggggaggggcgcccaccattgcccaggcttgcttaggtaaacaaagcagccaggaagctcgaactgggtggagcccaccacagctcaaggaggcctgcgtgcctctctaggctccacctctgggggcagggcacagacaaacaaaaagaccgcagtaacctctgcagacttaaatgtccctgtctgacagctttgaagagagcaggggttctcccagtacacagctggagatctgagaacgggcagactgcctcctcaagtgggtccctgacccctgacccccgagcaccctaactgggaggcaccctccagcaggggcacactgacacctcacacttcagggtactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactaaaaatcagagctcctctcctcctccaaaggaaggcagctcctcacctgcaacagaacaaagctggacagagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactaggtgaagaatgcagaagcctcaggagccgatgcaatcaactggaagaaagggtatcagcaatggaagatgaaatgaatgaaatgaagtgagaaggaaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaatttccccaatctaccaaggcaggccaatgttcagattcaggaaatacagagaacgccacaaagatactcctccagaagagcaactccaagacacataattgtcagattcaccaaagttgaaatgaaggaaaaaatgttaagggcagccagagagaaaggtcgggttaccctcaaagggaagcccatcagactaacagcggatctctcagcagaaaccctacaagccagaagagagtggggaccaatattcaacattcttaaagaaaagaattttcaacccagaatttcatatccagccaaactaagcttcataagtgaaggagaaataaaatactttacagagaagcaaaggctgagagattttgtcaccactaggcctgccctaaaagagctcctgaaggaagcgctaaacatggaaaggaacaactggtactagctgctgcaaaatcatgccaaaatgtaaagaccattgagactaggaagaaactgcatcaactaacgagcaaaataaccagctaacatcataatgacaggatcaaattcacacataaccctattaactttaaatgtaaatggactaaatgctccaattaaaagacacagactggcaaattggataaagagtcaagacccatcagtgtgctgtattcaggaaacccgtctcacgtgcagagacacatataggctcaaaataaagggatggaggaagatctacgaagcaaatggaaaacaaaaaaaggcaggggttgcaatcatagtctctgataaaacagactttaaaccaacaaagatcgaaagagacaaagaaggccattacataatggtaaagggatcaattcaacaagaagagctaactatcctaaatatatatgcacccaatacaggagcacccagattcatacggcaagtcctgagtgaccgacaaagagacttagactcccacacattaacaatgggagactttaacaccccactgtcaacattagacagatcaacgagacagaaagtcaacaaggacacccaggaattgaactcagctctgcaccaagtggacctaatagacatctacagaactctccaccccaaatcaacagaatatacatttttttcagcaccacatcacacctattccaaaattgaccacatacttggaagtaaagctctcctcagcaaatgtaaaagaacagacattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagatacaacataccagaatctctgggacacattcaaagcagtgtgtagagggaaatttatagcattaaatgcccacaagagaaagcaggaaagatccaaaattgacaccctaacatcacaattaaaagaactagaaaagcaagagcaaacacattcaaaagctagcagaaggcaagaaataactaaaatccgagcagaactgaaggaaatagagacacaaaaaacccttcaaaaaattaatgaatccaggagctggttttttgaaaggatcaacaaaattgatagactgctagcaagactaataaagaaaaaaagagagaagaatcaaatagatgcaataaaaaatgataaaggggatattaccaccaatcccacagaaatacaaactaccatcagagaaaactacaaacacctctacgaaaataaactagaaaatctagaagaaatggataaattccttgatacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtataaggaggaaccggtaccattccttctgaacctattccaatcaatagaaaaagagggaatcctccctaactcattttatgaggccagcatcatcctgataccaaagccgggcagagacaaaaccaaaaaagagaattttagaacaatatccttgatgaacattgatgcaaaaatcctcaataaaatactggcaaaccgaatccagcagcacatcaaaaagcttatccaccatgatcgagtgggcttcatccctgggatgcaaggctggttcaatatatgcaaatcaataaatgtaatccagcatataaacagagccaaagacaaaaaccacatgattatctcaatagatgcagaaaaggcctttgacaaaattcaacaatgcttcatgctaaaaactctcagtaaattaagtattgatgggacatatttcaaaataataagagctatctatgacaaacccacagccaatatcatactgaatgggcaaaaactggaagcattccctttgaaaactggcacaagacagggatgccctctctcacaactcctattcaacatagtgttggaagttctggccagggcaattaggcaggagaaggaaataaagggtattcaattaggaaaagaggaagtcaaattgtccctgtttgctgatgacatgattgtatatctagaaaactccatcgtctcagcccaaaatctccttaagctgataagcaacttcagcaaagtctcaggatacaaaatcaatgtgcaaaaatcacaagcattcctatacaccaacaacaaacaaacagagagccaaatcatgagtgaactcccattcacaattgcttcaaagagaataaaatacctaggaatccaacttacaagggatgtgaaggacctcttcaaggagaactacaaactgctgctcaaggaaatagaagaggatacaaacaaatggaagaatattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctgaagccatcacactacctgacttcaaactatactacaaggctacagtaaccaaaacagcatggtactggtaccaaaacagagatatagatcaatggaacagaacagagccctcagaaataacactgcatatctacaactatctgatctttgacaaacctgacaaaaacaagcaatggggaaaggattccctatttaataaatggtactgggaaaactggctagccatatgtagaaagctgaaactggatcccttccttacaccttatacaaaaatcaattcaagatggattaaagacttaaacattagacctaaaaccataaaaactctagaagaaaacctaggcattaccattcaggacataggcatgggcaaggacttcatgtctaaaacaccaaaagctatggcaacaaaagacaaaattgacaaatgggatctcattaaactaaagagcttctgcgcagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagggaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccggccatcccattactgggtatatacccaaaggactataaatcatgctgctataaagacacacgcacacgtatgtttattgcggcattattcacaatagcaaagacttggaaccaacccaaatgtccaacaatgatagactggcttaagaaaatgtggcacatatacaccatggaatactatgcagccataaaaaatgatgagttcatgtcctttgtagggacatggatgaaattggaaatcatcattctcagtaaactatcgcaagaacaaaacccgaacaccgcatattctcactcataggtgggaattgaacaatgagatcacatggacacaggaaggggaacatcacactctggggactgttgtggggtgggtggaggggggagggatggcattgggagatatacctaatgctaggtgacgagttagtgggtgcagcacaccagcatggcacatgtatacgtatgtaactaacctgcacaatgtgcacatgtaccctaaaacttaaagtataatttaaaaaaataaattaaaaaaaaaaaactgattcacgtaagaacttcaaaagtcttaagacaaaattgtagaattctttgatatttaatgaattaaaatggtttaaacaaagcatagctacatattacggttgaaaggaatacaaacatttataaatatataatattgaacattgcaaattattccaaagtttttccagaatttttaagggtttcttctgtgacagcgaatttgggaaaacatgcgtttagtgattatacacataatctatattctttaaatccctatcaattattggttcccaaaaggaaccatttgggaatatgatgatgataataataaaaataaaactaacaataacaataaataatagtaatgataacaataataatggaagttaataactatttagcctttattctacgccaggagctctaatattcacatatagtaacttatttaacattttgtagcaaccgtatgagataggttcattttttgttaacatgttaattatatagtacaagagataaatataatgtaaaaataaaaaatggttatttagggtttactatgggcttagtaggaaatctaaagatgagcttgccattgacatgtgacaccagtagaaaggcatgtttatatagaatgtgcccagaaagtttattggccaaataacttcactgagtaaatgaacacacttccaagagaagaactagagttgaaactgtggtttcaaaggaacaatgatcagcatttaaattacttaaaatgaaatcataaataagtctgtaattgcaaaactgaatgccaaagtcaaaatgcattgttgaaagaagtgatgctatattacatatatatttttttaagtttgaaaataacctaactttaaaggactaattaatttacaagccaaaaattggtacagaaaagtgaacattctctacaataaggaattacttaataaatatttaaaatgagtcaataatttttaacctttaataagggagataaatcatatgatttcatattgatattgataatttgacaaatatggattcaagtgttttcatgttcaaatagttaatgttaaaactagtagattgaaaaacaggatatacggcattcaaaactctaacttagaaaataaaagagccaaacaaacacaaaaatattcaaaaggtaaaagaacatgaagaagtaaatataaacaaaaaatttataatatattaaatacaacacatataaaattgttaaactttcatattgaaaattaaagatttagatacgtttcaaaacacatgtttaagtcaaaaaaacagagaataaatagtaaaatttagatacagatatagtcaaaggatgggtgggaaaaaagagacacagtcaagaaaataggttaaaaacaaggttaggcataaacatagactacatatcctgcaagataaagaattatgaggaacaaaagaatacagttttataaaagaagtaatcttataatgaatatataatgtctatgtgaaacctactttcaataaataaagtaaaatattagcatctttctctctaaaattgggggaaaggcaaagctctcaccctttctatttgatattgtgctagacatgatagccaggacaacaaagaaagataaaagaaataaaagctacacaatatttaaagcaagaggcaaaacttctcttttagcacacattattatcaatgtaaaaaacctaaggaatatacaatgtaactgctagaactaagaagttaatttagttagactgtaaaatttaaaatcaacatacacaaataggccatatttatattatcagaaaataattaaaaataaaataattctacttataatatgcattaatcatatgaatcaatccttcaacattaatgatacatcatagcacttatgtatactcatgcatatatataaacatacccacacagacatatatgaacattcatatctatcagttctattttagttatttctattgtgtctgaagcagaacatgttgtaaccaatatcaaagatatagaatataattttagctaatttttgaattcattataacttttattatttcactttatcaaagaccatgacagcagagcagttatacacagatttttttaaaacctaaaactcacttctttcaacttttgtatgtccaaatggaaaaaaatgaaaaaaaaattgaacatacatacaaatatatagtactataataaaaaaggaaattcattgatgtcttttaaacaatattttatattgctttatttcttatttttctcctaagaagtgtttgctaaaagatgaaataatgcctactaaatatctcttcccttatctctttatttgatagttcactgtcatcaatacctggagcaaatatgacataagaaagttgtaagcatagttgtttttgatcaaagcatgattacatgcataaaataataacacctattctttattctccatggtttatttggcatttaacttattatgctctaaccaataaatcataaagttgttttctctccaaattattgtattggcaataatgacaaatgaaagtgacttgcttgtgacttttactatgcaacataaacagatccaaagaaaatacattagacctatttgtagagtgttttataggaagatggaaactgcagataaatataaaaataaaaataaaatgctcccatgtaatatattattttgtctacattaacatcaataaacctcataattcatacattttatatgtagtatatgccattaaacatgctttatgaaatgaatatgctttataaactgaaaatatactaatatttttagtatcacatattctgtgataaacattgacatatttaaggtttaggaagtactattgatagcatttatgataaataacatttggtaaaaaatataaaatgtactttgccatgaattttgatctataaatattatttataacaaatctgatagaaatatttacatattatatcaacttctcaggaccaaggaagtgaaaatatttaatgcacattctatctaatgttaaatcattttctagaaaaatcaaagcagcatataacttgttttcataaagatcatggtaaaattttaagttgttttactgaatgtaacataattattttactgattttagttataaacaattcacgtaggcacaacgttaattctccatttttgaattgctgaacttattgaaaatatcacacaaccaataaaatataagaaaattcatgttatatattaacttttcttacacgtttatatgttagactgcaatggaatatgtaaactgaaattttagaaaaaaataatcaaaacaaaaaaagaaaattaagccttagagaacaattgccaaataaattcaaaagagctgaagagctctggaacttttcagtagtaaagcaatattaaccacgactttgaaaaatgcctagaccagaatactaataaatatctgatgaatgaatgaatcaatcaatcatgtgattatgtatttttccttggaataattatatattttttcatggaactgctaaaaataactccttattcattatataacagacatttactgaatgcatattatatgccagaaatactagaatgtaacctcatggagcttttaatctagtagaaattttaatggaaaaatttttaaaaagaggttgttcaatttcagtgaacaaccttttaaagatattgccaaaattatctccattttctaacaggctatttaaattattatggagaaattctttggtgctgctctcacattcaatgaaacaaactctatacatgcatttaggcattaataacttcctctttgtacagtcacattttagtcatatagcagtttcctgatgcatatcatcttaatttccacctaagtagtttaagtacagcatttttgaaacagattttgatactcttatggcatcatagaacaatagttttatttcatttattctgcatatataagtaatctccaaaatacaaccatttaactctttagctctgtaagttactttaaagggcttatttgcaacaacattaaatatacagttgtgaggctatatatccagacatacttattaatattaaattgactttaaactaatttccttctttgtttaaagaactctttcagtttacttctataagcatacatatctagcagtgattgaagttgtcttattgtgtcatttccaaaagggactttatattacgagtgtctgatattataagagaatttgagattcttttattataaagagaattttggtaaaattcaccttatttttgggcatagttacttttccaacaatacctatagcctacaaactgggccttacaaactgggaatcaccaggaaataagttatagtaaatttacctcaaagaaggagatgaatgtcttttaaacatgattttcaatctttctaatctcaagtattttaaattctgaaagtctagacttgaattgatatggcaaagttcacctgccacctgtccagtgacttaagagaatgaaatttaaagagggggtgatgcttatttgatgtaacctttgatcttttgacaaacctatgaaaaacaaatagagctttaggaaaacctttccttttaaaatgggcatgcttatatattatttaagagaagtacctgagtgacatatttcttttgacaataaaatgaaaaaaaatgtttgtaaagcatctcaaacacatacagcatcaggatacattagtttctttccctttcaaagaaaaccaaacacaaattgttacaagaactcatggagaaaataagtcttctgtctctcccatgtcactgcttttgacaaatgaattaccttttgttagtccccagccaaacaaataagaaccttaaaagcaacagatgaacactcaacaaatggatcattttttgtgacaaactgtctggaagttgtgctggaggaatgttttattatttgatcaatgacttgacgtgtcctaccttttaataccaaatggaaagaatcagaaggcaagcaaacatcgcatggctctaaccactcatgggaactactaggggacatttgattttcaggagtttgggaacccgaaacataacatgatctatttttcaatcaggcagatctcacttgggaaaggtgcaatgatgttcaatatcctttcattttaagaacaaccaaagtgacttaccagagcataattaacagaccagtaacatatcctttagtattctagttttctaaagcctccttactttaaacttttggtcaagataggtaaagttaccttgcttccctcttctcaaacacagatttaagagatattaaagcttttgtcagtgacaacactagattttggatgctgttattttttccttcacaatgtcatgctcaaaattggataaagtgcacaagcaaattgcatggctcagcagtactgggaaagctaaaggaagctgagatgtgctttttctcatattctaaacgtacaattatgaaatttctctgataactttaaaaactagccttaatcaaatattatttagagtataacttggaggttataaataaactgttgcctttttatgtaatccagagggacataaaagacagatggagaactgagcatggccaattgttttttatagctacagtttaaaaaaaaaaatccccactcacaaggcaaaaagcctctgctacatggcagctgctgactagggtgagcagaaagtatcttgctgaaaaaaaaaaaaaagaattcagcagtacagcaatgtgattagttaagctctatggtgttcctcagataaaggacgtgaagctggaattttaaagatagagttcataaaatagtatcaagaaggctttttattttgccattgatattctaagagactgcggctatcagagttgcaaatactgtatccagaatcttagacttcactagctgccttttaacctttgccatgtggcatatgaatgtggcttgtttagtgaattttatgacataattaataggcattgtcagagattctcatttatgatcatggggggttggcaaccctttgttgctttcattccagactctgagaaattagccagatggtatgtcctaccaccaaactgcaatgtggaagacatccttctcaggacactttcaaatcctttctggccaacttcatggcttctgcagtagttaaattagttacagttttacttaattagttctaactgcataggttgtttatagattccctctaaaacttcactgagataaaaattagtactgtaaatagtttagttttctcacctatatttaacttagtgaaaagacaacacagtatactacaaaaagttatctccattatacataaattccagtccaaactctgacacaaacacactccttgagcccagagatcactctcactcagttgcttcatctttataaataaatattgggctcaatgatctgattctttccaactagagaagaccatgggctctaagtcttcccatgtgcaatccatcacaagctctatgctggtttaagtagaccctaacttggctttcaaaaattaaaatatgtggttttgaagatttgtgagagtccttgaagttctatgacaaatagcaatttttagttttgcttaggaacaaattttatttgcacacagtgcaaggctatatgcaggaaagtaggatttattataagaaaatctagtcctctatccaccatttgtatatcaatgtagttgcatgttatcttctcattatcagtcttattacggttgcaaagcggccacttaatatttttcttttttagtatatcttctttcatttcatgaaggaaatcaataatgtaatatatcctattactttgaaaaattagtcttttatataaagtgtgaattatacattgaggttaactgaacatagatctataatggaaaccaggaacattaggacctttgggaaattcccatatgcatcaatacatataattcatatcagcattttctaactccccaccctaagcactcacagattccaaaagctttgatgctttatgtgaaccaatatatacatatactgtttattaataaagtttattgatttatattctgtaaattaacagaaaatgttttcaactgcttagtaagtgatatacattatagtgtaagttataataatttcaaaatcatttgttaatttttataaacatttggtgtaatattttgtttgacgtggccatcactaagtaatgcctctgtctagtctatgatttgacatagagaactgcaccaaacttttctgacattaaatttctaccattaaattgacagttattaggtgccatctggatagtcattaggcgtctcgataagcagagaatttctcttcagatcaataacattgttcatagtgctgactcttctttcagcttcaactaaatagcaatggcatgtaaatattttctagtccaagtctgagttccttatatattcaattttctatcacccactaaaacataacaataataaatctgaatctcacatttaattggattaaatgaatcattctggtcagatgagaagtagcataaatgcttgttgggagcatgggcatgttgccaggctgcttgagttaaagttctggctctgccatttaagttataaataagcactcaaatgcttcagtttcctttcctgttgaatgagcaagactcaaatgtcttagaattgtgtctgatcctggatttattgttaatatcactgctattaatgcctgtgacttgctttcatgtagtgaattaaatagagatgatatttaactgagaaggctgaaagcaagaatttgcacttctaacacctcctggcctgatattactactgcagcctacctccatcctctgcttcctcctcctttgctagaatccccaccctgccaggagattcagcagtccctggtctttgcctgaggctgtcccattatcccctatcttccagtttgctccattctctatctgtctatctgctttcttggagtcaaggtcccaaaaggggctacagtctactcaagcacaatttgaggatggtaagggacgggccaagcagtggtgggtggccacaacctcatggggccaaaatgacactaagcatttgtccgccaagatgctagcactgtctgtaggaataccacctttccttttggtatttaggtctgttctgggcagagggaaacaggtgtgaatgggccagtcaaagagctacagtgagccatctggtagtccagcaggctggcaggggccagtgtgggtctaaatggtgttcactctgaggtccctggaacatgggataggcaagacccttgggcattactaggagggagatcccatgttgttacctaagagctaatctgagagtttggtcagcaatggcactgactgaccacttataatagcttaggcaaaaagcagggtcctaaagtctccccacttaagataggcattaaccctttagttgctggcgtggtctgaagtaatcctaggggaaggctgggtggcaaaggccctggagtaaagtgagcttgcaacaatggcacttttcaacagatatagacatatttcaacaacaggtaaagccatcccagtgtgtggtggctaaacatcagtcctatctagatgaagcatgtgctttccactactctcccatccctcagtcgtgggctagtaatctgctgcaatatgcagatctcaaagaattgtaatgctggtatctacctggctttaaaatagcttggtaaatagaaggtgctcaacagatatttgctgaataagtgaacgaataaatgtacctatagaaagaaatcttttcctgtcttaacttcctgaaaggtttggaccacttactatcagtgtttgtgtttacttgaatcgatcttatgcttaaggtatgctgaacactctctcagcaacaatgaaatttattactactaaaatgaacataggctttgaagtcagatacatcataaatcaaattccagtttttgttcttaccatttttagtgatcatggacacataatttatgttttctgaggttatgagacaatgggactcattttctcaaaattaagggtaataatgtcttccttatatgctgttgacagatcaaggaaatgtatacaaacttagtaaactcataactagaaataaaaaataagtagtccttgttattgtagttgtattattattggtgatgttattaatacaatgtattatactgtcagcatctccttctctggaaaagacaagtcttaatactcaggtcaagctcccattactttaattagctaaattctggttttcctttccatcctacacatccaggttataaacttgctgcatacatagaaccaaaccctaattgtctgatgataattcagaacatggtacttgacttcttttttcactaaaagctagatgtaattacagaactcctcactaattgtcagaaaatgctttgaggaaagaataggagcaggaaaaacatgctttctgatgtatatcctgctgatctgccaggcatcccgaccattcttgttactacagagcaataacatttattatcttaattatgtgtagtatttttctataagtcaggtaattatttcaccttgtagacctgtggacccagagtccaggttaaatgcttcaagaaaaagttattttgtttctataataatattaacatttaatgggaaaaacaggtattctttaacactctgctttctgaaacatttctttctctttagttcttgttttggctttaatttgaaatagtcttagctgtcacaggctgtttttagggcaaaaaaatagtcttgaagattttttaacttattgatggccttagaggtatgtaaaagagatatattatcaaagttggaagattaatctctagccagtagaagctgaaaacagcagagggatttgctgggctttgcctgcagatgaggatgggccaccaatggggagtgaagaagcttaaaagatgtttcagtatgtagtttggagcagacattcagatcactgtcttgagataggaagttaaccaaggtaaccatttgaaattgaaaatggttgtaacagaccagttcaattgtatctaaatttgtgtgctactcctagagcagcgatccccaaccttcttggcaccagggaccggtttcatggaagacaagttttccacagaccaggggggacggcatggtttcaggatgattcgagcacattacatttattatccactttaattctattattattaaattgtgatatataatgaaataattatacaacttaccataatgtagaatcagtgggagccctgagcttgttttcccacaactagacagtcccatgttggagtgatgggagacagtgacagatcattaggcattagattctcataaggagcacgcaacccagatccctcacatgcacagttcacaatagggttcatgctcccacaagaatctaacacaaccgctgatctgacaggaggcagaactcaggcagtaatgcaagcagtggggagtggctgtaaatacagatgaagctttgctcacttgcctgccacatacctcctgctatgcagcctgtctcctaacagggagaccagtaccagtccgtggcccaggagttggggatctctatcctagaagaccaaatagatgtcgatgaaaagagtcaaactctgtaaaatatttgaagagatttattctgagccaaatatgagtgaccatggacctgcccaaggtggtcagggtgaggcttggttttatacattttagggaggcatgagacatcaatcaaatacatttaagaaatacattggtttggtctagaaaggcaagacaacttgaagcaggagcttccagggtataggtaaatttaaacattctctagttgacaattggtcgagtttgtctaaagacctgggatcaataaaaaggaaatgttcaggctgagataaaagattgtggagaccaaagttttttgaagtctcaaagtggctgcccttagagacaatagatgacacatgtttcctattcagacctttaaaaggtactaaactctcagttaatctcttcaggattgggagggcctagaagaataagatccagctatgttaatagagattctttacaggtgcgtattttctcccacgaaagatggctttgtagggccatttcaaaatatggagaagaaacatgttttcaggtaaaatattttgattttcttctttgtcaagtaatgttatgtcagagtcaaactggaaagtaagtcacgatatatagggttaaataaagcccatctgatgagaatttatgctttgtagggcatggctccccaggccccttagataggaatttgggcaagattaaaaaaaaaaatcagagcttagccttcagtgagtatagtaaaacattcttgctgaatataagcaaaagactatacaaaaggcacaagacactcccatcactttttcctaaaaatgtagagatacagaggccttaaaatcatttcaatttttaaaccctgcatatcaataagtttcttgactacctgtgttagaccagttttcctgttagaccagtataatttcccaatacaaagcagacattattgtttgtatgtctttatttgaaaaaaaaaattctaaatctaaaaatatgaagaaaacttacagttgaaaaagattatgacaaatgctcagcctcagagtatcaacaggttaaactgttattataaaaatcaatcttgagtgtaaaatagctccaaacttaaaatcatgagatttcaaaataaattattttgctacaacttacattgttaattaagctatctggaacattaaaaattaatatcatcaaggtagaatttgaattgaacttaaatacctaaatgatgcagatgtttgaaaataaaaatttaaacatcagaataacacactttgatcaaataaacttacatttcagactttgttacaagttctttattttccaactaacaaaagcacattttcccctcttttatcactttacagataacatgataaaagcaaagaagataggagatggttgacaggatagtaaaagatgagaaatagttaagagcaaactgatgaaggttgtatgaactaaaaaagagaagtttgaatatgaaaagtaaatgaacaagaaatgaaaaacaagttcacattatttaaaagatttttccacacttttgaaaacattggatgttgcataatataaaatacatttgaagtgtctttaataattcctagtaaattcatggaaaattattcttgccatatgaaaatacatattgtgaatatagttatgctaaaaatatcttgagtgaaatttttggtaatgcttattaatgtaactgcactgcctgacatataataaaaacagctgtagaatcttaaacagatactctgatagtaatactagtatcaaaaatttgcataagcctaaaggaaagcttttatctaaaggccgtgaaacatcacttatgataaaagttttatggagtttataaaaaatatttctatttacacattgtaacgaagaaagcaaagcatagaaaagacagttaaaagtgctagcatgtcctctaacatgtcctacaaatacactttattttagagctattttacaactttaagggaaaaatgaaaattcaatgaaactatggacaatatcaagcaccttgttttccttatattaagagatttcacctttaaaatcagtcctttttgtctctgaccattgagtgctctcctcaagattcaaaaaataaagagaaacttgctagtatatgttcttacaaaaaaaagtactacaatttgatacccatagattaattagattatgatgtatgatattttataaaacatgattttaaatcttttaaatttacatcttttacctaaaaattataattttcctacctcattcttagcactgtacactggggatataatcagaaataaaatgaaattatgccctaaaggataccagtaggtcatgggagaagtaatacacatacacataaaaaagtagcagaaattcttctatcattaacaccttaatgaatggtatagacaataagtgaagtttcataagaacatgaaaagttttaaagaaaagaaaattttcaaagatgagattagccatagctaagtagattacacaacaactcagtttactaatgttactaaggttgcccttaaacttagatagactaaaatcatcatcatttggtatgagttactgggtactaagagaggagtttttgtccaaatataatgcagtgattcctcatatacctttagcaggagatagaaattttttcaacagtaggagttaaatttaaatatgtaaacaaaagtagagaccttagtaataaggtaacctaaattagcaaagtgattaggtagatagatgattgatagatgatagatagatagatagataggtagatagatagatagatagacagatactatcagattcacttctataggcaggtattatgtattagggactgaggtattgcaagtattaaaggcattgtagactcaggtattagggaaccacgtagcagcacagaatgagaaaagaaagataaattagttttccttatttgtctaattttgttatttaacaacatatccaaagactagttttgactttatataatgtaacatctcaatgaacagtagtggaacaaatagctatcaatatggaagaaaaaaaaaaaccttgaaactctacgtctctcttcttctaccaaaattccacatggaaagtaaaataaaataaaacaaaacaataaagtgctaaaaggcatcaaaagaatttattttttatgttttaaatgggagctttcaaaaaatgactctaaagccagaaaacataaagaaaacaattacatacattggatctaacaaaaatgcaaaaattccctccaagaaaacactacttttgaaaaaggacaaactagaaaaatatctttaagctatgaaactgacaaaattatgttattgataatggaaaaagtttgtagcagttaaggacaagtagaatgactgttgactgagaatggtgtttagtgtccagaagatgaccctaagaaaagaattcacatgtgagtaatttatgtgggaggtgctgtaagcaatggcaggggagggaaagtgagatagtgaagggaagaaagaccgctaataaagggagctttatcatatcggctaccactgcaggtggtaacagtttgatcccacagggaaacttggggaaatggtgtagaactctggcctcagagatataaatgcaagggttaaggaagacaggtttttatcaccaactcctgcctgccattgctgcaaagcagcccctatggaatgttcattccagggtgcttgtgttttactatgtgagaaggcagagtagctttggagaatatctttaaggaaagagatgctgaaagttggctggaactcaataaaatggtacacctccagacaaatggaaggtatctacagcattggctacatggagcagatgacatgaactggtaatatatattaaaaatgcacaaatgttcaacagtcacaaaaaaataaagaacatcataaatcaccaagcaatacacattttaaaatatttggactttgcatattaaaattatatttttaaagtgattttttatgatgtgagaaaaatacactctcatacattattagtggaaatataattggtaaaagacttccgagaaataataagccaaggtgtttcacaaggtttgatatgcatcaatccgacaattccacttcctgaccatcctgattacaatttacaattgcaactctaccctttgacacttctgttacccttccatgcatccttttctccacattacacatcactatgtactaaccacatgtttgttcactcatttattttgtttattattagttatcttcactagaacatatgccacataagagcaatgacttctgtctactttattcactgccacctagaactgagaagagcggccagaacacaacaggcagtcaataaaatctcttgaatgtatcattagacaacaacagaaaaaatggtcaaataaagttcatcttaatgttgtttacaatagtaaaaaaaatcataaataacaataatcaaatgatgtggtatatataatatacataaatactgtacagattaaaaatgatataatctatatattgggcatgaaaaactatacatgatttatcattgtcaccagaacagtttaacaaacagcatattcagtatgactcaattttggctaaaaaatacatttttagtataaatctaaacctggaataacatacagagaaatattaaccctggttatctctggctgatagaattataaatgattttcactactttctactatgcattttatatagtatgtgttttacactcataatgaattatgaagctattttcactgataaaacatggttagtctaatatagaaaatctattgtggttaaagggctgaatcttaaacttttagaacatagtgaattggccaaagtgaaaacatttgaaaatgaccaaacgtttgtatatattatctgatagtactacctcgtgaattcttaggtgacctagactttctatattagaggtgcagaaatggtgggaaagggactaaagtagttttactaaataaagctctctagtgggatctacttatgtatattttgtagataacactaaaattaagttgttgtgtcttatcttttcagggatatgatagaactattaaacaaaagtagaacttttcactttggttagtgtcttgattcatattaatgtcaatttttttcattactattttggatgaagagatgaaataaaagcccaagaaaacatttccactgtttatcgagatcaaaaatgtataaaaccactataactatattttaataatgcctacagcaccaaacaagagatttgaagtattcacttgaaagagctggcagaattatttatttcctatttcagttttaatagcatatccatgactcatcttgctgcactattacaagctagtttttcttaaatttgggaattatacaattcttcaaattaatgtagcttcttaatgccttgtcatattttaacaaaatacgtaaatatatacaaatatagacacttttaagaccaagtagtgatacaaagctagaacataatttaggacacaccttttgttctaaattattaagtaatactgttatttcatatttttaagatgccacatttgatagtaatcacaagagctacataaatgtatatcttaaaacatattatgagatcagggatctgtaagtagtggtcacagcaaccatgtaatattaacacaaatctttaggactacccgtagaaacacaaacaagaagggtctctgcctgaagccctatgcttagaggccttgaatttctcaagtctgcaaatacatgtgttaaagaacacatgggtatctcagtaacttgggttgcagtgttgcagtattgccacatcctgactcatgacacaacacaaaccaactcatgactaacaccatttgcccaagggaaaatattcacatttctttccctgtgtcttcaaaataaaaggtgattccattcaaatgccaagaaggtttgtggcatgtactgttgacaacattgaacagagatgtgcttcagagtgtgggaaggatttgagtaatgtaattacttaagtaagagaaaagacatattaattccctttcaaatcttttctctccattaggacaaatgcaatagagtcttatataacaagtcattgttgctcaatatcactgagcattccccttcttgcttctctttgtgtaccacaaattagcatggtcttcacaaaagtttcacatcacatggtggctcaggaacattttagagtattaacagctcatgttacccttaaatataaatatatgacataacatgcacgtggcatgaaattatttctttagattggcaactagatggacatcgaatactagtattgtgcatagttttagttttatggaaatatttaatgagatttaattaaattttaagattactaaatgaaaattcagctctatagatttcattaaatttgtaaatattaattagctacaagttgtatttgccctgtaattttaataaataatttaaatgagtttagaaggaaacttttttgaaaatatatatgaaaaataattttaatgagttgttacacatgatttaaaattttgaaaacatagccatatttggtatatttttaatgcaattgcagtttatttttcaatcatagtttaaactgttactgtcaaaggaacaaaataatgtgaaagatgttgattataacaacataattagtgatttgccaaaacgataagaagaaaaataaatttaatggaataaatttaatgcaataatggaataaaataagtggaataaatttaatggaataaaaaaataaaataactccctttttgttacataataaatagtaagtggccaaaaaaaagttgagttgctaattctagtaactgtgaattatgtatatctttattttattactcatgcaaatactactggccaatcatcattcagataggcagagtaattaaattccatcatctttgctatgatgccaactctaaaacataaaactatagctttacacatatttcttctttattttggtgagtataagggaatatctattaaggcaggatgacataaaatattttatttagaagtttactagcttgatgtataactttaaaatatttagaaagaaggaatattggcctccacttgtaatccccacacaggggtgggcctgaagatcctagtctcaggtggtgaattcccttagggtactttgcctcagtctgccttgctcaagaattgaccgatatctactcctcaactaataggtcactgcagtggtttacctacagattttaggtttagaacattgtttgatgtgaactcaaagtattactccagccaatccagttcaagtcatttatttttatggtattccatgagtctgatttaaatctaaaatttgtgaactagatcacttgtaaatagaatgttatgcaaagacatgatttcaaaatgaacttgctaaaataatgaaaacctcatccatgaacacgtctatgaacatctattagttttcactttgtagaggtaccatgtaaactgctgaagactgtgtgagaaacatggtcaaaactgctccttcttcagaaaatgtgacttgcataaaatgatgagattttacaagaagaacatatgtgatttgtttaattttttccattccaatatggagaattctatgatgatggatttttctaaaatgtccagattttatcagttccttcctcccatttcacaggtatgttttgtaacaattagagtgtcaatatttcaagtgataaagaaactgaagatagctgctataatgtgctttgtttcttgtgtcaggattaaatatgacatatgcctgcaatctttaaatttgaaattgtgttcttaaagaaaaatgtacaataaatttcagccattgtcctctagtagatgaatcactagtaactttacaacactagctccaaatatattaagttcaattgaaaacattttaaagataaagcaggataatttatgcttttgacaatatgcagaaaatacgtcatactttggtaaagagacaggcgtggcctagtaggctgcaggaaagtgtgacataggtgaaggaccaatacctagaaatagatccctcaactctcagggcagggtaagttgtagagtgactatcccagctgttttgttggaagagtttagactcttcaaaaagctggaagtagcaaaggatatctcagcagtagtcacatttcctgcataaagaaagaggccaagagagactgggtacgaggccagactaagaggatgtggacatgagtgggacactttgtgttgcaaggagtacttgatttgtgtagaaaactgctttttctaagaaattaaattttctttaaaaagttacatacacatgtatatggggcatacgtactaaatttaaaatctaacatagcagggcctattgtagccagtgagagtattaaagaaatatacacaaacattgaaaaataaatgcatatgctatagaaatatcatttaagaatataaatcctacagttctctgtccctattatcctcttctaccccaggtgcctctctcctacttatttggttaggcatctcacgttcctttggggagaaaacaattaattaatactaaaaaatcctctgttttgattcctacagtaaatattaataggtataatccatataaagaaaagctcttagaggtcctcaatagcttttaagagtataaagtaaccatgaaaacaaaatttgttttgttggaatcacttctccaggaatcaagatgagtccatatctttatttgggtgaaactaaagaggatttgtagagactgtacctcagaaatataaatccattagccatttatatatgtaaaaaaacaaaataacttcagtgtatgtgtaacattttaatcttatttggcttggattgagcatattcaggctctagactaacttctacaaagcactgaagatagaattacagcttaattcaggagttgtatcatttcatttacaaaaatagactttagatccctacagaactggaagggatctacttcataaaaagaagcaaagtagtcttttataagatgactctcagatggtagtgtgttcttacactctcacactttatgtcagctcatgaaccttgctggaaagctagggaacaaatgacctttttacttttgaaggagttatttcagataaagctttacctgtgcaataaggagagaaaaagcaaagtgctttggcacactacataatccttgtaggtttcagtaccagttcagtgatataataatgactattttgggcttctgaacagtttgcctgtgagattggacataactccctttttgttacataataaatagtaagtggccaagaaaacgttgagttgctaaagcttagctgacctggtggacacatattttaaaataactggaaaaataagctacagcccactagtgtatgttctgtgaacttgggacagagtacatccatcacttcaacaacaattcatcacaatacagttccttccagcctttggtcagtagtttggacatgatcctcctaaaagagagagacatttgtagaagaatctttctttcttttttttttttttttgagacggagtctcgctctgtcgcccaggctggagtgcagtggcgcaatctcagctcactgcaagctccgcctcccgggttcacaccattctcctgcctcagcctcctgagtagctgggactacaggcgcccaccactaagcccagctaattttttgtatttttagtagagatagggtttcaccgtattagccagatggtctcaatctcctcacctcgcaatccgcccgcctcggcttcccgaagtgctgggattacaggcgtgagccaccgcgccggcctgtagatgaatctttatattatattgacggatctgttaaattaggttttgccttgcagctattgagcaactgaactactaagatacccctcttgccttgacaagaattattgtatgcttcatcacatacaatgactagaaccagaatactgtaacaatcctatcagaattaaagaggaaatgtgatacattttattagaaacttcttaaacactttctagaatgaatgggaaaggatgagttctctcttgataactctttactgaaatatgactactaaaaaatggcaatatttccagatctaggatttttgctataatcattcaattcacacgcaaggcaagtataatctggttataagatttattaagcacttagtctgggtcagggatggtacaaagtggtttatatgtattatctcatgtgatccccaaaaaactttagaaatgcgttactgtcattatcccagttttatagacaacgaaatgcaggctccaaaaggttaaataaattgccttgagtcacaaaattagtaaattacagagcttagattgatgaagttttcaattacaataatttcataatccgtatatatattattttattagctatattctagctagtaaggtttgttcagatttggggttcacagtcctagcatgaatgagcacacttggctaagtcacgaataataaacaaaaacatgctttgggatagaaagattattctctaaaaccgatataaaaaaataagtttccatcaagacacaaatgacttaaatgccaactaatagtaaatgatgaaagaaatcccagataaaatgcacttatagccagcacaaatacagtaatgattccgtgggtaatatagaatcatccttgatagtttaggaaaacaatttataacaagagaaaaagttacatatagtaaaaaagcaaaacaaaagaaacacaaaaatgggctttgaactagagatacctggctttgctgtttttgagatgaatacatttgggcaagttaattaacctttctgagcccattacattatcaataaaatgaggatcccagtatttgaactgcatgattgttttaggattaatagttgtgtcctaaggcctttgtgacatggccagtcctccacaatccatatccatcatatcatttcctaaaataaattttatcaaaacaatgctatactgtctggggctgaaagtttgaagaacaacctaggatttcaaacaatttgcaaacactgaattagaagatacaggatattggccatcaatatctctacaaatggagataaaaagggtatagctgaaattctctatactccttataatcttaattcctaaaaggggaatgctctccataataagtactttaagtgaaaagaaaagtcatattaataggggagaaaaggccatggatacagaaaagaaaaaaaaaaagaacttctccactctagacttatgttccacactttacttttcccaatccaatgctacttttcctaggcctgatctatcaagaacaagtattagttgtctccacagagctttggcaagcattgccaagaatggtggattataagaccttgaattaaaactgaataaggagggctcactcagcttgaacaatattggagtatagaagttctactgatttttgtatagtgattttgtatcctgaaactttactgcagttatttatcagttctatgaacctcgacacataggacttaattaaactaaaaagcattttcatggcaaaataaattatcaatagagtaaacagacaacctacagaatgcaatattttcaaactatgcatctgtcaaggtctaatatccagactctataagaaattaaacaaatcaataaacaaagagcaaataacgccactaaaaagtgggcaaaggacatgaataaacacctctcaaaagaagacacacaagcagccaacaaacatgaaaaaaatgctcgacatcactaaccatcagataaatgcaaatcaaaactacaataagataccatctcacatgagtcaaaatggccattactaaaaagtcaaacataaaaaatgctggtgaggttgcaaaaaggaatgcttatataatgtgggttatttcagccactctggaaagcagtttggagatttctcaaagaaattaaaagagaattaccattcaacccagcaatctgattattggtatacacccaaagaaaaataaatcattctaccaaaaagacacatgtacccgtatgttcactgcgatgctattcacaatagcaaagacatggaatcaacctaggtccccattaacagtggattggatttttaaaatgtggtaatatacatcatggaatactacaaattaatgcaggaacagcaaactaaatattgcatgttgtcatttatcagtgggagctaaacattgactacatacagacataaagatgggaacaagagacactgtggactactagagtggggaggaagtggggactgtgggttgaaaaactatctattgggtattatgcttactacctgggtgacaggatctgtaccccaaacttcaacatcacacaatatatccatgtaacaaacctgcacatgtaccccgaatataaaagttgaaattattttaaaaataaataaaatactagaactaatatgcaaatcttgaagaaaaatttatcttttatgatttaccaactactaacatttcatgttgtcattttaaataatgcaatcatataaatgttctgtcactgtaaatcatataaatgttctgtcactgtaaatcataccaaatgggatcataattgtatctatatcatagtattattgagatgataaactgaaaaagttggtgaagtcccagcttaatgcccaagcatatttaatactcactatatgtaggtcactattatcataactgctattgttaatatgagcttgggctggaaatataaacccatgttttaaaatctgagttggtacaacagaaaaagaaaaaggaatttttcaaaagtaaaataaaatttaaaaaacaaataattacagatatcaaaaactaattcaaaatattgcaatcattacttcaattcagcaaatatcctaaaatttgtttataagagaaaatagccaacaattgtgttacaattttaaatattgcatttttataacaaaaaagtaaatttttcttgcttataagggcttctgaaatttatttcttctctaaccattatcaaaccaatcttttacagctgaattaaaaacttctgaaaataacatatagaaaagcttaagacatatttaactctaatattgaaaataataatcatcaaaaacagatacaaatcattgccaatcccaaaggcagttctgtgtcattggactttttctggaagcttttcactatatctgagagctgtttcatctgaagttagccttttatctgtaggcctgctgtgctatttcaaacggccagcaaaggcgatgaaactaaaacaataagaaattccttgccaaatgatgaatttgtaatcttaaaatttgacacaaattctatagttaataatcaaaagcattatgttaatacttagtttaaattactgatgatataatgcaccctacatgcaaaatttcctaaagttattattaaaatagtataccatgaattaaagttatttatatgcatgggtatgcttgatgtgacagtaggtatatatacatatggcatagatattcatatggtaaaatagaaaatgatagtaatttttatgattcttagatatgtataacttattaagcattactatatagcagtccttgttttccaagtgttttctatcctttatctcatttaatcttcacaaaaccccaaaaatgtagatgcaattattacttgcatttcacaaataagaaacctacacatatagagcttaagtattgcttaaactcactgacatcagcagtggcagcaatacaatttaagattgattctgtctgattccaaagctcatgctcttaaccactaagcatattgcctttcacaaggagaatacaatcaatgacagtctaatataagccaggcacttcacgtactttctcattttcaaagatgaagaaattcacagaggttaggttacttgtaagtgctaaagctccagagttctttctctatttcctcagtgtttattacagtatatccaatggactacccatctcagtcaccagacactatttaaagggtcagattttcagctttagttccagattacaggtttgatccatcttaggcaaggcatttttaagaagtttccttgtgaggtactccacagttttcaattgtgtatgtgtatgtttctgataagaagctattttttttacctcagtatctcctatgataaagcaggatagttatgtcacgggatccttggggtgatgcttcaccagccagaaacctctgtggccagtggcacctttgcccaagttttgctcaggtctgctgggcccactcggctgggcaggctgtatttggcttgtgctactggcctggatcccatgcctgccaagggcaagcagagtggcgaggggtgtgtgagtgagcaagcgtggggtccagccactgcacacaggcagggaggctggctgcggcagggtggatagcaccaggtgcctgcatgagtgctggctccctgtgaggctgtggctggaccaggtgtactgtaagcagcttccacagctggcatcagagaatgcagtggtgcccagaagctcggagatgccaggaactgcagagccccaaagagggtgtcacagtgctggcttgggaagcttctaggtctgggctccccaaaggtctgtagctcttctcttcttgttgcctgcaacatggcaagcaacaggagtatttcagctctgtttgcgttacagctctttcagcctcaccattcggcagttcctgagttcttgtctcacacccaggaagaatgaggtacaggtacaagtggagggtaggcaaggtgaagagaagctttattgagcaatagaacagctcagaggagaccaacagtgcgtagctcctttctgtagcgaggatgtcccaacaagtgttcagctctcagcagagaggagaccctggggtgggtagctcccctctgcagctggtcatcctgtcatctttttgagtctggctgagtccaaggtttttatgggcatcagaggagaggaattacatgctatcagtccatggacagccatgggcaggcccagaaaaagtactataagttcctactcccgtccacagggctggaatcctggcccctagacttcaggctagaccacctgggacccacccttttccagccagggcctatctgcctcctggcactgttcatggtgcccaggctgttcatgcggaggggtacctgcagaccagcaccaagctgccctcagcactccgtcagcttccctcccatgctcattggtgcccaaagtcctgaaggggctgaggtgccaggggtttggcctgttatcactgccctgagcacacacacacccagctggagtgagacagtgcccaggctcagcctcaactttgctccaagattgaagcaggtacataccgggagtagggagaggccaagcagcagaagcaggcacttacaagcctatgggggtaggggaggccttcctgggctcccaagagtgcagagatgtctgtgtctgcagcaatggcatgggtggctgcagttgtacccagagggcagggcctctgcttgctcccagcccccaagagcacaggaatgcccagatccacagccatagcttaggtggctgcagttgcacccagggagcataagattccaaccctgcaaattcagaaggggtcagagcttccacctgttcctggctcccattggctccatgaaccatgcagcccctgctactcctcccacactacagccagcatcatggcagtggcctctctagatgggatgcctaccactgccatcagttatagagtggcaagagaagatgaaattcatttcctagaacatgcaatgttaccatgcaactctctcattgatttaagattcaggacaaaaaacagacacctaataaataatacttctttaagaaatgccttttagattttctgatgttaaaggatcaataagtaatatatacagaaattaggataagaagatgcccacatatttcttggcttttgtttatgagtttcagagaccctgagtttcaaacatatttccattcttccatagataatccatcctcaaactgttgtttacaaaatcagagaaaagaacaaagccactttaggatatataacaattgacatttattgtgtacttactagagggcaggtatcatgctaagccttgtgaactcggtaaattattatatctgttatacaagcaagaaggctaaagtttaaagaggttaactaatctgaccaagatcataaagatattattagagctgggattctaactcaagactatttgattccaaagacctgaactatgtcagctcatttcatccaccaccagaaccaccacctcctaaatcaccattactccaaccacctttatagttaccactaccaccaccattatcaccatcactgacatcattgtgaccacctccactatcaccaccaccaccaccatcatcactaccaccatcccacttcttgccctcaacctatgtttctaaagcagtcagtttccagtgcacactttggtggtggtagttgtggtaaataaaggaagttaaaaattgaaaataaatatccccaaactactgaatcagaatcatccacagtggaaactagaaatataaactttaacacattcctcaggcaattcttatacaaagtaaagtgaaaggaccacgacaatatgtaatagggcttcaatttaattcagtgtatttcaataactaaaatacttcaacaaacatttttaaggctataaaaacataaacaaagaagaataaacttactactttaagtacagatgcaattgctaacttttttgtattttgtgacagttggaacagtagaacctagtgcagttttcaagcaagtatatagtaagacttgaggttaaaacaatttgatttgtaaggaaggaatgattcccaaagtactaatttatctccataacttagaacaaagaaagctatggatttactttccaaattttgtatttttacctgcaggtaaggcatgttaacgagagttgggtaagatgttatctcacactttaatatggcacaaaaaaactcatattgagatttttttcaaactcttccttccttacatttatttgcatcatataactacatgccaaaccaagtataacctgggtattttgatactatcatacttcacacaaggacatttcaagtaagaaaatttggaaaatgatggcaggtgtctacattttgccattctctcattactcttcaaaagttcccaggttagtcatttgaaactaattcattaattacttaatgaatcgtgcacatatgctgaaagatacaatggcaagattgctcattgcagccttttttacataaaagaaaaaagttaaaataatctatttgtccctcagtagagtggaaaacagtgatttatttatataacaggatattatcagtaatttaaattaataacatctacatgttttacatgactatatctcaaaaatattgcctcaaaagagccaactgcaaaagtttatttatagtatgagtcaattcacgtaactaattaaatatattaaaaagcaatatataatgagtatttaaggactgcacttaagaataagaagagtgtcaggtgaaaaagtgggtaaggtattcaaggcaacaggcaaagccaaaataaaggaagataggcacagagacagataccatattctggaattagccagcagtcctccataggaaattgctaggaaatgagactggaaagatagacaagtggccagactgtgaaacatcttgatggctaggctaaggaatttgggattaaccatatttgaactaaagaaatacaaatgtcatttcaatgaacattgaaatgatcagatctatggcttaggaagataactgtgactgtcagatggagaaatctgtaacagaatgagaagcctgtgcagtaacccaggtaaaagattaaaaatgactgtgagaatagaaagaatagcatgaattcaagaatagctgtaaagactaaattcacagggcttagtggtcaacagaaatgagaacacggtcaaagaataaaggaaggaaggaaagaaggaagaaaggaggaaggaaagaagggagggagggagggaggaagaaagaagaaaagaaaaacaaaagaaaagaaaaattaaagttgatatcaggatttctaatttgaaataatgtataggatagagtagatttaatgggggaagcagagtttacattatcagcgggtcattccgaagctgatcttagtagactagaaacatccaatcctcataagaaaaatgaaattatataaaaatttgtttggattaagtggtataaaactgataataaaggtatagcacttgagaagaaaataggacagggcagaattctgaggaactgctataggctggcatttaagcagcaggtaaagaagaaagatatattacagaggacatgaacaatgatccagagaggttaaaaaaaaaaatcaggaagaagtcgtgtttcagaaacaagggaagaaaatgtatacttggcaaatagagaagagactagccaaatgtattttaaggatcttttcaaacattctgatggctgagtttatttttattaaggtaatactttacaaactctgacctaattagtctgcaaaaatatatatactcatgtatattttgggactcctaaaggccacctggatgtcgcatggatgttatatgttatagtctcatacccagtatattaaaagttaggcatatgtatgaaggaattgactaataatgcttctattgaagacacaatcttgcagaatcaaacatggaggtttagtttggagaataataagaaaaccagtaatgtactgacaaaatgtagctttgacttgcatcaccactgatgttctgttctatttttatttttattttaactttttctttgaaagtttattgcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcaacagagcgagactccgtctcaaaaaaaaaaaaaaaaagaaagtttattgcatcaagtttcagcatgaagtcattataatgctaatgaggttatacatattaaaagagttacagtaaagcaactctgcatgtacagaagccaaatttaatatataacaaattggatttattcccaatgtgaagggcttctcattatagataattgctctgaaaagcacatttttttattattgctatattcctaacaaaggtaaaaaggtatccttttttaaaaaaattgtaagtataatttaaaaaaaaccctatccaagaaaaataaacttcattaaattgttgataacattttttgatgagcaataaagtttcaatcttaaggattcaaattagaaattattaacatgtatttcctgtaatggtatatatgcttcacctctgtggtttctcagagtgattttccccataccttctcagtgggacaatattgattatctaataagtgattataaaataagcctacacatataattaaaatcaaatatatttcctagcagttccaaaaagattccataattttcaaataattattaaaatggaatcaatagtggttggtcatgatttggacattcagttatttttctcaagtagttaatttaaataatccattcaaatgatctatatcatgcagtatttcttgaaacagaactttgaaactgtttcttaatctcaatagtgcaactggagaaagcatataagtaaaatgatgagctttagactacaaagcattcttttgcagcagattgagagctcaaattatgctattttctcttactcagataaatttattcttgaccttgcctattattacataagaaaccactgctaagaattgcagttaacacagctatgaaactttaatatcatcttccctttttacaagtggtgtgattttctgtcattaccaagatagcttagattgggatatgaaggcagatgtactgacacattagataaccatatactgtttaaaggacacaggagtagcttcaaagaaggggaatgaagcttcacaacaggtcccatgtcatgtcatcaataacagacctgtcacactaatgactaaggaaatgcagggagctgtgacaatgggaacattcatcttgttcttctctggaaaaggtgcacctgtatcccactgcactctgtcttctgctacctcccacctccctgacttttgttctccatgacagtgaatgtgatcgtgagaatgtggcctatctatcatcctctcatcctgaaaggcaccttgactacagttaatgactgtaataagaccaaacaatagatacaataccccaacctcttattttcagcttttctaaaaatggactcaattgagattttaaaaaaggatcaaaggattccactagaaaagcaaataatatttttgtaacatctcacatattttgctctcctagttcatgtcatatatatctaccaatatttagataggaaatgtgactgaaaagcaatgagactgttattcttgggtggattatacaggcaacagcaatatatggctacatgcttataaacttacatatgtaggcctcgtatttaccaataacattttttaaattttgcactgtgtaataacagtgcttcccagcaataaaacaataatgccttttagcaacaaattatgcatcttgtttttgtgttgcactagttattctccacaaaacaactaaatgtatagtgtaagactgtaaatgcacccatatacaaagaaattagaagagtaaagtcaaatacataatttgaaaacatgcagacatcaatcattcaatgaatacttattgagtacccttttagtgtcagatggcctctggaggagttgggctaaaggaggctgaatccttgctttgttactttgtcacctacatgtacttgaaaaaattactaaaattctctgtgcttcaagttcaactctgtaagtgggcatggtaacaacatccatctcttaggattgttatgaggagaacctagaccagtggcctcacaaaaagaaaaccctgaagaattttttttattattgctatattcctaaaaactaaagtgtgaaaatatattctttaaaacattaaaaaataaaaactctatccagtaactattgctgttgctgctgctggtactactactattattgtcattactattatttctgttgctgctgcttctcctgctatactacatgccagacactataaggtattttcaattattttgattgtcacaaaaaaaattaaacagaaggttttcatttccattttacatggtaaaaaactgtctcaaaaaagttaaatttttcacataaactggtaattcttttttttttttttttttttttttgagatggagtttcactcttgttgccccggctggagtgcaatggcaccatcttggctaactgcaacctctgcctcctgggttcaagcgattctcctgcctcagtctcctgagtagctaggattacaagcatgcaccaccacacccagctaatttttgtaattttttttagtagagacagggtttctccaagttagtcaggctggtctcgaactcccaaactcaggtgatctgcccacctcagcctcccaaagtactgggattacaggcatgagccaccacgcccggtcacaaactagtaattctaaagtattttctttacatcagtattaagaactccaggggatgtaaaaattaatgcaagctatttattaacaaaaaccttccaatacagtaaggagagttatgtgggtatatatccacaaatagctatgacataagataggaatacaatgaaactttccagaggtattaagatatatagggtcaaaggaaaggacttttaggggtgcatctcaggagaacatgactgagtttattctaaggagatcagtatgcatttaactgccagggggaaggagagcattatcttctcttgtcacacgaaggcacgtgataatgttgactgtaagatgacaacagaatgtaaaattcacattaaaatccaaaagaaaaggcagttggaggcttcttgttacttctttctatgtgctgtttttaaaatcaggaaatcactggcttttagaacttccccagttccctttacgttagcagcagattcttgtcctgaacctgagtaatgacctacattgtgtacaacacatcctaatgtctgagagaaaggtacatctgtgttgcttttccagaagtgaatgcattagaagcattacatttttataaataagcctgtagggagaaaaccctgatgcaaactgctaacaagccaactcaagccacatatatgctaagaaaattacaggaaacaatgtcagtgattttacaatgtcagttgatgttacaagtgtggtgggtaaaacttgcatccaatgaacaacagcacttaacaattttaaacaaaaagtaggtattccacaacaaacatttttgtcatctatagagaatatttatgggttcatggtaacaagttaacagccattagaactttaaaaaataaatgtttcaattattactgaaaagatcttttgccttcacagcaaatggatttaaggaaaaattcaaattcatcataattagataaaaaataaacatatatttaacaaatattttagtaaccaatgtataagtatttgttgaccttttctttgtctaaactgatgtaattattcactcagggcttgtcttcccaaagcacccagaatctccccttctttcaaaagtcttcattaaattgtcaactgaggcttgtaacctctggcttcagttatattttctaccaggattaaattaaagaatatacggctttatatttttttttttcctgcattggcaatgtcccataattaaatatgaaaagaataaaaattcagaaacatatgtgatttttctatcacatcttatatctttactctggtgtataaaatatttctggcattttgctatatatatgtatgtattctaagtgtatctttttgtaagtggtttatatcattgcaatgaaatttctcattttatgttttaaatttaatttttctttaaaagatgatttatatcaccataaatttaaaatgtcaagcagtttatcacaaatttacttaaaatgtccttgggatctaacattgacctaaagggtttaacacaaattatgcatattataatgtatccttcaagtctagactgaaatattctctgaaatgtgttacctgccttaagcactcactagtgatctctcccttctctgatcttctctactacttaccattcaagccttcttttttcctcttaactactctgtgcaagtgtatgtgtggtccctctaatcagatcaaaagctcttttgagggcaagagtgagagtaataggtctttcacgtaacagaggttcacacattttttgagtcattgatgatactgaaaaaagagaagaaaaagagaagaaacaaaagcagaaaatttttcaacgtattatttcagggatattgtaaattttaaatgtgattcataatattcagaataagaggaagtagaaatctaggtggtatttggaaacctgatacaaaagagcagtaaattggtcaaaataatccaaagtgctaaagcaatggtcatgtgggtatgtttattccatgtataattttctggagcccaaactgaatttttcctcactgttaaacagaacagcatgataaaaaaagatggtgctgaatcctctacaatcaaacccttaaaatattttcagagttctagaatgcatgaactctcaaatttccctagattcaaacaatcaatcctttcaacactagttgcctaaaaccacaaagcactgcattgctattgatgacattattgccagttttaaagagattaaccaaagcaagtattcattattcatattcaaaatatgtattttcaaataactttgatctaagtcctgaaattaaaatgttgcataaaattctcaccatattaataattataatacatgtaggggaaacggtactataaaaaagcatttgaaggaagaaatctttagttctaccctctacagtgcctcttactaactgttattacctaaggtaaagccatgcaatctcttttgacctcaaatgtaccaagtatatattgataatattgaagtatacattctctttttttttgagacgaagttttgctcttgttgcccaggctggagtgcaatggtgcaacctcgactgaccgcatcctctacctcctgggttcaagcgattctcctgcctcagcctcccgagtagctggcattacaggcatgcaccacaatgcccagctaattgtgtatttttagtagagatggggtttctccatgtcggtcaagctggtcttgaactcctgacctcaggtgatccacccgcctcggcctcccaaagtgctgggattacaggcatgagccaccgcgcctggcctgaagtatacattctccaagatttctatgaagtataagtttctatgattatatgaattaattatatttgcaagcctgaaacttcataaaaattcaaggcctgctacatttatgaaagccctggaaatccaccgacctggggcaaagtccaaaaggaaaagaaaagaaaaaaactctgtattccctatcatacacagcttgacaggcctctttgaactttgaagcaacatattccaaatttgaatgcggtgccctgcactgcttttaaaatggtattccttgagtgtgccaagaataagagaaggctctccagctgaaattgcagctctattttcttctttgttctgttttgtttccatgtgtgggtgcatttgtgtgtgtgtgtgtgtgtgcgcgcgcgtgctttatatatgaagccaccttccctcctgggttgactttgcactatagtggccacaaacttaaagacagcatttatcagactttcttatagttggagttctggaatagggtcccaacaattaaatgtacacatgtgggagagtaataacattgaaatacaggccattattgtatatacagtataggtatatatacatatatatatagtgtatatatatacatatatgtatatgctatatatatagtatatatagtatactatatatagacaatatactatatatataaaacatatatatactatatatattactaaatttataaatttagtatatataattactaaaatatatatactaaatatatactatagtatatagtatatactaaatatatactatatatatgtagtgtatatatatatttttttgcttagctctactggcacacatagttgatacatggagttttctgctgtatgattcgagactattcagaagctttatgcatgtcaaacgacagctatgaagttagtgacagtagcttacctaccagctatttcagattccagtcactagttttaaaaatgtgaaaatgtgtggcagcagcctcagctcctctgctggactatatcatggtgttttgcaagttatttctgaaaatccatcctggagttccctacatcaatttttccaacaagataataagcaccttattccctgtattaaattaatttttgcccaaacaaattgattttctttttccgcatctgaaacctgtgtgatacacaactatttttatgctaatactactaaaatgcagaaaatagagttggaagaaaggaaggaaggaaggaaggaaggaaggaaggaaaggagggagggagggagggaggggggatgggcaagactgtattagattaaaaggcagtaaaacccttgccctggtttcagtactgccactaactcattaatatgaccttaccaagtcacttaaactttccagacctcagtgcctcaactataaaatgacaatattggaggatgtattctcaatggtttctgtgaattctaaaattctatgccttgataaattaattaaatttaaatcattagctgcactgccacaaggttcttgaatcccaaggcaaatgacctgtttcacttataaccagaacagacaaaaacctgcatttttaaactctctgatggcttctcccatatcttagtacttttatcagagagtaagaagaggcagacagttactcatatgaacaactttctgaattagatagctatgtcaatttaaagccttaacaaatttatagtagtagtttttactttttgttttttcaaaattaaaagtatgaggtaaaaaaaattaaagtcaattactgaagcattttacttagtataaatattgttctaaagcaatactcctaatggacagtcaggtactatctgctcataaaccataaaatgttctttgaaactgaagattgttacctattcagtaaaaacactttaaaagaactctaaaatggtttgatgtattgaacaattgagtagtatgacatggcatttactgttttttaatagctctaccattttcttagcaggtgatgcagaaccaattatagctattataacaatttaatcatgaaaaaaatgatgactgggttgtaatagtctgaccaatttctgatagtttataaagccagatttaatagatgtctgcaacacttttgaatgtgtacctgtattctccaaaacatatatggcagagactgctaattttaatattcctgcttttaactggcccctttacagctggatggtggctatggatctctaagtactggccattagcaagtaaagaaaatcattatccaattacaaaaataatttttatggcaaatttgggattatttccttcaaaaggacaagagcaaccctttcctttctctccctcctggcatatagaacttagatgttatgtcgagaacaaccatcttgaaccggaagggtgaagacacatggccaggcttcctaaatggtgagctggctgaagcccatgatgctggtgacttcatggagcctccatatgagccttaagctccctacctcttgttacaaagaagacatttctatagttacttttatcttgattttatatgcaactgagcctactcttatccagcataggtattttcaagattaggagattgttgtagttctcattcaaattgcatgtataaattgttttaaaaaattatgaaaaacctatatatacatcattaaatactgttctttggggaaaaaagccatataattgtttctttaaatgttttgtagatgttagtaattatatgtgtgaacatatcagtaaaaaaaaaaataaatgaaattgctaaaaggaaatacatgcttcaacaaaaatatccaagttcattttaatcatatgtattttaacacatgatttagaatttacacttacagggtttttttcagttttccatttgggatcactatgaaataaggccagtaatgagcacacatagctaattaatagatgtacattaaattacagatttctctactaacacagaagagaaactaaagaaggatccacttagtaagaataaaattagcacacaaaacatttaaaaactattcatatgtaagtacaatcaaattcaaattatttattaatagtttagggtagatatattcaaatgtcttcttttttaaaaaggtacctactgattataaaaagaaaagtattaaacaatgtaatcagcacttaccatgcaccatacagcctagatacttttttcgtaacccatagtatcacaggaatagacactattatcatgcccattttatttattttttattttttattttttgacttcttttattttattttattattattatactttaagttttagggtacatgtgcacaatgtgcaggttagttacatatgtatacatgtgccatgctggtgtgctgcacccattaactcgtcatttagcattaggtatatctcctaatgctatccctccaccctcccccgaccctacaacagtccccagagtgtgatgttccccttcctgtgtccatgtgttctcattgttcaattcccacctatgagtgagaatatgtggtgtttggtttcttgttcttgcgatagtttactgagaatgatgatttccaatttcatccatgtccctacaaaggacatgaactcatcattttgtatggctgcattgtattccatggtgtatatgtgccacattttcttaatccagtctatcattgttggacatttgggttggttccaagtctttgctattgtgaatagtgctgcaataaacatacgtgtgcatgtgtctttataacagcatgatttatagtcctttgggtatatacccagtaatgggatgtccgggtcaaatggtatttctagttctagatccctgaggaatcgccacactaacttccacaatggttgaactactttacagtcccaccaacagtgtaaaagtattcctatttctccacatcctctccagcacctgttgtttcctgactttttaatgattgccattctaactggtgtgagatggtatctcattgtggttttgatttgcatttctctgatggccagtaatggtgagcaatttttcatgtgtttcttggctgcatacatgtctacctttgagaagtgtctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaacgagatcccatttgtcaattttggcttttgttgccattgcttttggtgttttagacatgaagtccttgcccatgcctatgtcctgattggtaatgcctaggttttcttctagggtttttatggttttaggtctaatgtttaagtctttaatccatcttgaatgaatttttgtataaggtgtaaggaagggatccagtttcagctttctacatatggctagccagttttcccatcaccatttattaaatagggaatcctttccccattgcttgtttttctcaggtttgtcaaagatcagatagttgtagatatgtggcgttatttctgagggctctgttctgttccattgatttatatctctgttttggtaccagtgccatgctgttttggttactgtagccttgtagtatagtttgaaatcaggtagtgtgatgcctccagctttgttcttttggcttaggattgacttggcaatgcaggctcttttttggttccatatgaacttgaaagtagttttttccaattctgtgaagaaagtcattggtagcttgatggggatggcattgaatctgtaaattaccttgggcagtatggccatttttacgatattgattcttcctacccatgagcatggaatgttcttccatttgtttgtatcctcttttatttcattgagcagtggtttgtagttctccttgaagaggtccttcacatcccttgtaagttggattcctaggtattttattctcgttgaagcaattgtgaatgggagttcactcatgatttggctctctgtttgtctgttttactggtttataagaatgcttgtgatttttgtacattgattttgtatcctgagactttgctgaagttgcttatcagcttaaggagattttgggctgagacaatggggttttctagatatacaatcatgtcatctgcaaacagggacaattagacttcctcttttcctaattgaataccctttatttccttctcctgcctaattgccctggccagaacttccaacactatatcatgcccattttaaaggtgaggaatctggagctcagttctcaaattctctggatatgagtagagtaagaagaaatggaatagccaggtggaccccctttgtctgtcttatcagaaaaggtaaatttttaaccattacgctgttacccatgaagacctgaataataacaatatataaaatgtgttgcatttatttatgccttcttcccctccaagattatatcctactcagctaataatagaaaggaagaaacaactaaaataggaatttgactttaatgaatttaccatataaagttctaattactttgaaaatttataaaaatctatgtttttatttatgttatttgtgattttattccggcacatatttgtattacttatttttaagctgttggcatctgcatttcaattcaaactgcatatgtagtaacacagtgattattaaaactgaatttcctggtgaaatacagatgtaaaaagaaacctattagtgatgatgaaaatttttttaaaagtgaaaggtctaagaaaataattattcttaaatataaaatacaaattttgaatgatattgagtgttgaaattagtagtaactctgacctcagaggtgaagaggttcattttatgttcgatatagaacaagaaaaagaaatttactaaaatatttcaggatgtgctctagttagtacaaaacaatagcatttatgggaaaaattctgtgctatggtaggtatcagtgaagcctgattttatagccattttcactgcctaaaataaagaaaaaaattttttaaattaatctgtgacagatgtcactagattatctatatattcgttaattggcactctacattcagaatttaattttttaattctccatttttatggtaaatgatagcacgacaggggaaactccttcttgtcaattggaactaattgtataagcaactcaacattttacaaaagacatgacttttgtttttaatcaaattggtagtcatcatattcattttagaaacccaatctatgtgttaaaatagcattatgtgaagattatttaaaatagattttctaggtgtggcagagttgctctaatattattcattattgtctatttaatgtatttttatgtcctgttgatgtctgtctttttcttctgtgatgtaacaatacaatcacataatgatctgcacacagcactgttaccagtttagcatttgcggtgttagttctgctgatataatcaactatccaatctgaatcaagcaatcattgaggaagaaacatttatatcaattacaattgttctaaatgattattaataataagcaatattattgaaaatgtttaggatcaaatccccagtatctctgtaatatagacatgtgtctgcttgatatttgtctattctgtgtattttttcccacaagttaacgttaaaagcagaaagttatatgctaccaaatctaatgaattatataggtcacagtaaactctctactaggcatacaaaagatctattaacctcaaaaaatatgtcatttaaaaaagaacacagccaagagagtcaagataacatactgtgatagcttagaatattctataagatggtcctttctcattgctgagattacacctaagtttctgttactttaagtttcttcaaaattaaggtttctattgccaacttccatgaaacctaaaaataattacaaaaattacatcacaaagacaaccatgtaatgttatgtttctagcttcctgtaaccatctggaatattactaaactaattctccaatacagatacactttgcataagcacacagaactatgccatgaataatatcctatttgcagtttttgacccaaatatttctcttttactttctcatttttaatagggacataattcataatagtaacagctaacatttactgtaatatatgtccagcactatccttagtacttatgtatattgacttggtaaattttaacagtaattataaagaaagcactattattatatccatcaccattatcagatggggaaacagagccatataaaccttaagtaacttgtctaaagtcatacaggtttatgtagtgaaattcagatttgaacatgggcatcatagtttaagtccttggtgctaaccattactctatcatccctcttaattttacaataagaaaataaaaactcaattagaaaagaaaagtaactgacagtggtccacagtagtaggaccatgggaaactggagactatatgattcactgaaagaagcagatgctatgcagttccagctaactgttgtcatgtagaaatgtattgggtcagtatttcattttaccctatctataagctagtaagttaactggttactatttcatgatactggcaaaaagaaaaagagattcctgggtcagatacgaattaactttgttactcaaagcacagcaagcagtatggtcaaaagtatatttgtatcagttctcttttcttgtcacattacaatgagcccttacccagatttaaagtaagtggtttctaaatgatgcatacatagaattacatacacaaaaggaagctattcaacagtcattaaagctttgcattttatactcctctaattgcatcaattaagtgacatttccagagaatcatgcttcataaatcaataatttcagatttatttacaattagcaacaatgacaaacagctacagtacattctgctgtaaaagcattacatagataaggactctgtccctagtaaataccactagtgtgattgcaatgatatctctcattaacatatttataaagagtttggatcaggaaaaaaatcatatgatcatctcaatatattcagaaaaacatttgacaaaacccatatccatttataacaaatctttctgaaaactaggaataaatgggaagctcctcaacttgaaaaataacatctacaaaaaaccaaagatagcctcatacttgatgttgagacacgagatgcttttctcgtaagatcaggaacaagaaatgaatgtctcttctcaccactagtattctatataatagtataagtcctagttaatacaataaaaaagaaaactaaataaaagtatataaattgggaaggaagaaatacaattttctttgttggaaaattatatgttgtctatgtagaaaatttcaaagaaacaaaatctttctggaactaataagcatctatagcagagttgcaggatacaaaacatacacaaaagtcagttgctttcctatataacagcaataaacaattgaatttataaattaaaacacaatgccatttatattagcttgcaaaaatagaaacatttacctttaaacttgacaaaataggtacaagagatatatgagggaaactatgacacatttatgaaataaatcgaagatataaacaaagaaatatttcaagttcatgagtaaaaacgctttattaagatgccaattcttcccaatttgatctatagatacaatgcattcccagtcaaaatctcagaaagttacctggtggatatcaataaacattctaaagtttgtatagaaaggaaaaagatccagaatagtcaacataatactaaagaagtagtcagaggactaatactaccctacttcaagtctaactataaagtataaagctacagtgatcaaggcagtgtggtatcagctaaataaattaatggaacagaatagggagcccagaaatagaccaacacaagtacagccaactgatctttggcaagggagaaaacatttcagtggagacaggataatcttttcaacaaagaaaaatggttccggaaaaagtggacattcacacgcaaaaaataataagtaagaacctagacagagaccttacatcttttacaaaaagtaactcaaaatggatcgtagacctaagtataaaatacaaaaccatacaacgtttaaataataatataggagaaagtctaggagcaaatttttgcgtttgcaatgaatattagatacaacactaaaaacaacacatataagcaaaaatttgataagttgctcttcattaaaattaaaaacttctgctctgagagaaacactattaggagaatgaagagacaagccaaaaattggaagaatacattttcaaaacatatatattttaaacaaaggacttttatccaaaatatacaattttttaaaaattataaaataggaaaaagatatgaacagacacctcactaaagaagatatacagatggcaagtaagcatataaaaagatgcccaaaattatatgccatcagggaattgtaattttaaaacaataataaaatacaactacatacctatcagaatggccaaaatccaagacactgataataaagattattgatgaggatgtgaatcaacagggatcctttcattgctgatggaaatgcaaaaggtacagccactttagaagacaatctggcagcgtcttatgaagctaatatagtcttatcatatgatgcaaaaatcacacttgtatttacccaaataagttgaaaatttatatagacaaaaaacctgcacatgaatgtttataagaactttattcataattgtcaaaattggaaacaaccaagatgtccttcaacaggtgaatggataaactatggaacatccacacaatggagtgttactcagtgataaaataaatgcgttatcaagctatgggaagacatgggggaacatgcatatgaagtgaaaaaagccagtctgaaaaagctatatactgtgtgactgtatgatattcttgaaaaagcaaaattacagagatagtaaaaagatcatgattgccaagtggtcagaggaagggatgcaggcatgaataggtagagcatagagctttattaaggcagtaaaactagtaggtatgatactgtatgggagatacaggacattatgtatttgtagaaacccatagaactctacaacacagagtaaacactaatgtaaattatggaatttatttaataataatgttttaatattgttaatcagttgtaacaaaactatcacactactgcaagaatttaataacagcagaacctggggttctaatatgaagactgtgctttcagcaaaatatttctgtaaacctaaaactgctctaaaaataatgtccatttttgtaaaaaggcaaggagagcagtctgactaatacagtgtgcaacacaaagaatagagaatagtattaggtcagactatattaaattgtcaatatttaacatggttgaccctcaaaattcataatgtcatatgatttgtataattgaattgtagatgaggtcagagaacgtggactgtttaggggcaagaaaaagcatgttacttatttcagataacaccactcagtcttcaaatgcactccttataaaatggaaatccactaaatgttctcatgtcatgaacacggtgtcctgtctgaaaattattaatgttggattaaagttttcttctcctttcaagatgtatgtcttccaagatgctcctttcctttttctttttcttttcctctttctctctctctctctctctctgtctttcatattggactcaattgtctattgatcctggagggctcatttgattttttgccccacacccgtaggaaactaaaagttgattagaaactctctgggcatggctaaggcttctcagcctaatcttggatgttgtggcttagccatttcattagcaaaaacctcaatgttaacacctttcagtttgtttttgcttcttgttttaattagggctgttcacttcctcagagaagaattttccgttcttctgctggaggttagaatcctggaatgccagccttccagaggcaaactgggagaaggctggtattctcaagttgtaatgagtattcgttcacatactccccaatctttgaaacgtgactcctcccctttaaattctgacaatgttaaaattatttgttcacaaataatacttttatttcctggatgattttaaaatcataatttaaaatcattttttcattagctaaggattctgaaaccccatttgataaaacatatcacggtagtaaatccattgcacttagtgttatggactaatatttactttttctctaaaattattattttttataactaatttcccaagcgtaaattttcattttctctcaaatgacatagctaacattttattttattttactaattattattattattattatttttttttttgagagagagagtgagtctcgctctgtcgcccaggctggagtgcagtggcgcgatctgggctcactgcaagctccgcctcccgggttcacgccattctcctgcctcagcctcccgagtagctgggactacaggcgctggccaccacgcctggctaaattttttttttattttttatttttagtagaaacggggtttcactgtgttagccaggatggtctcgatctcccgacctcgtgatccacccgcctcggcctcccaaagtgctgggattacaggcatgagccaccgtgcccggccctaacattttaataagctctctgatttaagttcagaaccaatagaataagtacaagtgtatgcactgaatcttttttttttttcttttttttgagacagagtcttactctgtcacctaggctggagtgcagtagtgcaatctcacctcactgcaacctcggctcactgcaccctttgcttcctgggttcaagtgagtctcctgtctcagcttccagaatagctgggattacaggcgcatgccaccatgcccagctaatttttgtatttttagtagagacagggtttcaccacgttggccaagctggtctcgaactcctgaccccaggtgatccatcagccttggcctcccaaagtgctgggattacaggcatgagccaccacacccagctccatgcattgaatcttaagattctcagcctttttattccacctgactgtgtgaaatgagagagatttgaggatgaatttacttcttaaaaaattagctggacaaaattagaactaaaaagggaactttagaatatattataatttatatataacataaaaggaaaagaacctgtatatgttctaaattaattttttggaagcacttcctttacagtgctagtttagtcttctgcatgccatggatgttcaataaaagaataaaattagagagtatattaaaggataaaattaagtattcttaaactcccaaattttatgacttaaatgcaatcttcataaatgtatataaccgagaagttgttcaatcttaatatttagtgcttctgagtttaacttataacatttattcaaacactaggatatagtttgaacaaatatttatttaaaacccaaatgatgaaaatctttagtaaatttctaaaagtgagtttagctagaaaattaagaaatctgaaaatctgctttttttaatgtactacttctaccaagttattgagtagcttatacataggtggaattataaatattcatcaaatatcttaaatataataaagttcaattagggcaagttcacattaaagaaaataaatgtataaatacaaaaacattagattcttaagaaaacaattcagagttttttgaaaatgataatgatgccaaggtttttttgttttgttttgttttgagacagagtctggctctgtcacccaggctggagtacagtagcgcaatctcggctcactggacgctctgcctcccgggttcacaccattctcctgcctcagcctcccaagtagctgggactacaggcacccgccaccatgcccagctaatttttttgtatttttagtagagatggggtttcaccatgttagccaggatggtctcaatctcctgaccttgtgatccacatgccaaagtttttaataagatcttaggtcttacttatgtccaataggtatcagattatgtcaaaagttcaggtcacatgtttctctgatctttcagcagtcaaatgaaattagtggatgtacagaaatgaatatagtaagaatcttatagaataatgaagaaaataaagattaactattacaggataaactgacagcaaatgtattcattcaccaaataataattaaaaaattattttctggtataataaatctaccaatttaaggtctttccttcactctggaaagagatcagaaagatatatacatagcatttttagaaattaatttaaaaataaactaaaacactaatctttgcaactaacctattttctgctatagaaataaaataattttaaaccctatttgttacttcagtactgagtgctatactttctcacaaaagaggctaaataacctctacatacaactgaatgtgctgtctgaggtggttttacttgtctagtcaactttttggtcacaaaaaagaaaataatacaaaactgagagcaaagcacttaaggttttaaaagaaatgatgtaaaactttttgtatttataaaaagctacttatccttatcttccttctcatcaagaaactaataaacatagtaaatattttgctgtttattttttataataaacacaataaatattttgactaaatataaagcagcatgtgtcacatgtagataaaagttatatttaaaactgtcatatatacaggaagtatatttaggagatttacttctctctctcttactctctcttaacagtttattttaattacaaggggaaaatgttgcaacaattgatcagggttgtgatacttgcgattttgtatacaaaaacaattactaataactttcaaatagggaagtcgattgacattttatatgactattaaatggtgcatttgctagaaaagttttttctcctctttggaagaaaacaaatgttaatgaaaatttaataataacacaaggcacaatagagagaatgaatgatatcataattctaattgtagaaatgttctaaataaactgttcataataaacaacctttaagaaccatatttagtttttaatcatttaatactatttaagacacaagtctctcaaaaggaagtcttaacttgaaaattcttcagttttcataaaaacaaattagaaagataattaagattgtcttaatttttttacctcaaaattttacaagcatagaaatctctaaaacaatatatatcttctctctccataattttatgttgcataaaatcatactcaaaaggaattttccatttttcttttgtattataattggaaataatttctctaaactcctcattaatatttcagagttcaggggactgaaaactaattttacactttaagcatatttaaatcaataaagcagttactgaagcaatatcactttatctagaccagcactttctaaatacagcttccaataattaaagatacaaaagtagcactttacttttacaaggtgaaaactgtcatcaccttttttctcagtaaattagagtaattgattttttttacattttactgacaacagctactcaaaatgacttatatatttcagactcaggataattaagttcaagctatcatatccgagtcaattatcaagaaattaatgttttccaggacacaaaatggactatgttacaaaactgtaggccactgacaacaggaggtagccagaaggtagccacttttagtcctcagggcaaaaccagaaatctatacgggcaaatcaatactaatatagtaccaccaagagtaggcaataggtcctatgtatataaactgaggaccattcctgatgtataatgattatacaaactgatagggacaatctgctccaaggtccaatattcttaaccagtactgagaaaagcaatcacctaacatctctctccataacatatttagcaaacaactcactcgggagaaagagagtttaggtgttcaagcttgtttaagcaaccctggttgaatataggtgctattcatttagatctgtggctgttaatttacatgattccattaatatttctttctttcaacttcctctaaagctaagaaagaaagctgcattaaaaaaagaaagaaacagaaaggcaaatagcaaaacttgggactctgaaaaactgtgagtagaagaacatattattttgttgccatacccactgttcttcaagagtagaattgttaaccatgcacttaaacaggttgaatcaatcctctcagaaatgactaggtcaatatcaatgacagaatccatgaagatgaaacattattgcacccgagtgtcaatatcctgtaagaacgcaattagtgtgacttttgaaatggcagttaggaggcaggactaacttgcagctcccacttggatggacagagcagcatatggaaacctacattatgaactttttctccaagaactaccacaggaagctatcaggaaaactgagagaatccacagaccctttgaaggaggtggattgccactgcaggctccatgggacagctgaggaactgtcccatgggacagtaagtcagtttgctttctcagctgggagtcttatggcctggggcaagttttaagccctgttcaccagctgcctcgaaataaactgtgctgttgtgggggcatgatgaaagtaataccagcctttcagggtacaggctgcgtgggagctgggtgaggcctgtggctgttggctttcccccacttccttggtgacctgtatgatgtagcagaggcagccataatccccctgggaacataactctattgtactgggaaccacaactccacttctcacagcagacccagcaagccctgcccaaggagagtctaagctcagacacacctaaccctgcctccacctgatgatctttctctacccgccctggtagcacaagaaaaaagacttaatcccttgaaagttctatggccctacccaccacctaaccctagggcaagcttgaatcctccctatacaaccaaagctgatatgctcttgaaatcaccaactcctggctggaggcaaaacgatacaaaaccagtccacgtaacaaggtttaaggaccctccctgtgtccacttcacttcctggctacctccaccgggagtaggtgttgctatccatggctgacagacgtgaagacgaatcatatcacaagactctttgcagacatccccattaccagcccagagcctggtagcttgactgtgtggttagatccagaagagaaataacatgctctcagaaagccccatccctggggaaaggaaagagcactgcatgaaaggagcaccctatgggacaaaaagacaatctgaacagcagccctcaagtcccagattttccctctgatatagtctaccaaaatgagaaggaaccagaaaaacaactccagtaatatgacaaaacaaggttccttaacactcccaaaagatcacacaagctcaccagcagtggatcaaaaccaagatgaaatttctgaattgccagaaaaagaattcagaaagttgaccattaagctaatcaagaaggcatcagagaaaggtgaagcccagcttaaagaaatcaaaaagatgatacaggatatgaaaaaaaaaaaaaaaaaacctcaagtgaaatagatagcataaataaaaaccaatcacaacttctggaaatgaaggacacacatagagaattgcaaaatgcactggaaagtctcagcaatagaatcgaacaagaaaaagaaagaaattcagatattcaaagacaaggctttcaaattaacccaatctgaaaacaacaaagaaaaaataattttaaaaaatgtacaaagcctccaagaagtctgggattatgttaaacaaccaaacctaacaataattggtattcccgaggaagaagagaaatctaaaagtttagaaaagatatttgagggaataatcaaggaaatcttccccagccttgctagagatctagacactcaactacaagaagttaaaagaacatctaggaaatgtattgtgaaatgatcattgcctaggcacatagttcatcaggttatctaaagtcaaaacaaaagtaaaaatttaaagagctgtgaggcaaaagcatcaggtaacctaaaaaagaaaacctatcatattaacaggagatttctaagcagaaatcctacaagcgaggagggattggtgtcctatctgtagcctccttaaacaaaacaattatcagccaagaattttgtatccagtgaaactaagcttcataaatgaaggaaagatacaatctttttcagacaaacagatgctgagagaatttgccactactaagccagcactacaagaactgatacaagtagctctaaaccttgaaacaacttaaaatacaccaaaatagaatttccttaaagcacaaatctcacatgaccaataaaacaataacaatgataaaaaaaaaaaaaagaaaggtattcaggcaacaaatagcatgatgaatagaatagtacctcacatgtcaatactaacattgaatgtaaatggcctaaatgctccacttaaaagttacagaatggcagaatgagtaagaattcatcaaccaagtatctgcttgtgagtataaggactcacataaacttaaggtaaaagggtagaaaaaggtatcccatgcaaatcaacaccaaaacaagcaggaatagctattcttatatcagacaaaacaaaccttaaagaaacacagttaaaaaagacatacggaaattgtaaaatgataaaaggactactctaaaaggaaaatatcacaatcctaaatatatatgcactaacactggagatcccaaatttataaaacaattactactagaccaagaaatgagatagacggcaatacaataatactgggggacttcaatactccactgacagcactagacaggtcatcaagacagatggacttaaactgtaccatacatcaaatgaacttaacagatatttatacaacattctacccaacaattgcaaaatatacattctattcattagcacatggaacattctcaaagacagaccatatgatagaacacaaaacaagttccaaaaaaattcaagaaaatcaaattatagcaagtactctctcagacaacagtggaacaaaattggaaatacattccaaaaggaaccctcaaaaccatgcaaatacatggaaattaaataacctgctcctgaatgatcattgagtcaacaatgaaatcaagatggaaattaaaagactctgaactgaatgataatagtgacacaacctatcaaaacatctgggatacagcaaaagtggtgctgaaaagaaagttcatagcatcaaacacctacatcaaaaagtcttaaagagcacaaatagacaatctaaggtcacacctcaaggaactagagaagtaagaacaaacaaaacccaaagccagcagaagaaacgaaaaaacaaaattagagcagaattgaatgaaactgaaacaaacaaacaaacaaaaaacaaaagataaatcaaacaaaaggccagttctttgaaaagataaatataattgatagaccattggtgagattaatcaagaagatagaggatccaaataagctcaattagaaatgaaatgggagatattacagccaatactacagaaatacaaaaaaaatcattcaaggctgctatgaacaactttacatgcataaagaggagatggataaattcctggaaatataagaccctcctagattaaaacagaaaaaaaaatagaaatgttgaacagatcagtaacaagcagcgagattaaatggtacttgaaaagttaccaacaggccaggtgcagtggctcacgcctgtaatcccagcactttgggaggccgaggcgggtggatcatgaggtcaggagatcgatatcatcctagttaacacggtgaaaccccgtctctattaaaaaaaaaatacaaaaagttagctgagtgtggtggcaggcacctgtagtcccagctactcaggaggctgaggcaggagaatggtgtgaacccgggaggcagagcttgcagtgagccgagatcatgccactgtactccagcctgggttacagagcaagactctgtcacaaaaaaaaaaaaaaaaaaaaaaaaaaaaaaaaaaaaaaattagcaacaaaaaaagtccagaggcagacagattcacagctgaattctacgagacattcaaagaagaattagtaccaatcttattgacactattgcaaaagatagagaaagagggaatccttcctaaatcattccatgaagccaatgtcaccctaatagcaaaaccatgaaaggacataacaaaaagagaaaactatagaccaatgtccctgatgaaaatagatgcaaaaatcctccaaaaaaaaaaaatagtagctagccaaacccaaaagcatataaaaaagataatccaccgtgatcaagtgggtttcatatctgggatgcaggaatggtttaatatctgcaagtcaatatgtgtgatataccacataaacagaattaaaaacaaaaatcagatgatcatctcaatagatacagaaaatcatttgacaaaatccagcatccctttatgattaaaaccctcagcaaaatcagcatagaaggaacataccttaaggtaataaaagccatttatgacaaacccacagccaacattatactgaatggggaaaagttgaaagcattcttcctgagaactggaacaagacaaggatgcgcactttcaccacttctattcaacatagtgctggaagtcctagtcagagtaattagataagagtaggaaatttatttcttcatccaaattggtaaagaggaagtcaaattgttgctgttcgctgatgatatgacagtatacctagaaaaccctaaagattcatccaaaaagcccctagaactgaaaaatgaattaagcaaagtttcaggatactacatcaatgtacacaaatcagtagtctgctatacaccaacactgatcaagctgagaatcaaatcaggaacacaaccccttttaaaacagatggaaaaaaaaaaaaagaaactacttaggaatatatctaaccaaaccaaggaagtgaaagacttctgcaaggaaaactacgaaacactgctgaaagtaatgaaagacatcacaaatggaaacacattccatgcccatagatacatagaaccaacattgtgaaaatgaccacactgccaaagcaatctacaaattcaatgcagttcccatcaaactgcattgtgtgtggagactccatcattcttcatagaactagaaaaaaaaacctaaatttcatatgaaaccaaaaaaagagcccacatagccaaagcaagactaagcaaaaagaacaaatctggaggcattacattacccaacttcaaactatactataaggccatagtcaccaaaacagcatattactggcataaaaataggcacatagacaaatgaaacataattgaacataattgagaacctagaaataaagccaaatacttacagtcaattgatctttgacaaagcaaacaaaaacataaagtgtggagaggtcaccctattcaacaaatggtcctgtaataaattggcaagtcacacacagaagaaaactgaatcttcatctcttaccttatagaaaaataaactcaagatggatcaaagtcttgaatctgagacctgaaaccatacaaattccagaagatagcattggaaaaacccttttagacactggcttaggccaagacttcacgactaagaacagaaaagcaaacacaataaaaatagagataaatagatgggacttaattaaactaaaaagtttctacacagcaaaagaaataatcagcagagtaaacacaaaacccacagagtgggagaaaatcttcccaatctatacatctgacaatggactagtattcagaatctacaaggaacttaaaacaagtcagcaagacaaaagaaaacaatcccatcaaaaagtgggcaaaggacaagagcagacaattctcaagagaagatatacaaatacaaatagccaacagacattaaataatgctcaacatcactaattatcagggaaatccaaatcaaacccacaatgtaataccaccttctcctgcaagaatgcccataatcaaaaaaattaattttctgctcctataattgaggcataccaccctcaaaaaactatttgtaaacaggattggacctggccagaaaaaatgaacatacttgtttgggaagattgcattgcagaacaggcataggtgctgtgcaaggattcctgtggaatcattattgattggtcccctaagggaatgtttagcttgaattgcacctctctgtctgcatgccacagccacactatgttcacctggtctaaacaaaatggtcagatagtagaaatggtgagaagtacagcaagaccttattatctggaaacatggtggtatagtggcacctcaacctcaaataatatggcccactgtgggagctaaatataaggatttgtgataactattaatggctcttaataagatcaaaatttgggaaagaattaaaaagcatctataaggacactctacaaacttgtctttggatgttgcaaaactaaaagaacaaatattaaaagcatcccaggcacccctgaccttaatgccaggaactggagtgcttgaaggagctgcagatggcttagcagctagtaacccattacaatggataaaaacacttggaggctctgtgatttcaatgatgattgtgcttttaatctctgttgtttgtctttgtatagtctgcagatgcgaatcctgattcctgcgagaagtagctcactgtgataaagccacctttgcttttattgtcttgcaaaaacaaaaagggggaacttgttgggaacaggcccccaaatctggctataaactggccacaaaactggccataaacaaaatccctgcagcactgtgatatgctcgtgatggctatgacacccatgctgaaggttgttagtttaccgaaatgagggcaagtaacacctggcccacccaaggtggaaaactgcttaaggtgttcctaaaccacaagcaattgcatgagttatctgtgccttaaggacatgttcctgctgcagataattagccagaacccatccctttgtttcggcccatcccttttcttctcgtgaggaatgcttttagttaatctataatctatagaaacaatgcttatcactgccttactgtcaataaatacgtgggtaaaactctgttcatggctctcagctctgaaggctgccagccccctgatttcccactccacactctatatttctttgtgtgtgtttttaattcctctagcaccactgggttagggtctccatgaccgatctggtctcagcagcatccctttgccttcagcaagaacctcagcaggtcgtggttattttcttggtggagtgactcaaaccttcattcctgaagggtctgggccatttgtatttctgcctggattggcagaactgttggagtttcccattaagcttaatcacagggcatggcaatactaagagacgccctaatggatctcctgtattccatccatactcttccttaccaccgttgtggagtagtagactgatttcatcttgataatctgcatcagtaactccagcgaacactgtaactccattcttagcctgttgacttaaaggtaggaggagcacaaagtgtccaggtggcaatcttaacttccaatttaatggattcattgttgtgtctcctggtggcagcattcctccctctggaactaagacctctaggctagcaaaatgtaatgtcgtgagaacaggaagcaacaatgttgctagtggtcactaaggttgatgatgagtgacgccacttccacttccaccccttgattcctggccctgtgaatcctggctatgggagaaacaatgccatatattggaggctgattcagagcattcatggccttctggaatactttgccagagcccggcaaagtattgtcacctagtcggcgttgtaattgtgacttcaaaaggccattccactattctatcaatccagctgcttcaggatgatggggaacatggtaagactagtgaattccatgaacatgagcccactgccacacttctttagccataaagtgagtgccttggtcagaggcaatgctgtgtggaataccatgacagtggataaggcattctgtgagtccactgatgatagtcttggcagaagcattgcatacaggataggcaaacacatatccagagtaagtgtctattccagtgaggacaaacctctgccctttcagaagaggtccaatacaatcaacctgctaccaggtagttggctgatcaccctgaggaatgtggctatactgagggctcagtgtcagtctctgctgctggcaaattgggcactcgacagtggctgcagccaggtctgccttggtgagtggaaatccatgttgttgagcccatgcataacctccatcactgccaccatggccactttgttcatgggcccattgggcaataactgaggtggctggggaaagaggctgagtggtatccacagaatgggtcatactatccaattgattactaaaatgctcctctgtcgaggtcacccattggtgagcactcacatgggatacaaatatcttcacaatttttgaccactcagagaggtccatccacatacctcttccataaatttctttatcaccaattttcttatgcttcttccaagtccctgaccatccagccaaaccattggttacagtccatgaatgagtatataatcgtacatctggccatttctccttccatgcaaagtgcataaccaggtgcactgctcaaagttctgcccactgaggagagttcccttcactgctgtccttcaaggatgtcctagaaagaggctgtagtgctgcagctgtccacttttgggtggtgcctgcttatgatgcacaaccatctatgaaccaggccctagtcttctctttctctgtcaactaatcataaggaactccccatgaggccatcagtgcaggctggaggagacgaggcagtgtggcatcagtggagaccatgggcatttgagcacttcctcatgtaacttacttgtgctttcaggacctgcttgagcctgatcacttatatgccactttcatttaatgagagaatgctgctgtgcatgacccactttatggctacatgggtcagaaagcacccagttaatgataggcagttgaggtcatgtggtgacttgatgacccatagtcaaacgttcagtttctaccaaagcccagtaacaggccaagagctgtccctcaaaaggagagtagttatccacagatggcagggccttgcttcaaaatcctagaggtctctgctgtgattcacctatgggggactgccaaaggctccagtcatcatccctatctgccactgataccacaaccaattggatctgttgagtcatatggccccagtggcagagcagcttgtacagtagcctggacctgttacagaaccttctcctgtactggactccactccaaaatagcagccttttgggtcactcaacaaatgggccagagcaatacacccaaatgaggaatgtgttgtctccaaaatcccaataggtgcagtaggcattctgccactttcttggttgtagaaggggtcaaatgcagcaacttatccttaaccttagaaggaatatctcaaaaggccccacaccactggacccctagaaattttactgagggagaaagtccctgaattttagtcagatttatttcccattttctggcatgcaagtgtctcaccaataagtccagtgtgtttcctacttcttgctcactggatctaatcaaaataatgtcatcagtgtaatagaccagtgtgatatcttgcggaagtggaaagtgatcagggtctctccaaataagattatgacaaaaagccagaagttgatatacccctgaggtaggactgtaaaggtataatgctggccttgccagctgaaggcaaattgcttctgatgggccttatggacagggccttatgcagctcctgagtcaatggctgcatagcaagtaccaggagatgtgttaatttgctcaaatcaatgaaaccacatttggtacagcagctgaaattggagtcaccacttgattaagcttataataatccactgtcattctccaagatccatctgtcttcctcacaggccaaatgggagaggtgagtggggatgtggtgggaatcaccacccctgcatctttcatatccttgatagtggcactaatctctgcaatccctccagggatgcaatactgtttctgatttactatttttctaggtagaggcagctcttaatgccttccatttggcctttcccaccatagtagccctcaccctaccattcagggagccaatgtgggggtcctgccagctgctaagtatgtctatgccagttatgcatcctggcactgggaaaatgaccacaagatgagtccagggacccactggacccactgtaagtcagacctgagctaaaacccctttaattatctgacctccataagcctctactttaactggaggaccacgatgacatattggatcccctgaatcaatgtcagctcagagccagtgttcagtagtccccaaaatgtctgataatttccctttccccaatgcacagttaaccagaggtctccatggggaaggatggaaaaaagattaacagcataaattgttggtagtgtagtggggtcctccctcaaggggacccagcctccccatcattcaaggggttctggatctgtaaacctgctcaagtctggaaattgattgaggggccgtgattctgtttttataattcaaattagtcttttgtccattcaacctagaaggtttctgcttatataaattaagtaggaatgcagtaggcttcctgtcaatttcacttctaggaaaaccatgattaattagccaatcccatagctctacataagtcagactattctgactgctgctttgtctctgctgtccatcacagtagctacgaccactttgcctttgacagttgagtgccaccacttggcccctgccaccttgggatccaattactcccattatatttaaattttgtagttgagtgacggtggttcccattgttagatgtgacatacagagaagagcaattacagagctcttcaaagatgcaggtgctaccctcacaaatctgtttcacaacgcattgttcaggggatgtcttctggatcctcccagctgggatgagtaggtctaaagactaatccattccaccttcccaatctctctaagcatttggatcccttcctctacatcaaaccaagggataccacacatttccagctcacttacagtgggccatcttttaatccatatttcagctaaccatgcaaataagctattagaaccttttttaactccctgagctgcaacattaaatgcagagtccccacttagtgggcccaaataaataaattcagcttgatccaactctatgttcctttcaacattatcccacatccttaatatccattcccatgcctgttctccagatttctgtttatataagttaaaaattcaagcagttttttcaagtgtaacacaccttctcatgggtcaaaccctcaacctcacctctagtgacccactgggactttaatctagttataggtctagaagcaaatgggggcattaggggtggctcctgaagagaatcaatattatctttcctggcaactgtctcaccggaggccatcactgttgcctcaggtagtgcagggtttatctcctcagacaaaggtggaatggctgatggcagcatgggtcaagaaggagatattgccactactggggatggtgaagctgtttgttctggcaaaaaagcttcaccagagtttacaagctcagtgtccccagcttcatcagggtcctcccacacatccccattcaaagttgtagggtcccattcttttccagtcaatgccctcacattaatagtagacacctggtgaggctgtgcctgcacctttcgttgcacgtcagccacttgcatgataagagcttgtgtctatttttccacaatttcaggtctttctctacaggaggtaagactctgactcagggcaatcttagcagatttgaggctcagtatctgcttctgaggctgggagttagaatccgtagattcatcattttctttcattactttgttcactgaagtttggagcaaccaaccagcttcattatgttccttggttctccgcatatggtcaaaagtattaggtatagactgactagactccttgcttctcacgagcagtgaatcaggagtgtcaaatgcatttattttgcacagctctctaaacagttcatgccaaggactatcagtgttctccatattattagaagtagaatcttagcattttgggatctaatcatattaagcagccaactctagaaccccaaaaccagcaaaagaactcgatccttaatattctgttcttctagaaccacttgtgttaccaaaatctgtattagtcagggttctctagagggtcagaactaataggatatatatatatatcctattatatatatatactatatataatatgatatatgctatatatatacacacactatatatatagtagtatatagtatatatatagtatatacagtatatagtatatagactatatactatatataagtctatatactataatatactatatatactattatatttagtatatatagtatatatatactataagtagtgtatagtatatatactatatatattatatatataaataaaacatatataaataaaacatatataaaatatatatagtatatatatttagtatatatagtatattatagtatatatatttagtatatataatatattatcgtatatatatagtatattagcatagtatatttgtgtgtgtgtgtatatatatgtgtgtgtgtgtgtgtgtatatatacatatatacacagggggatttattaagtattaacttacataatcacaaggtcccacaataggctgtctgcaaactgaggagcaaggagagccagtctgagtcccaaaactgaagaacttggggtctgaagtttgaaggcagaaagcatccagcatgagagaaagatataggctgtgaggctaggctggtcttatcctttcacatttttctgcctgctttatattctagctgtgctggcagctgattagatggtacccacccagattaacggtgggtctgcctttccagcccactgactcaaatgttaatctcctttggcaacaccctaacagacacacccaggatcagtattttgaatactctgtatccttcaatccaattaagttgacactcagtattaaccatcacaccatgaaagagtttatgaactccatgtaaatgatccataacatataattatccaaatgatctttctgggctgaaagctatccttaagatacaaagatctttctctattccgatacaagaaatacttccataatatgtctggattcctctcaacacaacccagagaagctcatacctctgacagatatcccaaggcctaataccataggctgaaaatagattttcccagacagaacataatctgtctcctaaaatttaatgacctaggaagttcaaaagaatatcaagagttctgtcagaagaaatgaaggaaaagaattaaagcaaggttgtagtccatggagagtcaaagacctttttagaatggcaaatgacaggtagcttttaaacattcactttggggtattaagtaatgtgccatgacctttacaattgaagtgcaaaaccaatttctaaaaccaaaagtttaaatcacattttcaaataacataaaatactgtcccacaaatattaaaactacagtataaaagtgagtttgtaaacggagaagtttaagtcacattctaaaatatatttcatagctacaattgaaaattttccacaaagataatatgaacattagaaataaacttagaaactgtcattcaatattaaaaagcatatataatttaaatcatgctttatcattccttataagaaatttatcaagaaaaaatatggaaaaaatatcttaaaatattaaaaaataaaacactgggtgttgcttgatttgtattaatatataacactataattctactcagaaatctttggtgtctatagctcagaggagaaaattaaaactgcatattttgatactctttgtgatctaatactatctacatatctaatatcattctattcattttatattttagtaatactaacaataagcttgacaaggatattctattctccagtgcctctttgactttgcatatactgtttcctttgcctagaaaaagccccattggcttgtctaagtaaaaaactcccattactcttttatatttcatataaaatactttctgaagtcttactccctttgtctaacttagaaattcttttttttttctgagatggagtctcactctgttacccaggctggagtgcagtggcgcgatctcggctcactgcaacctccatctcccaagttcaagcgatcctcgtgtctctgcctcctaagcagctgggacaacaggtgcacaccaccacacctggctaatttttgtatctttagtcgagacggggtttcatcatgttgaccaggctggtcttgaactctggacctccgatgagttgcccacctcagcctcccaaagttctaggattacaggtgtgagccactgtgccaagcccagaaattcttaaagtgctgggattacaggtatgagccactgcacccagcccagaaattctttatcatattggtacctttcacctattaacaaataataattattttattataattaaaatgtttatatatagtttctccttactagattgctatatagttgagaatagagatttttcattttggactcagagcctataccatactaggatcatatttataaactagaaataaatgaatatagccatgaaacaaaggtaacagtaacaataacatatataacatatctaatatataataactataacatacagtcccactgtatatcaagtactgtaatacatgcttttttcagtatagatttgtactacatttatagcagtttttatccttgtatctgagctatcaagtgatcaaagtgcaatttatactattttctcttgatccaatgaatctaccttttccttataactgtagctttgaatttttctttttattcgtaagtagtggaactctttttctaacatatataatatataaagcataggaagggtagcccttctgaaaaaagcagataacggaggactagacacatatactcagcacccctctgcgagtagcttgtagggaccaatatagagactaatgccctaaaaaatttgtttccatctctacttactgtcaatccatatgttgaaatagtaacccctagtgtgatagtattagaaagttggcatttgtaggtcctgaggtagagccctcgtgaatggaattaggcccttataaaagagagctcctttgcccttctgccatgtgaggacacagcaagaagacagctgtctgtgaatcaggaagaagaccctcacaaaacactaaattttatctaggattttccagtgttcagagctatgagaaataaatttttgttgtttataaaccacccagtctctgttagtttgttaaagcagccaaaaccaactcagacatagagagaatggtagtctgaaaacccaacttggggcaggatgaacatttccaagaagaataatccactatattaaatgctgctgctaggttaagtaaaataaggagattcgacacaggatctaccacaggattgggcaaaagatttatgaaagtcattgatgagccatttctgtggagtagttggggagaaagccttacaagtgtcaaattaaaagagaataagaaaagagaaaatggaaacgatgaatgtatgctagtactttgagtagctttttaaagaagaaaatatagaaacaggggtttaattgaaggaaaaatgaggctgagagatatttttagatgagacgataggcaaaatggttgtatgtttacctgaatgatttggcagagagggaaaaatgaagtaaagggagaaattgctggtacaacatcattgagcagatgaagcaaatgagatctagcaggtaattaaaggtattaggcttaagtaggaggcaagacagttcagcatcaggaggagaagtggagtaaatatgtagaaatgttgttggggaaagtgatgtgctgataggaccatgtggaaatgataagtaaaatgtctgaaggcattaactaaaagagaatgagagagctgggtgcggtggcttaacgcctataatctcagcactttgggaggcaaaggcagttggattgcttccagaagtccaagaccagcctgggcaacagggcaaaaccccatctctgcaaaaaatacaaaaaattagccaggtatggtggtgcgtgcttgtagttccagctacctgggaggctgaggtgggagaattacttgcgcctaggaggtcaaggctacagtgaactgtgattgtaccactgcagtccaacctgggcaacagagtgagaccctgtctcaaaaaaatgaaaataatttcaataaataaaagaggatggagggaggggggaagtactagagattttagaacagagaaggtatgaaagagttacctatgagagtatgagaataactgcactagaaagaaatattgactggtgggcatcaataagggccttctgaatagtaattggatgaataataaagatgatagtccaaattataagtgaaaggaaggaaagaaagattgatgtgtcaaacctaataccaaagtaaaaatataaggtagcatagaatcgaagacaaaaataaaaaccatatccaaatcaaaagaaaatataaaggcattaaataaattaacttaggtatgaagaaacactaagcctaacaaaatgatttttaaaagtaaagacaatttttaatagattttaccaaacaagcatgcaaaacatggtaaaatttcttagataagttggtaaccattactatacagcaaatgagtggttatgttgaaattcaaatacaagtactttggtctgactttctactctcttaaatgtatactctaagctaatgacataaagggtattccaagattgatgtctttgatacacggcaaaaacaaacatgaaagtgcaactcatctaaagctaataatgtgaaagggacaaaaacacaactaaagcaatgtgggaatgtttttttaaaatattaccacttttcataatcaaatggtttttttgaaaaataaaatctaaaaaaattcacttggcaaaggaaacaacgtaaatagaccaataattatttaagaaatatgaaaagatattaaagtattaccacactaaaaataatttctaaaaaaattacagatatgtattaaatgccttataatatccaaaccaatgaagtaaagggaaatatggctggcaccactctttgagcagatgaagtaaatgagttctagcatgtaattagaggtattaggcttaaataggaagcaagccttgtttgccagtgattctaagaatttttccttaagaaataatcaaaggtaggaacaaagatcaggtataaaactatctttataaggctatttataataatagaaaaattgaaaactttttaaagatctcttgctatactcccaataaaatatctttctgccatttaacattatttttctgagaatatgcaatagagaaaatacttttttctattttttggtgaaaatataattaaattacatatatgttaatgcattttctcatttctatagtataaaattattctatcccataattaaaaaaaaatacctactaattccttctttaaaattacccagaatgagggttttagacaagtgggtaatctgctaacaaaaggattttctaaataaattcctttataattttttcatttgagtaaaattttcttttcataaaaatatatctttgttaatttctgtactacttgaatagatatttaaatgaaactaattgcactacagatttttctcttgtgccttttctaaattttcatattcatgggatgtttatcaatctaaaatgtgatgtgaagtctgaattcaaacttctaagtgcacaattttcatcaaaagaatttcaaagtaatagaaagtaaatgactcaattgaattaattagtactatcacatatgcatcaatttctagtttataaaatcacagccaaataagtgttttttttaaatacagttgactttaacaaaaaggtgttaatctatagtaataaacaataagaatctcaatttttaaatttagaactgaaaataagtaataaactaaacctacagtgtgattccaattctcaacatgttctggatttatacatgttaatattttatctcacttatattgtcctacccaattctgctattaaaaattcactctgaaattaatctctaattgagatttttcaagcaattatgtaacctgcaaaaattaaaaattatactcataaaatgaattgttattgaacttcaattaatttcagcagaatttttgcttttttaagagatatatttaaatcttttctaatatttaaaggattttatgacattaaattcattgaagtttcttctatttagctttttaaaatattctcacatagtcactgtataatttaaatttcagaaaatcaatatatttgaagcaaataaaaaatcagtatatttgactcgatcattgtatttgaagccttatctaaaccttaaaaaaacagttttttggtcaagagactgattcaacaagagaatgtgaatgaatcaataaaatttactgttattttaaatgaatatacacatattcttttcactgagaactaagtcaatgaggaaaaatttatgtctagataaaaattagtgatttatgaaaagaaaatcctgattttccattttgctaatttattcaataaacatttattaatatagtattaggtgccagattctgtgggtggaacctgaatcatatacaattaaataaatcattgccttcatgaagctcataatgtaatattgagagttctcagttgaaattataagtgaacttttatagattaataaaccttctaaaattgtatgcacattttttatgagtatacacacattttctccctagcttttattagatcttcaaaaaggtcaatgatagtaatccaataaatatcaataactaaaaggagcaaagacaaacagcttagctagtaattgaaataagatgggcaaagtaagatatattccaaaagcaactctgaccttcctccacccatcaaaaatggagagagaactaaatctacctggggaactccagagataatttacaaaaaaatgaaaatagcaagcagacattacaaatataggtgtacaatttaagaagcctccagatttttgcaaatataattgtatggaccaccagcattggacagttggggatcctttgtggacataagacattaaaaatgtataactatctcaatggcagatcatacagctaagtaattttcaagtataactgaattgcaattctaaatcaatatcatgcatttctagaattatcttttcctgttaaaaaacgtaaaaagtttacagcaaatatgttctcaagagtcaccaacttaaacttattaaagtcatgagagactgtcaaattaaaataaaagaacaagttaataataaagagacctagtaatttatcaacccatcaacttaaaagtaacttctttaaagaaggaaaattatgaaaaaagtatttattgaaaaaggtttttaattattcaaggaaataaattggtgttgagaagacaaaaacaaaattacagactcagttctcaacagaaaagctaccttgaagttcagtaaatataggatgtaatagtttgaaatttcaagaataccttaacaaacaacaatataaaacccataaatgttttctctgacatgggaaataattttgcataataaacatctatcataaagtataaatatataatattaaatttataaaatcttaagaaagaaaaagcaagaatatcttaaatactagaaagactagtgggaacatcctttacgaagaatgcatcacaaaatgaaacaggataccattagattggctgacatttattatttgtggataccattaaaatgagttttttaaaggagagaaattgctcaactaaagatgtaatatgatttaatatcatcaaactatgaacaactaaagtacccaacttatcaagaccaataccttattaatcaatacttaaagaccttccctcactatgctcatcaatctaaagtaaacaaacgtcataaactttgcccagtcctaatcagttccccacttacaagacttgccttaagtcacctagcatagatcctaaaaccatacaaatacccacccttgacttccaccttcgaaaatagtactaatactctcaagagattctccctttctgaagtaagtctaataaaattagctttgcttaaccagcaggcattagtctttgtcttttggaggaatcaacagccaacaagataacaattctttgattactcattttcatttgttttattttctcctttgatggaatgctgaaaagtatttagattgtgacattttatttttatttacttacttttttttttttttttttgagaaggagtctcgctctgtcacccaggctggagtgcagtggtgcaattttggcccactgcaaactctgcctcccagatccaagcgattctcctgccccagcctcccgagtagctgggactacaggtgcatgacaccatgcctggattatttttatatttttagtagagacagggtttcatcatgttggccaggctggtctcaaactcctgacctcaagtatctgcccgcctcagcttcccaaagtgctgggattacaggcatgagacactgtgcctggccttagattgtgacattttaagtaaggagaaaaacatgtatttaatataaataaacttgtcattagccccaaaaagaacattcattttggtttgcactcagaattaactcttaaattaattgttacaaatcactataaaatattttactttcaatagttagtagggtaggaatggggaacctatttcattctaattctctaaagggcaataaagggctattgtgaacacagtttctaaaatctttcaggttatgatcagaaggtccataggttaaaagacacctttatttattatgaacttaaatacagcatccatgttcattaaaagaaaataaaagagcaacacacaattttatttgatccacagggctttcttgtgagctctctgataaataattatttcaataaatactaagagatttcaatgtatgaatacaaacaagtatgtaagcaagtgaactttaatatttgtagtaatataaataaattatatatatgaatactgcaaagcatatttagagatagaaaagttgtttaaataattcttaaattcttaaataattctttttaaatgtcagaccacatcttcaaaaatctccttagtcaaaatattttcattaatcagcaatgtgaataaaatatatggaaaggactttaatatatacatttgtagtactttctggaaattaattctattcttgtgtcactgttaagaaggaaatattgacaaacctcatatgttgctgggcctggagtaatctctttggactcttcaaagcgctttgatgctttcacaaataagggtatggggcaagatttccttaaaacaggattgtatgctgcaggacctgagagacaacaaatgtaaaaattatgataaagtatattttaaaattattgattttggtcatatgaatattaggtttgtgctcttaatgtataaaattagcatgaaacaatcttgaacccattgtttttgaatgcttaaaatcatttggtttatgtctttgaaatataataagcataagatagtggcatctgtttacctaataattaaatatattacagcaataatttccaaaaaggagaaaatagtactccctcaatatacttttatatcatgaatgaagatgcttaactcttatatcctaaatattcattcacatgttcagtgaggagttagggcttgagctgcacttggaaatacaaatgggatttaaagaagcagaaaggtgctttaatagcattctgggcagtaaacattacggaaatcaagacgcaaagatggaatgcacatggagcaatcaaatgtagtaaacagatggtttgcatggaacaaggcctaatcctaaataaggatttttgtacttaagccaatgggttccaacttgtattcttcaatgcccccaaattcttacagaagtgaccagaggataatttgtaggtaaagcccaagttgaaaaggtttgaattatttttattcacaacatctctaaaaacttttgagaaccactttcatagacaatgggtagctcttaaaagttttagattaaatagtcatgaaaagtggtagtttagaaagtaaattctggcagattcttgattctcatgaagagtgtacaaccaagatcccttgcatgtgcagttcaggatagcgttcgagctcctatgagaatctaatgtcaggctaatctgacaggaggtggagctcaggcggtaatactcacttgccctctgctcccctcctgctgggcagtctgatttctaacaggccattgacaggtataggtccttggcccagggtacgggacctgtggtctagtgaatggaacctagctagtatgacttcacagagagaagatagggagacgtaattttttttcttcattcatattttaaacaatactattgagtgtctatcacatgccaaaccttgtgtttcaagagaatgttagaggtctactatatcaaatgtttcaagaggagagaagacttaggaaggacactgtagaatatgtggaatataatttcagaagaatggtagtgaatgaaattagattgggggcatcagagaggcaatgtatggggagagaaaataaaacctttggccacagaatattgacaataaatataaacagtgaaatagaagagtagatataatgatattaataaaatacaaaattaatttatctgtatttccctaataagcatgcaattcaatctacctactttggcaaatacattcttgttgatgctttaaaatctaaaatatttttaaattaataggttagtatgaaacatttttaatgtttttagcttcattaatataggacatttcaaaatttaagacaaagaaggacatctaggctctagcccaatcattctaatatcagctcaattaagacatagtatctaaagttccttgtgggaagctaatgtgttttgatacatcaagtgaaaagctggtatttaaaataagggaggacatccaggctctagcccagtcatttttaatattagttcaattaagatatagctatctaaagttccttgtgggaagctaatgtgttttgatataccaagtgataaggaaagtgtttttgcaaatgccatcttactataaaacaatagcatgcacaactttggaataatataatttatatttatagtgcagaggaataatgcacatatacatacataacatctttactgacagacattcaaacacaaactatgtaagggaaaatatatcatcgaccatagtattcagaattaaaaaaacacaaactatcaccagaagctgggtacatcataattccatagtcagttaattgaaaattgtagttttaaccgtaaagatatataaaggttaatgcaacaggtaaggctattatccaaacactattgtaactgtaattttcattttcaattatgaagaaatatagtctattctctacccttaccatcaggctacagcaactgataaatatttacattcacagctataactcattaaaagaaaagaaattattcaaatgtaattgtagatttctttttattggaattcctttgaggaacattaagtgaggcaaaacttctcaatatgcatcttgctccattttagcacttagcctgctttaagctacagaatattttttaaataaaacaaagccttatcatacttagtcttgaaatacattttcaattacatatgctattgcttatatgatacaggtcaaagacttacattgcttcatcagctctcattcatagctagattatgcagaaactatcttctttttagataccaaaatgtcacattttaatcacaggtaataaggaagaaaacttctcattccaaatcaaacacctatgaaaagtctgcctgaatcatggctagtgtataatgggaaattcaagagtaggtgattcttataattgcatattttccagccctgtgacaactcagtctctatgaaatgtcaaccaatgctacagggcaaaaatggaacataacaggaacagtgagtaatttaaaataaaaacctatgtttctgtcccttcaatatgaacatcttggtacattagagtggcctcagaaaaaaaaacttctataaataaagctacaaaatctcagatttcataagttgtttgctttataatgagctaaaattataaataatgtaatcattcttactatgaatacttttttcatatgaaggtgacacaaatctactaaaaattaaatatcccatatatgagcatactaaaaccctggaagaaaacctaggcaataccattcaggacataggcatgggcaaagacttcatgactaaaacaccaaaagcaatggcaacaaaatccaaaactgacaaataggacctaattaaactaaagagcttctgcacagcaaaagtaactattatcagagtgaacaggcaacctacagaattagagaaaatttttgcaatctacccatctgacaaagggctaatatccagaatctacaaagaattcaaacaaatgtacaagaaaaaaataaccctgtcaaaaggttggcgaaggatatgaacagacacttctcaaaagaagacatttatgtggccaacaaacatatgaaaaaaagctcatcatcactggtcattagataaatgtaaatcaaaaccacagtgaggtaccatctccatctcatgccagttagaatggtgatcattaaaaaaatcaggaaacaacagatgctggagaggatgtggagaaacaggaatgcttttacattgttggtaggagtgtcaattagttcaaccattgtggaagacagtgtggcaattcctcaaggatctagaaccagaaataccatttgacccagcaatcccattactgagtatatactcaaaggactattaatcattctgctataaagacacatgcacacgtatgtttattgcagcactgttcacaatagcaaagacttggaaccaacccaaatgcccatcaatgatagactagataaagaaaatgtggcacatatacaccatggaatactatgcaggtataaaaaaaggatgagttcatgtcctttgcagggacatggatgaagctggaaaccattattctcagcaaactaacacaggaacagaaaaccaaacaccacatgttttcactcagaagtgggagatgaacaatgagaacacatggacacagggaggggaacatcacacactggaggctgtgggggtggggggtggaaggctaggggagggataataacattaggagaaatacctaatgtaggtgatgggttgatgggtgcagcaaaccaccatggcacgtggtgcctatggccacgtgccatggtggtgcctatgaaacaaacctgcacgttctgcacatgtatcccagatcttaaagtacaatttttaaaaaggggttaaaaatcagttaggaaattgtccattgaaatttcatggttttaaaatgtcatttagaaagtttatacatttatggaacacattttctcatactgattttattcttcagctttacaaatgaagtaatagcaaagagaaaagactagtacacaaagaagtatcatcatcaatgccagagacacatttaggtttaatgctcttccactacctctaagactagatttgattaaatggcacttcagatgaccatagaactgcacagtctattaaattgagctataggtaagagaaaaaagagtcccaatactacacgaattttaaacaaaatgtccatgtttatttttgccatccctttaaattatctgttcaaaaaccaaaagggtatttcatattttaagaaataagattttacatgttcaaggatatcttaaagttattacagagtatctggaagttattgtgtacaaagcccctaagaaatgaactattttaatgcactccaaactaagtagactgagaaattcatctcctggcatctacctaaagcatgcacctgttaaaacatgtgttcctagcactgattaagctatagggctgtcactgttatgacatataaatacaaagtcatatggatttggcttgactgaaatatctcttcagacagcaatgtctgtttatctgtgtacctctaatacatacttatcaaaatgtacatccataagccctgtcaagtgaagtctttcaactgctgctataaaaaagatacttccactctgtgataacgtaaatacattgtagataaatttgaatgactttcaccagtcataaatgtgggtgtaatacagtttctgtgtgaattacaggaaccaactggaaggaaggataatcacccttcacctaaaaccactttgagtaggcagtacataaatatgtaacacatgaattatttgtaagaatgaacagaattaccaaataataaaatatgaagttgtcttcgaggtaaacagaatacttcacaattgtcctgaaatattagtggcaaattctcataattaaattttggttttatacttcacagttcttacataaaggtttggagccatattaccaagaaaattatcaaggcaaaaaagtagaataagtctcaacatatatttgaagttcccttagatcaccattctcagggctaaattagcaccactctatttagcaaggcattccctctgtcaagactgatacttatctctgggaatattacatgtacaaatcaggataatgctaaaacatgtcacatcacagatgaagtcacataaaatcctttaaataaaataccaactttattttaaaaataattaaaacacttgatttaaataaactaaattcttcacaaacattaaagaaaatcactaatttataccatttaaattgtgactattttccattttctcaacttgttaaaaattgtaaggtttctaaatatgtttggatttgaatctgctgctaacatctttacctgtataggtctgctaggaaaaagctagagtcaaagagtttagagtttccagaaagaggagcctacattatttatttagtgagaagccaattaagcaaagattaatatttcatttacaacttaaatgaacaaattctgtagcctaaagcaaatatatgttatagatgaaatgaatgatacaatacttttcatgctttgatgtcatcaaaatttttttacattcattggatattaaaaaagaactattagattaaccattgaatatttcagtaacctttgtcctcctttttagtgaaccaaaatctatatatagatttaaatctaaataagaatgcttttcttcacccttacagtattctttggtcactatgatcctgtaatcatgtaatgtaaatattcttaaccttgttcctatgtcctactagaataagagacagcagactactgtgagaattcagcagcattcttccctttcaaagcttctcatcaactaaggctgaatattcctaatccaaaaatctgaaatccaaagtactccaaaatctgaaacttttcaagcatcaacgtgatgctcaaagaaaatactcattgatacatttcagattttggattttcagattagggatgttgaactgttgagtataagtaatgcaaatctaagatccaaaaactttgaaatctgaaactcttctggtctcaatcattttggataagactaccactggttaattacaaccaagataactaacagtggaattttttacattaataatgtctactttcaaataattaagggattcttcatctggctttagtacctacagctcacagggtttattcactacccttctatagctttagaaatgttactccactggtctctggctgaacttgttgtagggcatgacacatcagactaaaaaacaaaaacaatcatatgcagcatcatatattttatgttgttcatggaccacagacatcagaatcatcccaattagtgtaaaaatgaagattccttggattcatcccaaaataataaatcatattctctgaaagtgggaccaagaaaacaatttcaataaaacccattggttttgacctctaaactacaatttagtgtgttgttgttcttaaaaatatttatactttaaatcagttttctctcaaataatcttggtaaccagtgatccaaacaaagaataaaccttccgaaattctggatgagactataattttctctgaaatatatctgaatcttatgtgcctgcctacggtagagcctctataaatgcttattgagctgaactgaactgaatcaagaaaggaagaatcaatttataagctacctagaatctacttctgtgactttaagcattttaaccattttcttgtcattttactttctttttagtaattgtccatgaaaagaaatagatggattgaagtcgcatttctatttataatatgcaaatagcatttagatgatacatcacataaatatttgtaaacatgttagagcaattgttacctgggaggaaagagattaacatgaggctggcagtattaagctaggaaaaagactttcttttcagtatacatccttcactcagtatgaattctgttatgtggatgtcatactattttaatcttggaccaaattggcaaacttacttcatgataactgaagaggcaatgcttgcaagtatattttcatctctatgttattttagcctattatttctagaataaatcttaaacctaaattgaaattcaagctttctatagccatgtgaccttgattaattctctaaatcatgctcacctttagtcttctcttttgtaatagaaattaaaaaaaccagctcagagaagttaaacaactttcataagctataaaatgagtaaggatcaaagtacctgcttttcatccttggaatatccctgagagggtagaaaggggaaaattattatttaaacttcacaggaaacagagttaaatagcagagctgtggcttcactttatggttttaacagctctttttactacttcatgctgccttcttaatctccattagatgtctcagcacctccaaaaccatcaaatttgccaaacaaatatcatattaatcaaatgacaatgttatgcttttaccacagcatgacaattctctaaaaggtgaactgggtctaggagatggaataaataagcatagttgataaatttagggaatttttttttgaattaattactaattcactagcataccaaaaatagaggtaatttttgttttacccatatattttaaaagttgtaagtataaacacatttaaggaaagcacaaatatcacaattctaaaaatcaagttgtcttcaaatctccatattaccacactgctagttgtcaaggctgccacacactgctactttcaaagcctgttataaacaacaataaaacaaattctagagttaaatgctatttttctagaatccaatagcactacatcctatctttgggtgaaggctgcctctctgtggtagaatgcaatgtgacgtcttccctaagagacaatcttctccctcatatttttaactagaaatcatctgtataatattcaaaaacatacagatttaaatacagtgccttaaccatttctttcaggattatacttttgccttcatgtttagaaaaatctttcaactgcaaggaacagcctcactcatttaggcaagcacgtatagcaagagatgaaaacagcattttttgctagtaacagaaatcaagtaaaaacgaattgctcaaaaagaacagtcatgtttgctgtcttttttgaaagctgaagtcattattcactttacacggagtgacctctgctggtcagaaagacacatattaatggacatcatatctaccagaaagcagctgttatcttaatttccccaagtaattactcagatatattgtgtgtcataagaggaagttggttattcacttacagtgcaacaatacaggagcatatcctatttcaaatactgaaagtcaagaagcaaatatcaaatggatatcttttacaaacattgagttaattgttatttcttcactaatgtccattgttagttgaaataaaagtagactcaaaaggtcttcttattataagacttattttgaaaggaagtatactctataataaaaaaaattaagattttggtatttttaactatatgatgaccgaaagcttagcatttgtacactattaactgaaataaacaaaacatatttatacaataaacatatgacttgttacagctcagaagtaaagaatttatttagctaagtaatacagttacaaaaattacatttaccttctctaaaacagaacatggtacacatcagaaactgtaaaacctaattaggagacagtatccagagactcagagtaaacatttaaacaaccaatatcaaaatactctttttaaaacatatatcactgcaaaaactgtgcagattgtttttctttataattttaatagaggtcacaacctttgacatgaaatatatcaataaaaacaccaaagaatgttgcctacaaaaattttttattaagaaaattattatatatcctgattgctaattatcacaatgtccccctcccctcctttttttttctttttaacaatgtccaggaggggaaaaaaaaaaaaagaagcatatttggtctttgcttcagcaaatactgaaatctatttatatgcaaataagctatccatgattagtatgagaaaagacttgtgtataaatgagacataaattatcactagaagccattaatgaaatctatttcaaaacataacattttacaagagccctcactcatgtaatatttgcttaagcctggaggggaaatggtgagttctacacttagatgaaatctgatactacattatttcccatgccaatatgttttataaaatgaatttatcctttccttaaaaatgactggataattgtaactccagtctttttagagaacttcatcattaaaatcagagccttatgtgtttgtcacataattgccacactttttgaggggttttattttgtgtctgttagaataattgtcattctttagggtttaaaatgttaacattcattttgatattctacatatattcatttttatattctgaatataaaaatgaatagatgagtcttaagagggaacatgagtctttctggaataagttgaatttctattgaaaataataaaataagcaataattaatagacctataaaacacttttgtatacttttttcattttcttttgggatatcttgttttgttctcctttacatcataaatttctttagtccatatttgagtctctgccaattttttttttttttttttgagacggagccttgctctgtcgccccggctggagtgcagtggtgcgatctcggctcactgaaagtttagtctcccgggttcacgccattctcctgcctcagcctcctgagtagctgggactacaggtgcccaccaccacacccggctaatttttttttttttttttttttgtatttttagtggagacggggtttcaccatgttagccagaatggtctccatctcctgacctcttgatccgccagcctcggcctcctaaagtgctgggattacaggcgtgagccaccgcgcccggccgagtccctgccaattttaaatattggagatatttcttctttctgtcatctactgagcttttcctaggatgccaaatgttgaagagaaatccttcgttttaaaatagttaagcttagattttttttttatagtcgttacttttggagtttttagtaagaagtatttccccactttctaggttgtaacagtattctcttagacactgaggactccaaaaggggggagggaggggttaagggtaaaaatctacttattggatactgtgttcactattgggatgacggattcaatggaagaccaaaccccaccattatgcaatatattcatgcagcaaacatgcaagtgtacccactgaatctgatttctttttaattaaaaaatcagtattcactgatattttcttcaaataactttgtagttttacctttccatttaggtctttaatccatatagattccatttttgtgcatggtattttgtaaggatctaatcttattttctctggtaaatgtattggtccattttcacactgctataaagaactgcctgagactgggtaatttataagcagaaaaggtttaattgactcacatttccatgtggctagggaggcctcaggaaatgtacaggcatggtggaaggtgaaagggaagcaggcacttcttcacgaggcagtaggagagagagcatgaagagggaagtgccacttttaaaccatcagatcttgtgataacactatcatgagaatggcataagggaaactgttcccatgatccaatcacctccaaccaggtccctccctcaacacgtggtgattacaatttgagatgagatttgggtggggacacagagccaaaccatatcagtaagtttgtcagttttcccagtatgtcaactaaataatttttgtttacctattgagttgcagtgacatctttacaataaattgtcttcacatatacattaatctgtctctgaattttctgtttccttatccatttgtcttgcttttgtgacaaaaccgcaaagtttttattaatatagatttgcagtgtgtcttaataaatggtattggaatttctccccttctctattcctttttttaagctcttcatatacctttatttttacacacatttatatgagatcattaatttcttcaaaatatccaactggaatcttaagtggggttacatttatagattaagaaaagtaaaactgatatcttgactatataaagtcatcacattcaagtgcctagaatagctcttcatttattcagaccactatctatgtctattattagtttaaaaattctctttatgaaattgttttttcttatttaatcctaggaacgttatttttacggtgagttgtacattatttcattactcttttgaaaatgatcactgctggtattgagaactgttactggctgtgtaagtcattctctatccagcaagtgtggtgaattttcttatcagttctagtagtttctggatattttttaaatttgctatatgatgctataatctgcaatttaaagtaggtttatatcttttcttccaatacttccttctttttgtgttattaggtattctatccttaggtattgatgtgaaccacctactttgttaagaaggtgtggtaatagtaggtatccttgtcttcctttctttaagaataatatcttagtattatagcctttatcaagttaagaaagttacttgtattcataactttctgagatttttaaatcacaataggtatatttaatttaaaaattgcttatgcaggtctttattcaagtacttcttgaaagagtacagtacagaaatatgagaataccctagaaaacactgctcccagaactcttcttgactcaaatcctgttgatttatctttgcttttaggtgactaggcagtttagaatgcaatatatttttgcctatctccccctactatgcttaatacttgctattacgagaaaagagcatgtgcaaatgaggatgaggtatgatagtgggaaggcagtcgggtgttctacttattcatcctaaagtccactaataaattcatcttaaattccaataatacatacatcccttcctctgctaacctacacagagttgcaagtcagaactgttgctgaaagggagaccaagaagagaatagtaccacttttttttttagtgcacccaaagagcacccaaactagataaatatttagtctttgtttccttaagtatgataagaaatagccacatgaaagacaaagaccaaaataaatagaaaaactgaccctgaagaaaaaaaaatagtttaggaaaatatagaaaatatataactttcaaaattgaatagtatgatgaaatacattcacaataatattgcatctataaaacaaacagcattctgagaacaatgtactccaggagcacataactgttggtatagaaaattataagaaaaatagcttacaaaaacccttacagaatttagagtaaaaaggcagagagagagaaaaaatatgaaagataaaaagatatttaaaaaaaaattctattggaaccaaaatccatgtttccagaaagacaaaattaaaatgctgaaaacaaattacaaaatacagattgcttaaaaaagatagaattcttcaaatgtaaaaggacactataaaacataaacgacctgagtccaggcattgaaagatattcagccgtagatatattactgtgaaactgtagaacattaagaagtttttaaaattctaaatgtttccaaaaaaaggaaggtcttaagtcccccacaaaggaaaaaaaaatcaaaatgccttctgatcgtattggcatcagcaaaaccagattctagaagacaatgaagcaaaagaaaaaaaagtaagatcaaaaggaagatatcttgaaatataaagtcctgccaccacctctataaaatgaaagcccaggtttaatacaaatcaggcctagagaaaaatcaatccaaacaaaaacagatcaatgggctccagaaaagaggtctccagaggggttgaaactttggataaaatgagaatcaactcaagaaaaaagtagacaatttgtatgatattgtactcatatgaggtggctaaagtagtcaaattcatagagacagaaaatagaatggtagtggtcaggggctagagaggaagttattgtttaatgacaagagtttcaagttttgcaaaatgaaaagagttctgtggatagatggtggtgatgaagcacacaatgtgaatgtacttaatgccactgtgtacactttaaaatgattaagatggtaaattttctcttacgtgtattttgctacagtttttaaaaagataaaattccagataactgtgtaagaaagtaatgatctagatctgaaactaaattaaaaagtgacaaaatttaagcaactaatgacatgcagaagtggaaatccaagtgattcttatgccaaaatattctactttgagaatattaaagattatggctttggtgccacagaaagaaaattaatccttgcattctacttcactcatcactgagtaatttttaaattttgtttctgggactttgaattaataaggaaaagtttattgcttttctctaagctcttctatacaagttggtttggtactatgtgcatatatcatacacacacacataatacaaacatacacacacacacacacataatacaaacatacacacacacacacacacacagagaatatacctatgttggcaagaggcctcctccaactgattcttttcattccatctgctgtgatgtttcattgaaaatgaaattattgttaagcattattctatctctatagcttctgtttctaaaactatatgttctgtagagatagaaacaaggttttgaaaagaagggaattatacttcattctgaaatatctgagtctttaagtgtattctgaaattcacaaagtcatcagaaggaataggtgaaaattagacacataattacttatagtttggcttctacagtaaaatgtcattgaaaatgtagaattatgtaaataagtatattaggcatataatgtgtatatgtaaatgtatttataaattaataatgtgtctatctcatgattccatattagttttatatttatctttctaatatttattttccttaataaaaccatctagaaattaaaataaatcaccttttttatgagtatgattatccatacctaattttccatcatgggtcttgttgtatgtcagtgaaaagttgatatgtttactatatgaataggataaaacaggtaaagatgacaacgtttattttatcagccatacacaaaaaacagaaactagcttttctaagcactgaagcaatatacccccaggttttttatgcagaatgcaagttttcatagaatgttagctgatataacacactataaagcattctgtggtcaaatttggggaaggttagattaaacaaggttcaaacaggtttattacaggtcatatcagagcctgtgatatgctaattcacacataaagaaaaaatacagcttgtgcatttccaacacgtatgatcatggattcctttttttttttcacaattttcttacaaaactagtgtttgtgtaaattaatttaaaaatttttgatttccaggatagccacattagtgttttcaacatactaagtctaaaattataatttaaattttagctatgattccagttaagaagcacaaatgaaagcagagatagaatcattatacttttttctactgttattaaaaaatttccaagtaaattatagttaaatagttcacatcaaaaagccatttatatcatctttggttttggatattatggaactgtgctctcctagtttgcataatctgtcatctttagcaaatgcatattatctaatcagacaatagcttcatcagttcagcatgtaataacttcagatggccataaagtatgaaccaaagaattctgttaatagggaatggtattgtctatacttggccacagctgcaagaaacttattcatttatgttatcttcaacctctttctcctctaatcaaaaaaaaaatctcagcagcatagtggctgaggtaagtctgaaacatgtatgatagaattacacaataaaagcaaatattgataaccaaagaaatgagataattttgatgtcaaggagttcatttatttctaagtattagtaaaaagaccttccattttactgatgacagtatttacctttactagtatttttaaaatttcctatgaagcaaaaaatatgacgtaactcggtagaaattatttcctttagattgaagaaatctatatgcagaattattttcaagttgttgttttcttgacaatgtatttacttcctctcttgtatgaccagagtaatttatttctgatcatcacaaacagaagaaaatttaggatccaaccttggtgaaagccttatttggcccagaaagagagtcactttcaaatctgagcatacctgttgaagtgtctgacccagagctgaggaaaaaaaaaaattcataaggagaatgctcagctggagtcatacaacctacctaacctgatcaaaccactcagaagatcctatagaaatactacatccacatcaggctacagaaaatattatttaaagtacaaacaagcaaagaaaaactaacttatccctacaaatatctccagaaatctttttatcaaagaaatctgtgtgtttgtgtgtatgtgcatgcatgtgtgtgtgtgagagaaagagagagagagaaagaaagatacagagagacaaagaaagagagacagagaaagaagcagagtgggagaaagaaagagacagagacaaagacagaggaaaaaaatggcttttcattccactgatgacaaggccccaagaatttctctctctctctctctctctctctctctctctcagggctcactgaggaaacagaaaagagtcataactctagatcttaaaatcctcatccaatttctaagactcaggccctcatctaatttctgttgaaaaaaaaaagcatctattatcaacttttggaggagctttgagtgacactggtagactttagggaagaatatatgacttttgctatctttcagatttggagaatagaatgtacttggttggtggaaaagtaatcatgttttttgccattctttaattcccatgaataaaagcaatagcaaaaaccacaattacttttgcatcaatctaataactcatgtcacagtttcttttattttggtgaagccacctatatgagtgatttagtcagaactttggaatcagattaattttgtcaacggttatcaaaatagaaatatattagaaactgaatttggcatgtctctttgataatgctgtctctgcagactctgaattttgagggaggagttctttcccctattacacaatcaggaatttgaaactgtacaaggtgagtaaaggggattggaactagcccacagataaaagattcaaagccaggctgcatccaacatcataaaccctcctaacaagagtaacaaggaattaaggtaaaagaccataggaaaaatactaaaggacccagacaagagcaatacaatttgtcacaagtgtttagaagcatagactttataaagccaatttattttaaagtgcctttttttcctgctattgtaaatgggatttttttgcttgatttctttttcagatagtttgctgttattgcctagaaaaactactgatttttgtatgtatattttgtatcttgcagctatactgaattcatttattagttctcagagttccttggtgaagtctttagggcttttctttttcaacttttattttagatacaggggtacatatgcggatgttacatggatatgttgtgtgatgctgaggtttggagtgtgactgaacccataactcaggcagagtgcatagtaagcagtaggcagtttttttaactcttgcctccctccctcactgcctcgtcttgtattccccagtgtctactgacccatctttatgtccacctgtacccagtgtttaaatcccacatacaagtgagaacatgaggaatttggttttctgtttctgcattacttagattaggacaatggccttcagttgcatccatgttgctgcaaaggacatgatttcattctttttatggctgtgtagtatgccatggtatatatgtacgacattttctttatccaatacaccactgatggatgcctagattgattccatgtttttgctgttgtgaatagcactgtgatgaacatatggatgcatgtgtttttttggtggaatgatttgttttcctttgagtaaatacccagtaatgggattgctgggttaaatggtagttcaactcttagttccttgaggaatctccaaactgctctccacagtggccatatatccttacatatgttttccaaattgcttaccctgtctcctctctcagaaatgccaatgagtcattggtttggtctctttacaaaatcacatagttctgaaaggttttgttcattttttttaaatctttttttctgactggattgattcaaagaatcagtcttcaaactctgagattctttcctcagcttgttctaatctgttattaatacttccaacttcattatgaaatccctgtagtgaatttttcaactccagaagttcagtttgcttctttcttaaaatggctgtgttatctttcaactcttggatcattttattagcttccttggattgaatttcaactttttcctgaatcttgagcttttgtgccatccagatttgaattccgtatttgtcatttcagccacttcaatatggttaggaaccattgctgggagccagtgtgattatttggaggcaaggaggcactctgactttatcagttgccacagttctttcactgattctttctcatctgagagggctagtgttcctctatcattttcaagttgctgtcattgagatggagctttttgtttttatattctttaattcccttgagggtttgactgtggtgtacgctgagtatagtcaattggctttgtttctgggtgcttcagagggccaaacctctctataggatcttcatttgtggctagattcctgcattgggtttcacaggtgatgtgtcctcaaagaatttttgttcggtggcgtcatttaggctacctccagtatattacacttaagagtaagggccaacagacagatttttagccacgtgcctcttctgtatttcagtgcgtttgcagcatgctcctgggtgagggttgggaagcctagagaggaaggttgggaagcctagagatgaagcctaggaagctcatgcttccccaaccaggtctccttccggtgtctgccccagaagctggcctgaacatctagttttgtcccaagccttctgtgcccagatgcctgggctgttaggtgttctgctgggttccctcaggcagaggctgcagttggcaaagagggttcacctttcatagactgctcttgagaagaggggcacgtccagctcccacaccagtccatgaaacctgggactcactcttctcagtgttctgaggatgggggctccttccccacttaagctgcatctacagatctcagctagatactcctgatctgtgtgcacgaacctgggggtttgggaccagacctgcagctttgtcctttggcccctttgtcctctggtccctttgtcctttggcccccatggggccaaaatgctcccatgcctcagcatagcactaaggcagggcagtggaggttgtgcatgctcttataggggcagccaggcagggtccttgggaggggcccacagacaggtaagcatgaagattagatgggccccagtcccataggaaagacagccctgctctctctcagccctgcagttagtaggggccagagctgctcagagcaagatggagagcctcaagggacaggcacctatggtcgcattttgccgcagctgccccattcacaaaatcttctgggcttggcacaggctggagctctccctccatctcctctctgggaagctcccactgcccattcaaatttctatgggttttttccagtgttgtcttccagaatgcttatagtttcaggtcttatatttaagtcattgatccatcttcaattgatatttttataaggtgagagatagcgatccagtttcattcgtcttcatatggcttgccagttttcccagcacaccatttattaaatagggtgtccattccccaatttatgtttttgtatgctttatcaaagatcagttggctatatatatttggcttacataaagaattcaaggataagaccccaaaaacaaatgcaacaaaaagaaaaataaataagcaggacctcgttaaaagcttctgcacagaaaaaagaaataattagcagagtaaacagacaacccacaagaaaatatttggaaactatggatgggagaaaatatttgcaagctacgcatctgacaaagcactgatatccagaatctaaaaagaattcaaacaaatcagcaagaaaaaaaaaataatcacattaaaaagtgagtgaaggacatgaatagacatttcaccaaagaagatataaaaatggccaacaaacatgaaaaaatgctaaaaccactaatcatcagggaaatgcaatttacaaccacaatgagatactactttactcctgtaagaatggtcattattaaaaagtaacaaaaaccatagatgttgacctggaagtgaggaaaagggaatgcttatacactgcttcttgggaatgtaaattagtacaacctctaaggaaaacagtatcgagattccttaaagagttaagagtagatctaccattcaatccagcaatcccactactgggtatctatccaaaggaaaaaaataataattatattaaaagacacttgcacatgtatatttatagccacataattcacagttgcaaagatgtggaaccaatgttaaatgcgcatcaactaatgagcagctaaagaaaacgtggtgtatatacaccacggaaaactattcagccactaaaaggaatgaaataatgtcttttgcagaaacttggatggagctggaggcaattactctaagtgaaataacacaggagtggaaaatcaaaaatcatatattctcacttacaagtaggagctaagctacgagtatgcaaagtcatacagagtgatataatgcactttagaatgtagaagggggagggtgggagaggaatagggatcaaaaactacacattaggtacaatgtacattactcaggtgacagataaaatcgcaaattcactactatataattcattcgtgtaacaaaaaaaaaacacttgtaccccaaaagctattaaaacaaaaattaatttaacaaaatgtctatggaggtcatggaagctcttgtagctaggatcccagaggcccatggtgagagtgtgttgtcctgcagttccttcactcaccccttccctagaacttattcagggccaggtgctggtccggttgctcagcaactccatgcagggttcccagctccctccctcctctacctcagggtcagcatcacttctctatccactttcaatgtttgctctcaaaggatctgtttgaagtgtgacggtttactcgatattttggtttctctcagtgggagaggcagttcctggctatgtctagttgatcatcttctagttttctataaacaaaatcatgccatctgaaagcagatattttcccttcttcctttctgatttgggtgtattttatttatttttcttgcctaattgctctgggcaaaatttccagcactatactgattaaaagtgccaaaagtgggcatccttgtcttgttcctgatcttaaataaaaagctttcagcatttcaccattgagtataatgttacctgtgtacttgagttatatggcctttactgtattaaggaatattcctcctattcctaatttgttgagaatttttaattataaaaggatattgaattttctcataggctttattttttatcacttagctaattattttttaacttttatttcaaattcaggagtacagttgcaggtttgttacataggtaaacttgtgttatgagtgcttgttacacacactattttgtcactcaggtattaagccaggtacccattagtaattttcctgattctctccctcctcccaacctccactctccaatgggccccagagtgtggtgttcccctctatgtgtccatgtgttctcatcatttagctcccacttattaagtgagaacatactttttctattgagatgaccatatgattctgttgagatgatcatatatttcttatactttattctgttaatatggtatatcacattgataagtttgtgtttattgaaccatccatgcctcccaaggataaatctaaaaggatcaaatgtggtgcaggaaaaaaaagttaagaaaatggccttggcaatgatttttttggctagtacaccaaaagaagaggcagtaaaagcaaacataaacaagtaggacaacatcaaactaaaaagtttctgcacggccgggggcggtggctcatgcctgtaatcctagcactttggggggccgaggcaggtggatcacaaggtcagcagatcgagaccatcctggctaacatggtgaaaccccatctctactaaaaatacaaaaaaattagctgggcatggtggcaggcgcctgtagtcccagttactcaggaggctgaggcaggagaatggcatgaacccaggaggcggagctggcagtgagttgagatggcgtcactgcactacagcctgggcaagagagcgagacatcgtctcaaaaaaaaaaaaagtttctgcacaacaaaggaaacaatcaataaaaagaaaatgcagaatatggagtgggtgaaaatatttgtgaactacatatttatatatagttcatatatatacttctatatacatatatgcagggttatatatatagatatatagatgtgtatacagatataataggtgtgtatctatatatatatacatacacaaagtgaaataacacataagtggaaaaccaaaaaccatatgttctcacttataagtgggagctaagctatgagtatgcaaagtcaaatagagtgatacaatgtactttagagactcagaagggagaggttgggagggaaataggatcaaaaactacacattaggtacaatgtacactattcaggtgacagatgcagtaaaatctcagaattcagtgctatataattcatccctgtaacgaaaagggagaatatggattgggtgaaaatatttatacatatacatatttacatttatatatatgtatatatttatatatttatatttatacatttatattcatatatatatacacacacatatctacagatgtgtatattcttataatatataaggatacatgtatatccttacaatatataaggatatgtgtatatcattacaatatatagggatacgtgtatatccttatatatatgtgtgtctgtgtgtgtatgtatgttaaccttatatatagacacagggttaatgtcctaaatatataaggaacacatacaactcaatagcaaaaacacaaataactcgatttaaaaatgggcaaaggacctaagtagatatttctcaaaagaagacatgcaaatggccaatggatatataagaaatgctcaacatcacaaatcatcagggaaatgtaaatcaaaaccacaatgaaatatcacttcacacttgttaggatggcaaataccaaaaagataaaaggtatgtgttagtgagggtgtgcagaaaggagaacccttatacactgttggtggaaatgtagattggtacagcccttatgaaaagtaaaatgtcaattcctcagaaattaaaaatagaactatcatatgacccagcaattcctattctgaatatatacccaaagaaaataaattcagaaaggtgatagcagccaagatggccgaataggaacagctccagtctacagctaccagtgtgagcgacgcagaagatgggtgatttctgcatttccatctgaggtaccaggttcatctcactagggagtgccagacagtgggcgcaggacagtgggtgcagcacaccgtgcgcgagtcgaagcagggcgaggcattgcctcactcaggaagcacaaggggtcagggagttccctttcctagtcaaagaaaggggtgacagatggcacctggaaaattgggtcactcccaccccattactgcgcttttccaacgggcttaaaaaacggcacaccaggagattatatcccgcacctggctcagagggtcctatgcccacggagtctcactgattgctagcacagcagcctgagatcaaactgcaaggtggcagccaggctaggggaggggcacctgtcattgcccaggcttgcttaggtaaacaaaggagccgggaagctcgaactgggtggagcccaccacagctcaaggaggcctgcctgcctctgtaggctccacttctggggcagggcacaaacaaacaaaaagacagcagtaacctctgcagacttaaatgtccctgtctgacagctttgaagagagcagtggttctcccagcacgcagatggagatctgagaatgggcagactgccttgtcaagtgggtccctgacccctgaccccccagcagcctaacagggaggcaccccccagtaggggcagactgacacctcacacggccgggtactcctctgagacaaaacttccagaggaacgaccagacagcagcattcgcggttcacaaaaatacgctgttctgcagccaccgctgctggaacccaggcaaccagggtctggagtggacctctagcaaactccaacacacctgcagcggagggtcctgtctgttagaaggaaaactaatgaacagaaaggacatccacaccaaaaccccatctgtatgtcaccatcatcaaagaccaaaggtagataaaaccacaaagatgtggaaaaaacagagcagaaaaactggaaattctaaaaagcagagtgcctatcctcctccaaaggaacacagttcctcaccagcaacggaacaaagctggacggagaatgactttgacgagttgagagaagaaggcttcagccgataaaactactccgagctacaggaggaaattcaaatcaaaggcaaagaagttaaaaactttgaaaaaaatttagacgaatgtataactagaataaccaatacagagaaatgcttaaaggagctgatggagctgaaagccaaggctcgagaactacgtgaagaatgcagaagcctcaggagctgatgtgatcaactggaagaaagggtatcagtgatggaagatgaaatgaatgaaatgaagcgagaagggaagcttagagaaaaaaaaataaaaagaaacaaacaaagcattcaagaaatatgggactatgtgaaaagaccatatctacgtctcatcggtgtacctgaaagtgacggggagaatggaaccaagctggaaaacactcttcaggatattatccaggagaacttccccaatctagcaaggcaggccaacattcagattcaggaaatacagagaatgccacaaagatactccttgcaaagagcaactccaagacacaaaattgccagattcaccaaagttgaaatgaaggaaaaaatgttaagggcagccagagagaaaggtcgggttacccacaaagggaagcccatcaggctaacagcggatctcttggcagaaactctacaagccagaagagagcgaaggccaatattcaacattcttaaagaaaagaatgttcaacccagaatttcatatccagccaaactaaacttcataagtgaaggagaaacaaaatactttacagacaaggaaatgctgagagattttgttaccaccaggcctgcccgaaaagagctcctgaaggaagcactaaacgtggaaaggaacaatgggtaccagccactgcaaaatcatgccaaattgtaaagaccatcgaggctaggaagaaactgcatcaactaacgagcaaaataaccagctaacattaaaatgacaggatcaaattcacacataacaatattaactttaaacgtaaatggactaaatgctcccattaaaagacacagactggcaaattggataaagagtcaagaccaatcagagtgctgtattcaggaaacccatctcacgtgcagagacacacataggctcaaaataaaaggatggagaaagatctaccaagcaaatggaaaacaaaaaaaggcaggggttccaatcctagtctctgataaaacagacttcaaaccaacaaagatcaaaagagacaaacaaggccattacacaatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagatcaacaagacagaaagtcaacaaggatacccaggaattgaactcagctctgcaccaagtggacctaatagacatctacagaactctccaccccaaatcaacagaatatacattttttttcagcaccgcaccacacctattccaaaattgaccaaatagttggaagtaaagctctcctcagcaaatgtaaaagaacagaaattatagcaaactatctctcagaccacagtgcaatcaaactagaactcaggattaagaaactcactcaaaaccgctcaactacatggaaactgaacaacctgctcctgaatgactactgggtacataatgaaatgaaggcagaaatcaagatgttctttgaaaccaacgagaacaaagacacaacataccagaatctctgggacacattcaaagcagtgtgtagagagaaatttatagtactaaatgcctacaggagaaagcaggaaagatccaaaattgacaccctaacatcacaattaaaagaactagaaaagcaagagcaaacacattcaaaagctagcagaaggcaagaaataactaaaatcagagcagaactgaaggaaatagagacgcaaaaaacccttcaaaaaattaatgaatccaggagctggttttttgaaaggatcaacaaaattgatagattgctagcaagactaataaagaagaaaagagagaagaatcaaatagacgcaataaaaaacgataaaggggatatcaccactggtcccacagaaatacaaactaccatcagagaatactacaaacacctctacgcaaataaactagaaaatcttgaagaaatggataaattcctcgacacatacaccctccctagagtaaaccaggaagaagttgaatctctgaatagaccaataacaggctctgaaattgtggcaataatcagtagtttaccaaccaaaaagagtccaggaccagatggattcacagccaaattctaccagaggtacagggaggaattggtatcattccttctgaaactattccaatcaataaaaaagagggaatcctccctaactcattttatgatgccagcatcatcctgataccaaagccgggcagagacacaacaaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagaaccaaagaaaaaaaccacaggattatctcaatagatgcagaaaaggcctttcacaaaattcaacaacgcttcatgctaaaaactctcaataaattaggtattgatgggacgtatctcaaaataataacagctatctatgacacacccacagccaatatcacactgaatgggcaaaaactggaagcattccctttgaaaactggcacaagacagggatgccccctctcaccactcctattcaacatagtgttggaagttctggccagggaattaggcaggagaagaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgaatgaactcccattcacaatttcttcaaagagaataaaatacctaggaatccaacttacaagggatgtgaaggacctcttcaaggagaactacaaaccactgctcaaggaaataaaagaggatacaaacaaatggaagaacattcaatgctcatgagtaggaagaatcaatatcgtgaaaatggcaatactgcccaaggtaatttatacattcaatgccatccccatcaagctaccaatgactttcttcacagaattggaaaaaaactactttaaagttcatatggaaccaaaaaagagcccgcatcgccaagtcaatcttaaggcaaaagaacaaagctggaggcatcatgctacctgacttcaaactatactacaagactacagtaaccaaaacagcatggtactggtaccaaacagagatatagatcaatggaacagaacagagccctcagaaaaaacaccgcatatctacaactatctgatctttgacaaacctgagaaaaatatgcaatagggaaaggattccctatttaataaatgctgctggaaaaactggctagccatatgtagaaagctgaaactggatcccttccttacaccttatacaaaaattaattcaagatggactaaagacttaaacattagacctaaaaccataaaaaccctagaagaaaacctaggcattatcactcaggatataggcatgggcaagtacttcatgtctaaaacaccaaaagcaatggcaacaaaagccagaattgacaaatgggatctcattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcaaaggacatgaacagacacttctcaaaggtagacatgtatgcagccaagaaacacatgaaaaattgctcaccatcactggccatcagagaaatgcaaatcaaaaccgcaatgtgataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgaccaagccatcccattactgggtatatacccaaaggactataaatcatgctgctataaagacacatgcacacgtatgtttattgtggcactattcacaatagcaaggacttggaaccaacccaaatgtccaacaatgatagactggattaagaaaatgtggcacatatacaccatggaatacaatgcagccatacaaaatgatgagttcatgtcctttgtagggacatggatgaaattggaaatcatcattctcagtaaactatcgcaagaaaaaaaaaccaaacaccgcatattctcactcataggtgggaattgaacaatgagaacacatggacacaggaaggagaacatcacactctggggactgttgtggggttgggggaggaaggagggatagcattaggagatatacctaatgctaaatgacgagttaatgggtgcagcacaccagcatggcacatgtatacatatgtaagtaacctgcatattgtgcacatgtaccctaaaacttaaagtataataataataaaataaaataaaataataataataaaaagaaaataaaatcagtacttcttaaagagatagctgcactgccatgttcattttggcattgttcacaataaccaagatatgggaacaacctaattgtccatcaatggatgaatgaataaactgtgtgtgtgtgtgtgtgtgtgtgtgtgtgtgtgtgtgtgtgtgtgtctatatatatatggaatactatcaggtctttaaaaagatcttaccttttgcaacaacatggatgaaactgaaggacattattccaaataatgttatctggtcacagaaaagcaaatactgcatgattttgcttacgtgtggaatatttaaaaaaaaacaaaaacagagtaaaacagttggtaacctgagatatgggtacagatggagacatgtaggcaaaaaggtacaaagtttcagtgatataggatgaagacttctagagatctcaagtacagcatgaggatgatagttaataatattgcattgtatactagaaatttgctgagggtagattttagtggttcttataacacacaaaaataatatgtaaaatgagggagatgttaattggcttcactgtaataatcatttcactatgtatatgcatataaaacatcatgttgtataccttaaatatatataatagaaatatattaaaagtaaaaaagctattatgtcataaaaacataaagtgccttttgtttcaggtatacagtgagacagtaagaaaagcaattctagttttcttttattttgtttcctcttaaggtatacatcacagagtgtcaagagcgaagatctggaagattttggttgtactgtgaacaagtcatttttgagagtgatgttgcccaataggttagtttattattctccacacctagcactgtgcctttgttcagagtagttgctttttaatattatcagagtaagcaaagggatgatatattacattaaatacactcagctccaggttttagggaaatgtttacattttgaccattctttcacttacatagacttattgttatttacacaaccaaagacatctgaattttaagtcatttttcttctggaagagtatgataaacaaaagatgtaatcattttggtccaaattgaatcacctgtcaatagttgatctttcattttacattctggaggactaatctgaggaaacaagttaaagaagatgccatatctcatatcatttgttcaataaagcagaatttatttagcatctttgtgctagaggggatacaaagaggaaaaatattcaagttctacctcaaagaaatttcaatggaatggaaagtagaaatgagacaaatgcacatatatgcctgtaatgcaagatagaagattagtaccattaattccatggggttctaaatagtgagaaagttcatttgcttggaagaatgggaaaaatcttcccaaaagaggacattttagataggagtagaaaagctagtaggattttgctaaataggtgcaagtattcataggtgaaagaaagagcataagcgaagttcttacatagcaaagcataaggcatgtagaggatacagtagaggattagaatacagagggaatgaagaataaaaaataataggactgaaaaggagagttagatgctataatacataggtcgaagcctttgcatttatataatagtcaatagtgagccttgatatgctggtgagctagggaatggcatgatcagagctgtgttatagaagactcttaaatcacatctttccacatatatatgagaataatgaaacaatggtttcccagatgacaatattcttttcttcttctgtaacattatttcctataaaaataatttcatttatattactcataatatataatatgtagtattttgagtaatgtagaataagctgtgatgaaaataagcccctaggtaattattgtgtggtcttatcttgatgtcaaatggctttttaattgttgggaggaagtagggaggagttgaggaatagaagtgtctcattactcatgtgtattcaattccaataaatatttaaataaaggtgtttaattctattaaacatttggcaatataattttttatttttaataatagttttaattggttttgcttactattagattcttattactatatattagtccccccattatcttcaggggatacttcctaagacccccagtggatgcctgaaactgtggatgctacagaaccctgtacataccatgatttttcctataaatacatagctgcgataatgtttaatttataaattggcacagcaggaaattaacaacaataactaataataaaatacaacaatgataacactatgctgtataaaagctatgtgaatgttgtctgtctctctctataaatatactgtaatattttcagattgctgttggccacaagtaacggaaacccgcagaaagtgaaagagtggttaaggaaggactactgtattcagaaaattaaatcaaattacaaggctcaaatggaaggctccagtaaatttctttctcttctttatcatctgctcttcacataaaacaacactgcaatgctttaaaaagtgttactccagttactaatgagatgttcatttttcttggttatactgagtggtacttccaaaagtagtttcttataaaattgcctatttggtcaatctaaaattaggccaccaatgttgtaagaagagattgaaaaatttgcctataatatggtataaattacgaacttgtattgatacttcaaaacgtgagtctaagctagaactactttcagtcaaatttaagtcattattacctttctttcagaaaccatggcataaaactaaaaaaaaaacaaaaaaacaaaaaaaaaaacaattgcagaaaagtgccctaaattggtccaataaatcaaattcaaatcaataaaaagcaattatgacatatttaattttattccattttaaatcaatctataaaattctgtgttaatctctctacagaagatagccttaaaaactaaagatactttttcctcttcatttcccccttagtctactgattttagaaaatcattttttatattcattcacaaggactttaaactatgctataattatgaaatatcacagcttcatatattccattaagataaacatttttaccatgaaagagctttagtaaaattaatagtcataaataaaatgtctaaaaaactgttctcttaatttataagaaaacattatgtgttctattagagtttagtaaaaccttgggtgaataaaacagtgctatgctgatttacataggactatatttttcaatgaatctagattaaaattcagttgagaaaacttgaggaaagctcataccatatgtgcttatgattttatcttcatgaaacatttctctgagtcaattaaaaagcagctagaagactaacaaaataaaagttctcaaatgtcattgcatttcaatacttgtagaaaaataaagagttaatcttaacatctggatttctagttttctacataagatgtagtaatggaagatgagagttgtttgagctaatttatctttcaggcttaagtatctcatctttttctctgaaagtttttagatgtttcaatagctgatttctgtgtaacgttataacctttacatcaggtttatttttctctccacagatggtcatttgataatgatagatgaagcatgtctgaataaaaagttatgaaacacacagattcataagaattacagacagtataattactttattgctaagccttctatatattctattaccttgtatacacataaaacatataaatgtgtatctttaactcactaaattaaaagacaccattaaaacattaaaaacacagctatatataactttgctggaatgatattcatatttaagtccatgaattttaaagctaaaagtactgaaaaattatttgttcccctgttttatccactgagactgcctctgcaacatactcacaatgtgattatctgacttaacagttgaatgtctccaataatttctccaattgacagaaacagaagggacaaaactttttcattaaagaataatactgagaagtagctttaattcagtcatggagtacatacaaaagacaaagtcctgggtcacagttgtgtcaggatttagtagagagtgcatataatatgagataagcacatatccaaaatctagtcagctaaatcacaaaggtattaatgactagcagtggaataaaagaaaggaggggtttaagaggtttaaactaattatactgacagcactgttgctgttaaataacttttctttacctaaatatggcaaagggaacagcagattcagctctctgtgcacctcgaaagtatcccagaaataatcacagcaatgagaaactcataagctaaaatatccctctgcatcttctgattacagtgtctattgctatataccatgttccaggtatgtagaacagtgcctttctaatagtagacactcggtaaatatatgctaaatgcataaatgaatctattttgaagtcaggaaaagtgtgggaaggatagcatgtgcaatctgtttttatacaaaaaaaaaaaaaatcttttacagtaatatccccaaaagtcttctctttaggtttcatagttaaagtagagttatagaaccaaccttagctgtaagaaaggatggaaaagagagtatttagcttgtctaatctctatagtggagacagcaagggataagagacattggaaataagtatcatgtcaaccaaccaacagaaacttccatgcactgcaatctattatttcagctaagtttcaaaacttcatattagttatttttattacacccatttattgaatgagtaactcaaaaattaagattattaagcaacttctctcaggtctcacaattatgaatagtggcaatggagcttaatccatgttgtcaaactcctatctactctcaacgactacactcattttttaagagaatcaaagaggtcagcacaagacatacaatttaatttctgtcccaatttttttggttgtgtgccttcctttacatccttttacttgaactttttacaaatttaaggacctttctttgccaattctctggccatgcaaatatgttaacattccttttccttttcttttttattgggatcagtttcatatttgtacattcttgggagtatctttttactcatgagattttacctcttttaggatttcataaagctcatattttattaatgtgcatgatttctacttttacttcaagacaaagcgtgcatttttacatggaaatttactgaaataggaatataaatttaaaagttagggcagatactcttgatttcttgttcaacaatcattgctagtttctcatctttgcttagaaattcttggttttattcagacgtttgaatatccaagtggatgacctttgatgtgttctgtttaatatttcccagcagatcacttagatatagtcatttttaaaaccatggctagtaagacataaggggaaatcttctaggatgatttgagcaagtcttatccttcataaaagagttacacgaattaagtcctccccatttctacatttgttcattttcatgtgagaactgaaaatgagctgcttctgttccttgctacggtgaagttaaaggcctcaggacataattcaatcctctgaggttgacagatcagaaagagggaaagcacctgcctcctttattcttattgcggaatcatgtgaaactggaagcacaaacttacagtattactgctatgaggaagataaactcttcaaaaatacaaatgttaagatgtgtctcatagttttcatgtgaatgttactattttgtcattatttaaacaatttagtgaaaaggaaatcttattaaaatgtacttcagatgccagatattagaactataagttagaaagaacagaaaggttagtgcattgaaagaaaattgaatagctcactgacttataacactaacccaaagctttctcacaagactaacttcacttcagatttgtaaaaatttctgattataaaagtcatagaacaaaaagagaaagggaacatatcattttcctgactaaatgtatcagggaccaacaagcttttgctacaaagggtcagatagtaaggattttaggttttgcagactatatggtctctgttgcaagtattcaactctgatattgtaacacaaaagccaccatagacaattataaatgaatgagcatggctatattctaatagaatttttatctatggacactaagatttgaatttcatacaatttgacacaaaatagtattctaattttgatttgttctttctcaaacatctaaaacttcaaaaccgtgttaagttcctgagttgtacaaaaatagatttgtacaaaaatgggtttgttttgcagtctttagagtttgccaactcctggagatagaaaaataattcttgtagtccaatttgttttcagctatttccccactaccatgaaaataaatagaatttcatatacaccctgggctttggagaaatccgttttgggtgtctgttctctagggaaagctcttatataaagcagatgttcccaatcagttgctagaggattcatgacaagggacttcaaattagtgtgtgcataaaacaatgtctatggacaaaataaataaagtgattcatggttacatggaaaaaactcaagaatcctccattcttcttcccactactaattgtatcttgctttacttaaacctaaaaatttggaaacttttagccaaaataaagcaaaagaggcaagcgccttcaccctttatatctttgtcatactaacactatagagtataagttgccactactttttattatttgatatcaccataagagtggcttcactcacccattattcactgttttattctgtatatttggctatctagtcatcttaagaaaaatacgtatgccaaaaaagcaatagcaagatagtaagaacttgccaacttaagaaacatctcaatctgaattaatgaaaattataaatgaaatagaataatttaagtgaatatactttattattttatcaatgtaaaagtaggccaaagtaaaaaaatatttgagtgatttattttagagtaaccatagatctcagttgacccggaacaatgccaaattagaacacttgtcctgtgtacagttattaataagtgccccatttcattctgaaaagcacatgcacatggagaacaaactgtatggtggttgtaattttaggaaacataagagactattttgtagtgtctatctgatcattctattttctaaagtttttagaagagcctaattctgatgtttgttctctctgcagaaatgctatttacttgtgaaattttgaattatggaatgtgaagtcacgttcagtaggatttatttctgagaatcttgtgaggccttggttgaggacagttcccgtccagacaggttttgcttctgccaagcatcctagggatggtaccaccataaaactactttatatgttattttctcaggttaaagccttccaaaaccatgcatataatacaaatgctatttgcataagtgcagatttattattatgagttatcagaaaagaattatattttaaatccaggccaaaatagaatgctttcttgcagtttttctttgctggtgcatgggattttttctgccaacctgtcctttcactgatagagcccttagaaaatctttgctttatatataggcatcagtttctactcaccagcatctagctgacatggttatcaaaacccaaacagtctacattccacaagacaaagcattaacaactacttagccctcaagagaggacacctctagaaagttcttgctttctagaaaactcatctcttcatttcaaaggatgcttgccatatattatctagcatttttatagtgtgaggagtttcaaatgatctaatatcctgtatttccaggaatcaaatggaataaaaatgggaaagagaagcataaaactagcaaaggacaagttggagaggtaagaagaaagcctaaatagtgaatgtaactgatgttaagggaggagagatttccaagaaggacctgatcaaccacctgttgcagcagtaacaagaaagataaaaagtgagaaaaagaacattagcttcatgtaaatgactgctaggaacttaggaaagtaacttcagaacaatattttaggtggtgatccctgaaaaatatataatgtattaatttgaagaaatcagcagaaaagaagcagagagaaaagaaaagaagagagacttaggataatctcttgaagcaggcaacacttcattaatggaattattgtaaaaattaaataaaataactcatgcaaaccctaagcatggtgctttgcggacacttaataatcacagttactttcaccatgtctttccttcctccatgagaaaaataatacaaatgctttaagatgctacaaggtgagaactttagaaaactgaattctcacagaaagtgtcatgcagaaaagtgttcacacagcaggtctgagttgctcaaaccctgcacattcccaagaaagacctatctaatgtgattgaccccaaataaaaactctgaatatcaaggttcaagtaagcttccttgtttaacaacacttcttccttgtcacacatgattactgggaaattagtacatctaggaaactccactaggagagagcacctggaacattgtgcctagttcctcctggattttgccccatttcccttttcctttttgctgattttagtcgatatcctgttgttgtaataaataaataattttgtaagtgtaacagtttttctgaggcataggagtccttctagtgaatcaccagtattgaaattgctcttgggaacccccaacacaactacaaaatagttttatatgtttcttaaagttatggtgacatgcaactcattttccaaactgcatgtactcttcagagtgaaatgaggcactattaatagttacatgcaatataagggggagattaaggttcaaattgaacatatttttacgaggaaatttttatcataagtgaaaataaagacaaaagaatttagtaattaggtatcttaaggagagagccaaaactttggaatagacagtgtgaagagtattcactgtgtcaaataaacaaacataactgaattgccaaagagtggtcagagcccagttggatttatgagaatcaatttggaatgagtcagatatgctcagtaaatggaaatttctccagaggtcctcttcagtaaaggaactaaaggaaaggaaagcagattgtgagaggacttttaattctcacctaattactaattaggacttctaattactgccgatagccctcagatgtttcttagggtctctttctaggcatacacataaccatcttcccacattggatccctatcacaccttgacaataatatgataatgttccggactcccaagttctaatctgcaataaaaacactactttttctaattaaaaaatagtgcatactcattacatttagaaaaactaaaaacattaaatataatgaagaaatcacttcttatacaaaacccttatgattttgctgcatttacttacatcccttttaaagtgataatgttcataattacacataaacttacaagcagttttaatttttaatgggactcctctatagaaattttagtgtacagtttccttcaattaatatttactataagcatattaccagtgaatgctaaatatgctttaaaggtataacctttaaatgactttataatattctgtcataatgaagcattcaatcccttaattttacagatgagaaatctgaagcttaaagaggttaagtgacttctccaaagtcacagagctagttttgttagatttaggaagagaaacaatttctctaaagttcttatttaatattttattacttcactttaatctaccctgtatagtgccactcatataactgtcctcaaatattgaacgtatcatatcacctctctgctttagcacacaggcacccaactgcatagaagaaaatgtccaaactcttcaccctagtattcaaggtctttttacaaatcagctttacatcactttccatgtcctaatcccataccactttacattaattatttgcttatacttagcccataccattaccctggaatatagtatgctaattacagaatccaagacttacatatcttgtttccctcgccaagatttaatttcctcttctttcatatgcccaaatactaaaacccttcagggctctattcagattctacatccttcataaagccttttccacccaccataactcactctaaactcttagttctctaaattcataaagccttttccatatgaatagtagagtgtcttcccatcagatgtaaactatctcaattattcattgccatgtcaatctcctctgcaaatgtgatgcaaagaaaatattcaaccatactgactagactcacttcaaattcataaataaaaacctcagatgggttcttatttttcattgtggtaaaatatacatagcataatattaataattttaaccatttgtaaatgcacaattcaagggcatcaaattcattcaaaatgttgtgttatcaccatcaccaccaccacttcccaaaactttttcattatgcccaataaaaattatacatccattaaatagtaacctaccttttctcctcctcagaccctggcaacctgcattttgctttctgactctatgaatttgcctattctaggtacctcacgcaagtggaactgtacaatacttgtccttctgtgtctggcttatttcattaagcatcatattttcaagctctatccatgttgtagcatatatcaaaatttctctcccttttacagctgaattgcatttcactgaatgtgtataatttattttgcttatccactcatctattgatggacacttaaattgttttcatcttttggctatgaacattggtatacaaatatctatttgagctcctgctttcaattttattggatataagcctaggaatggaattgctgagacatgtggtagttctatgtttaaccatcttatattcccaccagtaatgcacgagggtttcaacttctttacctcctagccagcacttattttccattttttgtattatagccaacctggtaggtgtgaagtggttctctcattgtgtgtttccctaaactagtgatggtcagggtcttttcatgtgtttgttaaccatttgtatatctactttgaagaaatatctatttatgtctcctgcccattttcttaaattgggttgtttttgttgttgttgttgtttttgagtttaaagagttctttatatcttttggatattaattctttatcagatatatgatttgcaaatattttctcccattgagtagattgccttttaatgaaggtcatttatcaattttttccttgtttgcacttttgatgtcatatccatgcaatcactgccaatgcaatcaagatttcctatagtgttttcttctaataattttatattttttaactaagtttaggtcttgaataaactttataggaggccattggtttggactgagctcttgcactaggttcaataaaccaaaccaaaatggagtttctcatgcagaagttccacaccaccaagctaaaactgagtggtttatctgagcttccaagaaattgaaagagataacagccaaatcctcaaacagtccctgttttagctggaatgctaagaaagtctactctgctataatctttccaaggaaaactctgtaatgcccaatccgcttttgttttttgttgctgctttcctcagcatttttctgtctataaagccaagctcctatgctcagctcatcagaacactcattctattttatagaataagatgttgctggattctagaattgcaaataaaagtctattaaggtatttgaactaaatttgttataattatgtgttttagcagtcttggagttaaattttgcatgagagtctgaatccccatactcaggtagctaactcccacttctatgaactccaaatgttgttagtcaattatacttatctgtctggtctatgtagatgcccactctcctaaatgactatttcacaatttctctcttctcaccccataaatcaccactctcagccaattacagtacttcctatcttgtcaaaaaaattgaggcaatctgaggagatttctacagacctccactgccatctgcccaactaccagcatctgcacatacctcatattcacagttaagaataagggattatgcaaggccttaaatatcaggaggtggaaatcattgaggccatcctagaaacctacgaaccacaaccatgacacagaaataaattctgaataattttgctgaccacagttttcaaaacaccactctggtgaatggatgactaaggttaacgaggtcaaataaagcaaaaaaacaaaaacagaaaataaacttaaatcaagttttctgcttatcttcaaacttcaacaaaatccttttgtggtaagtttggaggagggaagagcatactttctcgcatttatcggcttcatttctctaataaataactaataaacaggcatctttaattatattttgtcagatataaaatatttcaaaatctagcagataatggttagccatgtctatcagaaattcaagcatgcccactaacaatatacttgtaactgcaagcagagtctaacatgtaaaactctgaaaaacattcaacctgaattactcattcatagaaagcaaccctggttcaaagagggaaaactgtgctcttttgcaagctctagtattattttctattgtaagaattcatccatgttctgcaactgagttacctttaattacactcacatatgcttattttccacagacatccttcattttcttctctctaggactataaattgccaatttctttaagaaaaaaagcaaagatgtacttcatactgccttcatttctcttcaactttatttgatatgtttataaactatctggctctcaagaatagactgtcaattgtgtgcatacccaaatttgaccaatactttcttaaagaaatgagctaaacctttatattaagttgtatttattgggctccctgaatacgctacagactgatcaaaagctctctctaagtttattttcttagaagatgaccctctatgaaagatgtgcaaaattcatgttattttatgggttcctgtatctattccatgttctttggttttgaattttaaaaagtccttggatagaagtcttaggaaagacagcctgatgaaaaattctctaaagagttagaataaatattcatggcactagcaggtcagaggagtgacaaaaagctggcaccatgacatagataagcccttcaaattcaggttttatgcttccgattggaccaatcaaaattatctatctttctgattgtttctaactctccccctcccttcttctctctctctctttctctctctctctgttgttttcctctctttctcttgttcctccccccaactagaattattccaaatttttctacttgttgaaggacatcaatgagtcactcaatgacatcttctaccttggtacattatgatgttttgttgttgagaaaccattagataaacaaaattattgaaagagaaaaaatgagattgcgtttcttaataaattatcccaattccctgtagttttgttttgtttttgttttattttgttttgttttttgagatggagtcttgctcttgttgcccaagctggagtgcaatggcacaatcttggctcactgaaacctccacctcctgggttcaagcgattctcctgcctaagccacccaagtagctgggattacaggtgcccgccaccatgcccggctaatttttttgtatttttttagtagagatggggttgcaccatgttggccaggctggtctccaactcctgacctcaggtgatccacctgccttggcctcccaaagtgctgctattacaggcgtgagccaccgtgcccggcctccctgtagtttcaacaaatgattttgcctgctacttcaagggggaaattagtgtcttttagcaagaactccctcaattacttgtcccctcctatcactccaagaagcataggagcatttctattatttctattttcttcctttttatttcaatggaaaaaaaaaactgattgcaggccactgatttcggtggtaaaaaggtaaaacatatttaagaatgtttcacatatatctgcttaaatttctatgtgctcatcactttgactccctcttttgttatcttattctcttttggtagatgcacccctctttgctatcagcaagttgcagaaaaataatcaaggcagcaagctacaactgtagattgtaccctacaccaatcatgtgtaagaggcactgtaagaaggcactctatcatttaaagccccctgaacttcccttcaagcagtaaaaacaccagatgaaagatacgagaaatatgaattcatagatattttctgtatttacactgatgacagccatattacacgtattgcccatgaagttgaaaacttggtatggtccctcttatttacaattcaagtccatctcctcattatctcatccttttcatctgttctttataaccaaaaccctttgcaaatgcctcccagaccttccccccatataaagttaattagatcacgagcagctcttctaattaagcttacttcaaccacaaatgcattttctcattttattatcactaacaccaagatgagatactgtgattaacaattaggtgaacgctctgttccatgagattgagtctcaagtgcaatatggtcttaactcaggtttctggtcacaagaaagtataaacactttgcaaagtccttgaaatcttctttaggtcactcaatgcattccagaattgaatgaattaacactttctatttttactcctaatctgaatatatatccgtaacacaaaacaatagatcttcttctgattaatattaaccacctctaatatacaaatacactaaaacctccactagctcaaaaatatcaagtttccaaacaaatatattcatgcattattaacggtcagtaagttcatcctgtttctgtatggtgtatgttttctttgtcattttcttgtacatatttaatagagttgtagatagacaatagcttgaataagttgtgaggttaaaatgtgtgactgtatcattggtcctatactagccccaatttaccatacaaaattagagaaagacacttaagctttctgaaacttagccacctacaatgaatgaaatttctgctttacaaagttgcttgtaaatgttgctaaatgagataaattgtagaatactaaacaattttaattaaaattattatggttattattttcctacataatttgaaggtgttagtctaggctctaggggtttctgaattactggcctacagtcttttaattggaataaaaatggtatattaagaggtagtgacaggtatttcaggaaaaataatttttgtttattaaagtaccttaaggggccatttatgtaagaatagaaaggccctagagggcattctgcaaggaatgtgtaaaagaaaagggaaagggaaagtgggaggagcaaaaggactcttataaaataacagacatttataaaaatcattctactataaagacacatgcacatgtatgtttattgcagcactatttacaatagcaaagacttggaaccaacccaaatgcccatcaatgataggctggataaggaaaatgtggcacatatacaccatggaatgctatgcagtcataaaaaagaatcagttcatgttctttgcagggacatggatgaagctggaaaacattatcctcagcaaattaacacaggaacagaaaaccaagcaccgcatgttctcactcataagtgggagctgaacaatgaaaaccaatggacacagggaggggaatatcacacatcagggcctgtcaggggggtgcggggagaggggacggagagcattaggacaaatacctaatccatgcagggcttaaaacctagatgatgggttgacaggtgcagcaaaccaccatggcacatgtaaacctatgtaagaaaccagtacattcttcacatgtatcccagaacttaaagtaaaattttaaaaaaatgacagacatttggttttattttgttctggcatttcagatatgaaaagggtaaagaacccaataattaaagacacaaggaaattttagatggaaaaacagaaaaaaaaagaatttagcaagatggcaggaagctggggataataaagatgccagggaagccctgcaaaagacagaaaaaaaatgaacgtataatatttatattaaattcttgctgatgagaaagacaaaatgcactgaacaaataatgagatgttttattcaagttattacagagatgatgtcattagtgagggaagtctcaaagaaaaggaagggtgccagaagttttatagaggcaggcaaacaaagtcatccacaagtcttatgggagtcatgagaaagaatggagactggtgttagagtatgtaagggcagtgtggtggtactttgccactagcctttattctgaacacaaaaattgggaggacatcttaacttgcactgctttcccacaacgcagggctcagaaaaaaaaataacattgtcacttgtctctgaaataatcccccttctttttaccatccatctttagtaaattctgctgtataaggtactttgagagaactgaaggaaaagagagttaaattctatgttttaaccaatttaatagagggaagaaaaaataatccaggtggtgagatattaagaattgaacagaaagaggaaattaaaacaagaggtggtcagaaagaatgtaagccatcaagaacttttagcaatattgcaaggtcaggaagtaaggggttggatgtttcaatgtatgtagaaaagaaggttggaggatttagcaattcccaggtggtaatatttggggaattcatataaaactgaaaaaattaggtactcataggaaatataaaaaatatttaaggtggccagcaaaatacttgtttgctggagtttcaggtgcagtctaaaagtgcatcctaaggaaggaggcggcattcctttttctacctataataagccagagagttttagagatgccagttttggagactctaggaattataggcaactgaactactgcaagagcttcctaactattaatctgcttccactgttcctctttccaatctattcttaaaattaacataagtttcctcaagtatgaatcagactgtgtcacttccttatttacagcctctcatggcacaccaagatcattcataagccaatatagttatagtataatcttctgccactctcaccaccacttaccatattatattatgggctatcgctcaaacaggaaattctttcatgttaatctattgattttcgcacatctaaatagaatgtactactcctaaagcttttttcacaatttattttatcagcaaatttatcacaatagctccagctgctgaagttcagatttccccactggactaaaagatcaaggacaagaactgtggtttagattttacatatccaccctaccttccatacccttcccagaatctagctctaggtatatgttcagtaaatgtttttaaataagtgaaccactgtgctataagtacctttattctggtaagtaaatgagccaaggcaagatcatatctggatatatataattctcatgaaaaggtaaatttcagtttatacaatacacaagttgaaatatgataatctctcaaggattatatagagaagccacaagcttaaaacagtaggttgaaatatatagtctttaaaattccatccaaccctacaagtcaataattctgtggttaataagttagaaatggaaacagatgagaatcagaaaggaaatataatactaagcatctaaagaaggtcatcttggaagagaagatactgtaactcaaatccttactgtctatgtgcatacctctgagcaagggtcagtatgctagtttcccattgctgctgtaacaaactaccacaaatatagtggcttaaaacaagacaaatttgttatcttacagctttggaggtcagaaatggaaatgggtcttaatgggctaaaatatggatgactgcaaggctgcatttctttcaggaggctctaggacagcatccatgccatgccttttccagcttctagaaatcacccacattcctgggctactggcccccatcagtcttcaaagccagcagtggcaggttgagtctttctcacaatgcatcactctggctctgactctgcttctttcctctttcacttataaaaacctatgagactacatcaaactcactccaatagttgaagataatctccccatctcatagtcaaccaattagcaacctgcaactttaattatcccttgccttatattacaggttgaattgtgccccccaaaaaaataccttgaaattccaactcacagtacttcagaatgtaccttatttggaaatagatttattgcagatgttattagttaagatgagcttacagtggggtaagacaggcccttaatccaatatgactggtgttcttacaataaaagaagacacagagaaaggaagacacaaacgtacagagggaagatggccatgtgatgatggaggcagagatgagattgatgcacctagaaacaccaaggataaccaacaaacaacagaagctagaagaagaaaggaaggattctctcctataggtttcggagtgaccaaagctttgccaatatcttggttgaagacttcttgcctcctgaattgtgagacaataaatttctgttgatttaagccacccagcttatggtacttagttatggcagccctggcaaaccaatacaccatataacacatattcacaggttctgaggattagaacatggatatcttgggaagctattcttctgcctgccatagtcagtgggagaagtgataaaaatagaggacttttgccctctaattaagaaagaacaagataaatctctttctgaagaaatggaaatgatgatcttttttccttttaatttacatactgtcctgaggcttttatcttcctggaacttctattaagtattccagatcacttagcaacaattttcaaccacagctttttttgctgatttactattatgttaagtgcttacctcatatgtgtggctattttaagttcagtttaggcaaacatgggatttaaatggaaaatgcatagctgaagcatagactagtcactatggcagagcctaagtgaactgggaaaaaaaaatctatgccagctcagtgtccttgagttttcagaaaggaaaagaaaagattctgctttctatttttggaggttttaaagtcgtctctaaatttgtatcagtgaagctaatgtcaaacaatacttttaaaagtggcaggagttctttccttttccttattttgaaagaaatatatatttccaaagatcttttaacctcacagaagcaaaatgactcattttccatctttttgttctgtcagatttatctttttcctttcttaatagagcaggattaacacatttgtcttttgagataaggcacactctgtgctgttccctagtgaccaatctttacgggaacattagactcagacctgttctgcccacacaactagtagctgataacagaagggacaggagaatgttcatggggacagttaaaagaatgagagtttttggcctaacaggatgcttcctccctatgaaaagaatcccatttgccttagagatgtgcgcaccattaacaaatatgcacacttacttcaattatgggacacatgtagctaaaaatgcctcaggggaaaacatacagggagaaaatcttattttacaacagcaatggaaaagaaaatcaaagctattgcctctctgatatttggaaagtattccacactaacttcaagtattccaaattagaagcaaaaaaagcttcaaaacaataaaataagtcattcaagaatgctttgatttcttgtgaaatattttcatttcctgagatattactatcagattatgaaaagatattattcctaaaattatatggctaaaaaagaggaataatcagttatagtgtttgcataaatgtcactatatctcctttctctgatatttaaagcttcctgattaaatcttccctaacgttctttcaatttgaccttcagaatataaaataatctacgttatattttggatacaaatcttaacatacctctgtttcccattgttgccgtaacaaactaccacaaatacagtggattaaaagaagacaaatttgttttgtattataagtgctgatactctactataattctcagtgggtactatgtttgtgttcaattgacttagcatggaggatgtagctaacatataattacctggtgcataatacaggaatattttttggaatggtcatgaggattagccatgatcagtatgaaataaagcccagcatacagttgtctatatagtgttagttacttgtgtagcataaaggtggtaagtagtcaatttaagcatgctgccctaaccttgcaccttggattctaaaacagaagagactaatgatgttacacacaaaaataagctagaagtctacaaaacaagaaacaatttaaatctagcaggaaggattttaaagtttgtgagcatatttaaatatcaattcatccaacatgtttctagtatttagtttactggatttcagcacaaatttctatgataggtgacatgtaactaaggcaaatagagaacctacaagtagggaccaaatattccagtttggccaggatagtcttattttatgcctattgtccgggcatcattaacagaacacagcttcacaatttattttggggtcttgttcccctaatgaagacatttctggcattctagagagaggcattccctcctgagactccaggcccatggagggaaactatgaccagccctaccagcaaggggaattcattccatgtgatattatgcaaatgttgctgattacttatcaatagcaatcagtatggatatttctattgatttttcttgacattgctggtttcaacatttcttaactctaagatgataatatcagccacatttttattgcataatgatgatcatgaaacatccttaatatggtcttcaaggcctacaaaatttgacccaagttcatttctctatcctcatcttgcaccactttcctaacccctccctattttagccacatgtgccttttttagttatttgaattccatgctcagaatcacagaacatggtagagcttctgcttggatccctcttcaaatccaacctccacaacaccacatgcacacacacacacacacacacacacacacagaggcacagacagacacacacacacacataggcacatgcacatgcagagtgaacttacttttagagtcctcaactcaaatggaacttgcctagggtggaccaccttaacctcaagactagaacagattccatcttatacactctcacagcacaccttgttttttatttacagcacttacttcagtttgcaattagaaaatatttgtataatagctgatgttcccctttaagctataagatacattaggttggggctatatgaatttcgtgcactattgtatttgatacactcagcatagtgtctattactaaggaaatgcagcataaaaattgttttctgaaggttaaaggatacaaggctggaaagatgagaatatgttagatgagagaattagtaatcaaaataaccttcacagattagagaggtaacctacaacaaatgaaatgcagcagagataaattttagatcccccagtttaaaccaaagaaacaattatacaagaagagggtggagtaattaaaagtatatatatgtttaaaagttggtgacaggatttttttaccaaaatagtaagaaatatttctgtttttttctttctaccctttcccttattcctccccacaagagaaagagtatgttatttaattcatatgatggacagaatctaaattccatggagtctcagccagcaacaaaggacatggcattggaaaagcattactttctttttctttgcatcctagacatagctgaatccagaaaaaggggtgctagaacctcctccatacagaatgactatgcagggccccatcatagttttgaagttagttttaatatcaatattataagtgctgatactctattataattctcagtgggtactatgtttgtgttcaattgacttagcatggaggatgtagctaacataaaattacctggtgtataatacaggaatattttttggaatggtcatgaggattagccatgatcagtaacagatatattcaatacaattgctgaagagatgttaaaatcttggactgaataatgcagaatgtagaacaaaaataataataggcacattctactcagaactgctcagaacactcttggtgtactgttcaatccaggaaactccactttaagtgatatactgagaaagatagggcatgttttgaggctgttcacaattgcattattattcctaattatgtgctgtcctccctataagaggcttgtagatgtcttaacttgatatgtgacagtaaatcccagtgggaggtttatattttcccaccccatcaatgatagatttggacatgtgatttgctttagcttaaaaaatatgtaaaagtgatttatgcccttcctcaacaaattttgcactttttccttctgttagattggcataacttagggggtactccttccaactgagtcctaaaatgaagatatatggagaagaacttcaacaaaccaatagctgatgttttatgtgaatgagaataaatattgttgtaaccactaagattatggggtttttactactacagcaatgcttagagaaaactgactaatgcatacaaacaaactaattcagagtcagacaacctgaacaattaaagactttgaacttcatattaggaatagttgaaggaactgggatgttctatttgtcaaataacagatgtggagacattgtaataccctttaaatatttaatgagtgggcaaatataagagtaagagaactgttctgagtattcttatcatgtcaaattagacccaattactggaagctttagggaaatctatgtgagctcaatattagagggaactttctaacttgcagaggtggtcaaagatgaaattggaagttgtaggatgctttaaagggtttactgatattgggaggtactgatagctcaatatatttagtcagggatggtttaagaggattcaaatattggttgggtcaataaactaatatgatctctatttaaaacaaagcacaaaatttataacaaagtaccaaagactttccccatgtcctatagaccaactgtcctttatgtcttggttttcttctttcattctgttcttgttcaaccattgtgaatagtaattggcaaacggaggaaaggatttctttttaagtcagaggcttcaaaaattaagtctcagactggatgtggcaatcaaatattgagaaacatgttattcccaaagatttaaacatttaaaataaaatagggtataataaatataaaattccttttatcccaaacattattcaaaaataaaaatactaatgagtacacaaagatttatgaaatgatcgtctattgcatgtgagcccaacataatttctacttatctatctacagtctatgtgtatttgtaggccttatcataacaactaatgggacatttgagtaatattaatttttccacccaatataggatttgtaaaactaaagagttttaatagcaagataagccaatctttaattaaaaatcaatgaatcacatcttcagaagaattttcatgcttgcttttatgagaaaaataactctttagtaagttttattttgcttttgtttttgtcaaataaataaattcaatgtcatcttaaaaattaacatacaaactgtggctgccagcatctgtttcctctatctcttctaattaattttattatatttaatttttagttattgtaacatatgcttaattgtatcacccactgtaatttattttttcaagcaggtagtgtacaaccactaaataagtaaacatttattaaatcccaataatgaatttaaaataactaaaagaatcagtatttttaaaatctgaacaagattttctatatgtctaaaatttcaaaatattcaacataagcaacacaagcaatttttgatgagtcataagaaaactttttggcatcaaatttagaagtcacagttattttatgacttaaaaggcaaatgaaactcagttgttgataatttgagaaagaagctttatagtgtctatcccattaccaattatgtttatttttctcttctaccaaaatgttgattaaataccaaatacaatgtgtttgtttaatcagctccttcattttatatttataacaaccccatgaagaagtgcagtcactgaaacagggaagatttgatttcattttgtcccatccttgctaattttttaaagatttttaccatttatcctcaacaaaatggatttcacttgataggaaacaataatacagagagtctgaatctctctgacaattaaacatggtggcatgttttaataataaactggcttctattagagtttaaattttacaatataaatacaatttgctgtacttaattacaaagggaagggaggaaataaatattacataatttatgtttctgtgcagtttgttattcatatttggcattcataaaattgcaattttggaagcaatttttaataaaaataatgattcgttttgtcttctaaattagaagactgcattacttaatgagtatttgaatgtgttattttaatcagtttatccatattatatatatgataagcccacacaaaaattagtgtttgatttggctttttcctaacaatctggcatttttgagaaaacaaaaattgattgaaacttaacagaggttaagagtcaagagatgagaagagaaaatctgaaataatgaagataaaacatagagttggccaggcacgatggctcacgcctgtaatcccagcactttgggaggccaaggcgggcagatcaccaggtcaggagattgaggtcatcctggccaacatggtgaaaccccgtctctactaaaaacacaaaaaaattagcgggcgtggtggcgggcgtctgtagtcccagttactcgggaagctgaggcaggagaatgtcgtgaacccaggaggcggatcttgcagtgagccgagatcacgccactgcactccagcctgggcaacagagcgagactccgtctcaaaaaaaaaaaaaacataagagttaacctcttgatactaggttcatgcaaatgacttgccaggccaatgagaatttaaagacacaatgcaaagacttaaaatgggtggatattgttaacttaaataaaatccaatttataaatttagaaaaaagagaaaaggagactttattttttatagtgttacagcctgcaaggtggccattctgacaagctgagaagcatagcctctggccagaagccagaaacaaatattttattgggagacagtggtgggcaaagggaacaggaatttatgctgagtggggtggccacatatacttatttaataaggtataggaggagtcatgaatatttatgaaaggagaaacgtgcacatgtgcaattgtgcttcatgcttctccatgttcaaaactggcagtaataggaaggtgtagtttttggccctctgatgtcaaaaggtaaaataaaggacattaaacctttactgcacattctcatagactggccagaaccactccatagtttggtggtctctcttttttttttttcccaagaaggagtcttgctctgccacccaggctggaatgtagtggcacgatctcagctcactgcaatctccacctcccgagttcgagcaattcccctgcctcagcctccagagtagctaggactacaggcatgtgccatcatgcccagctaatttttgtatcttaagtagagatggggtttcaccacgttagccaggctggtctcgatggtggtctcttaccaggcaaaaaaggaggggcagtgtcaggcagttggttgataacagtggtggcattatttgaaagggctagtttctgtttagcctttagagaagaaagcctaacagcagttagcaaagctgcaaagctgcagagagggaatgaggtgtgtccaacctcctatcctgacatggctgagaactcagtttccaaggttactctggggtctctatggccaagagatggtttgttcagtcagttgggggacttagagttttatacttagtttacagtatgcacaaggtagcttgcactcttccacttttgccaatgacagaacacactcaggttaacctagtacagaatgagagccacatggagtacatataagtgttccagttgctgcagcaatgggcggcttcaatcagccaacagccagctgattcccagacatgtgagcaagcccagtcaagatcagttgaacttcctcatcaacccccagcttttcccagacaaaagggcaataaacacatgcctccaaattctaggctagtttgttatgtagtaaaagtaaaaaaaatagcagataatttgtgattatcagatataatttttggatattctgaagtacaactggtacccttattacaataaaatagacctaatacttaagcactaaaggagcctaccctcacaaaaaaagttattaaaaaaatcatcttcgtttcaattattttatatatatatatagaaaacacaagagtttctcatgcatatatgaacatgtcaaatttatgaaaacatatatatgtctgtatatatatgtgaatacacagatatgtcaaatttatgaatacgtacatatttatatgtatagacagcatctaccacatcccatgcaccattttaggatatggaaatgaactaaccagacaacatcttgccattataaagttgaaattctggaggtggcatactaataataaataaattaacataaaatatgaaataagagtccaggcatggtgactcaggcctataatcccagcactttgggaggctgaggcaggcagatcactgtaggtcaggagtttgagcccagcctggtcaacatggcaaaaccccatctctactaaaaatacaaaaattacacgggcatagttgtaggtgcctgtaatcccagctactcaggaggctgaggcaggaaagtcgcttgaacctgggaggcagaggttgcagtgagctgagatcacgccactggactccagcctaggcgacagagtgataatctgtctcaaaaaataaaataaaataaaatacatgaaaaaagtaccacagataaaataaagtagggtaaaggggactgtgagttctaaatgtgcagttatcaggaaaggcttcactgtaagctgagatctgaacagagacctgaaggaaatcaagaactgagtcaggtggatgtttggaggaagaacattacagggtgaagctcatttggcaagcacaaagaactgccatgtgcctagagtgcaatgagcagcggagagaaaagaaggaaatgagttcagagaggcagctgcaggctaggataaggattttgtttttttaatctaaacaagattgcatgctattagaggttttgagaaaaaattaacatgagaatgaactgtagaagcaagggaagaagcaagtatactggttagcttgcagaaatccagctaagatctttagaccaaatgttaacattagaagtgctaaaaagttcttggaatctggatgtattttgaagatagattccacagcacttgctgatgaactgggatttgtgattgagagtaccagaggaactaaaactgaaggttctaagaaacatgaagaatggaattgtcgctattgagacatggaaggcagagatcaggatgtaagaggcagggatgggatgagtcaggcagttgattttttagaagctcttttttctttttgtctgtattttgatttgtgtttttgagagacctattaaccacccaaacaaaaatgtttaataggcacttagatatacaagtctgaagttcaggaaagaagtgcatgctgtatatatacatttggaatggaaagctaatagtagtagtgctctaaagttcagcttaagatttggttttgaggaaaattctattattcaactttggaaaagtgaatatactgaatgctgccattatttcttgtacttgtgaacaaggaatttgtcatcaaatcctattggcataacaaggtaataaaataaggcacactatgtcaatatcaggtcaatccagagggataggaagcacacggggatttaaacagaaaaagtttaatatgaagaattattaaactatgataaaagagtaactctaggatataagaaaactctgtgccatgctctaggactaagatagagtacctaacgaaggacaaacttggaagggggactctccttcctaaggttggggttcagacctttgtggagaaagtgaagttcagtctactggatgacaaagaagtttgtcagtttgcccagaccagagctggtctgtagttggtgggcaagcaggaagcatccttttggagtacaggaagggcacagaggagacacaggtgggacataggtgagcatagctaggcacgtgagcatgtagaaggaatggggtttccgatgcaggagagggcttggagcccacattgcccatgaggtgagccactgcccagagcaaggtatgcagacatgcagagggaatggggagctggggcacagactaatgacagctagtggggctagacaaatgggcatgcagagggaaagaagccatggcatggcagaaggccctggagcacaaagtgcctatgtcaggagtaccatgggaaacagatctgggatatggatgtgcaaagggagaaataagagtgtcagtgtggaaaagtaggcttgatcttgtggtggtctatattgaaagggcagcaggaaactaatcaccagaaccataaagggctgtgagattgctgagggcctgtacattctgaatggatggctgcagatgcacactacccataccactgacccaccatgcagcagccagaaactggagagccccttcctcctgaaatgtcccttcagcaccctctgctgagaaaacacaacatcatgctcattgtcaaggagaaattcttaaaaggaatttggtccatttgaagagcatgtattaaaaggtaaattttggagctaagaggcaataaattgagagctgggatatatgccattaagatttataattaatatctgaatgactactctcaggtaagcattctagaaataacttttagtaaaattcactatgtgtaacatatgttgaaatcgtatcaatcaaaatttaattgtatgtttattgttgcaagactaagaaatgattgtacaatttgtaatggtttatacaaaacaattattaagaactgtcagtttttaatgtaaatagtgaatatactgacagtcaataccctttttaccagagagtttgttaggcagataactttaggaagaataaatccttttttaacaataaaggcttatcaaaatttaaacaataaatcaaaaaacagtatttgtatataagcttacattgtaatttttgtaaaatgtttgctgtcttagcttcaaaacattaatcaaataacctctcagtatatatttattttgtagtcatttaattttatttagaccatgagtcctacaagaaaaagttctatctggtaattcttctcaaaattataacaataaaataaaaacagaattatcaactttgttacctcaaaatttaatcaaaaagaaaacatccaaaagtaaattaatctattttcaattgtcttctactaaacataacacaggatataaacataaataaaatgttagagagacaggtggaaattcagagacaacttgtcattttggaagcctgtaccattgctgtatttttagatccaagggtggaaaggttaaagataatttattctcaactgatattgtgaagtagcaggtgtaggcaacaattttaaattttaaattgttgcttacacaacaatattcaaaaagagctatgtattttacattaatgaaattgtatcatcactccttttatattacgtcaacaaacatttttatatgccttttctattttatgctttcttagtttcaagctcacttttaatttcctttcagaaataattctttcctattttcttttttataaaacacagtagtgaactccatgatagaaattgactgtacctttaatcatgaatttattggattcaaaaccaaattacattattggtgctatttctaatatgtacattgaaattactgtataatttattattattattattatttttacagacagggtcttattctgttgcccagattggagtgcagtggtggaatcatagctcgctgcagactcaaactcctaagctcaagcaattcttctgccttagcctcttaagtagctaagtgcatgcccccatgcctggctaaatgttttttctttttaacagctggaatctcactatattgtctagacaggtcacagactcatgagctcaagtaatctccccacctcagccttccaaagtgttgagattacaggcatgagccaccacacccagcctgcttttaaataaatagaaaatatgttggcaaaaatagtcacattttatcctaaaattactatactgtatttatactttgaaaagttcaactaaaaagccaaaacatcaattttataaacatttatataatattaagcattgcaaggtgatgtaggaaatgcaaggaagaataatatagcacaatgccccacccctaaatttctcacaacccattgaggaaagataggcacaaataaactattaaaaatatcagaaagcttggcatgacgatacatgcctgtagtcccagctacttgtgaggctgaggagggaggatttatggagcccagggcttcaagtccaacctgggtaacatggcaagactctgcctctaaaatatagggtgtgtgtgtgtgtgtgtgtgtgtgtgtgtgtcagaaagactgcaataaatgccacagtggaccttcagtaattatattcctcccattttaagcaaactggtcttttatttacaaaaatttctttaaagataagcttttgcttattaagcactttgtagcagtcctcaagatttgtattctattacgtatgatatagtaattgtaacttattcttggagtaacttcagttctctttatattactttgtggattacctacccttttgagttttaagtaaatttggcataaaaccatatttcacaatgtctggggtacaggaccttcttaccatctctggaaattttaggacttaattccttataattctgtttttatggcccagtgaaccattttattttcttcagcctcatcactcctcctcctcaagtcaaaaccaacaaataaacagtttgaccacaactcggttgtaccattttgtggcttgcctaagaaattcactcacaccaagcatatcatggttatattcttgctaaaatggttaggtgaggtttacagtaaggagtaggatgcaaatcagggtgcctgctgttgtccacaacttcactgctgtcttttgctttctcttggtggtactttgttcactctaacagttaggattaggtttgggtgagtatatctgaaaacccagaagaaaagtgaattttaactcattctcacacacacacaaaatcagcagtataggatcatagtgttggctccacactagtgaagaacccatctcctttccatcctcctttcccacaatacacagtacttatcttctaacctcaaaaccacataagactgtaaaaatggctactgaggttccagggagaagaaaaaagaggtggaaggtgcaaagtgcatcctctgccagctgtctgtctccactttgaggagtcttcccatatgaccggctcagtgatgtccaaacacaggcaatggttacacctggctatgactgaccactaggtttgtagtcttttagctggatgaatagtcttttgaatagaattaaattctgattaccggaaattgaaatgtagtcagtctatcctatttaccatcctgttgtgataaaaagggcgcataaatagaaaggaatgtaaagcatatgatagagaaagggtagattactgggaataataaaaagagatgaaggaaagtaaatatggcccttggagagtagcattgcaatgtaaagagaaattaactgagggatgaaggtgaagagaataggataaaaacagaggctacacgtgcacaacgtgcaggtttgttacatatgtatacatgtgccatgttggtgtgctgcacccgttaacttgtcatttacattaggtaaatctcctaatgctatccctagaaattaaagtataattttaaaaaatgcaaaaataaataaataaataaaaataaaataaaaacagaggcaattatttattcaccttctatttaccaaacactacacttggttactgaatgtacaatggcaaacaagagagatacaatctctgcctctatgaaattcatattctagtactttgagagcaatgaaagcacaatgtgtctaaattgttagttggaggaccagccacagaataaattggcctcaatattttaaaatattcacaacaaagcaaaacaaatcctcaaactgtcactaaaactttagcagaggaagagactttaaaattgctagtgggagcaatatggtaaagaaatcagtattgattattattattatttttaaaacagagtcttactccaaggctagagttcagtggcacagtcttggctcattgcaacctctgcctcccaggttccagtgatcctcctgcctcagcctcctgggtacctgggattacaggtatgcaccaccatgcctagctaatttttgtatttttagtagagatggggtttcaccacattgacaagactggtctcgaactcctgacctcacatgacctccccacctcggcctcccaaagtgctgggattacatgcatgagctactgcatccagctaattattactgttttaaaatatgcaaaatatcattgatggttttaatttttgaatgctgtttgtatttcagtaaaaatttttaaaaggaattaactatattcattttacatgtatgtatatacacataaattgtacttttacacatatatatttaaatgtactaggaacattattataagttaaacctataaggtaggcactaatagtatcatgaaattttacagatgacaatattgaataacaatttattgggtaataactttgcccatggtcacacaaccaataagtaacaaagctgagattcaattctggaagtctggttccaaagtctgtacttgtaaccaactcattatgcttcccctccattgcctattcattgtctcctttaacttattttccactcccattactttaattttattagaaataaatattctttaacctcaggaactataaagaggctattctctaaacaaaatattacagcgagatgaatggattagggagaacagtaaagagaacaaagttccatttgatgagatctgtctagtgttcggaagaagtggcatttaatatggtattggaatgataggtgaaattttaataggaaatgtggacagaaggacattgcctataggaaagacaaatattcttaaaaagcactaaagccattaatatctactatgtactttaataaaattgaatagataaatcacagaaagataatctctgaaaaatctccaaaactagaaaatgttctttattactattgccttctgtttttcagtatagtgggatttgaagaagcaacactgtgaaactaaaagagcactgcagtgcatgccaaaaatctacaattttttgctggtttccttccgtttactaattttaggagtaataggagaataataatgtcaatctatgctgcctacctcacaagtttcttttaagaattaaaagagattttaagtactttgaaaactattaagtactatacaaatatattaggttgtgatgattaatcactattatacaggagctcagtaaataatatttacaggatggttaaaatgcacttcgtactgaaaaatccatccaagaaaaacttcacaaaaatgcagtaacagatgttcctatttagttaaaggagagaatactgttaggccttcagcttatagcttatacttaaattgtaacaacaacagcttgtttaggtttgtcagttttttctctgtcgatttttagccaatattataccataaaatcatctctttctttaaattagacagaaaggtcttattctgatgcgactttaaaaactgatccaaggggaaatttaagcatgcctcccaggcagcataaaattgagccaaaaattccaattcctatcaggaatctctcatacagactctatgctataagaaaagcaatgcagttttctggaccaccacaagattttcccagccatgttgctatacctggttctattagctctagggaatggacaaaaggattgcaaaatcaatgaaaaactttcagtttcttaccttcttatttcatataaaagctactccttggttggttttacagtcaaatgtatgaagtattataaatccctaccgttctgttgcataaaaagataaattcagttaacttctctattctagatttcattattttagattagatactttgagccctaatacttgctttaactaggataaaaatcattgctcttcagttgtttcattcatagtggattaaccattctactttatttctcatattatatctctgatagagtatcaaactgagatatcaaattactatctatcaatgttctgcttttagaatctatcaatcaggggggtggttccaagatggccgaataggaacaactccagtctacagctcccagcatgagcgacacagaagacaggtgatttctgcatttccaaatgaggtactgggttcatctcgctggggttcgtcagacagtggggacaggacagtgggtgcagcccaccgagcataagccaaagcagggtgaggcatcgactcacctgggaagcgcaaggggtcagggaattccctttcccagccaaaggaaggggtgacagacagcacctgaaaaatcgggtcaatcccaccctaatactgtgcttttccaatggtcgtagcaaagggcacaagaggagattatatcccatgcctggctcggagggtcccatgcctggctcggagggtcccatgcccacggagcctcgctcattcctagcacagcagtctgagatcgaatggcaaggtggcagcgaggctgggggaggggcgtccaacattgctgaggcttgagtaggtaaacagcagccaggaagcttgtactgggtggagcccaccttagctcaaggaggactgcctgcctctgtagactccacctctacgggcagggcatagctgaacaaaaggcagcaggaacctctgcagacttaactgtccctgtctgacagctttgaagagagtagtggttctcccagcatggagtttgagatcacggaatggacagactgcctccccaagtgggtccctgacccccgagtagcctatctgggaggcacccccagtaggcgcagactgacacctcacacggctgggtactactctgagacaaagcttccagaggaacaatcgggcagcaacatttgctattcagcaatattcgctgttctgcagcctctgctactgatccccaggcaaatagagcctggagtggacctccagcaaactccaacagacctgcagctgagggtcctgtctgatagaaggaaaactaacaaacagaaaggacatccacaccaaaaccccatctgaacgtcaccatcatcaaagatcaaaggtagataaaaccacaaagatggggaaaaaaacagagtagaaaagccgaaaattctaaaaatcagagcacctcctcccctgcaaaggaacacagctcctcaccagcaatggaacaaagctgggtggagaatggttttgatgagttgagagaagaagtcttcagacgatcaaacttctccgaggtaaaggaagaaagtcgaacccaacccaaagaagctgaaaaccttgaaacaagattagatgaatggctaactagaataaccagtgtagagaagtccttaaatgacctgatggaactgaaagccatggcatgagaactacatgacaaatgtacaagcttcagtaaccgattcgatcaactggaagaaagggtatcagtgattgaagatcaaatgaatgaaatgaagtgagaagagaagtttagagaaaaaaagggtaaaaagaaatgaacaaagcctccaagaaatacacgactatgtatagaccaaatctatatctgatcggtgtacctgaaagtgatggggagaatggaaccaaactggaaaacactctgcaggatattatccaggagaacttccccaacctagcaaggcaggccaacattcaaattcaggacatacagagaccaccacaaagatactcctcaacaagagcaactccaagacacataattgtcagtttcaccaaagttcaaatgaaagaaaaaatattaagggcagccagagagaaagatcgagttacccacaaatggaagtccatcagactaacagcggataactcagcagaaactctacaagccagaagagagtgggggccaatatacaacgttcttaaagaaaagaattttcaacctagaaattcatatccagccaaactaagcttcataagtgaaggagaaataaaatcctttacagacaagcaaatgctgagagattctgtcaccaccaggcctgccctaaaagagctcctgaaagaagcactaaacatggaaaggaacaaccggtaccagccactgcaaaaacatgccgaactgtaaagaacatcgatgctaggaagaaactgcatcaataacgagcaaaataaccagctaacatcagaatgacaggatcaaattcacacataacaatattaaccttaaatgtaaatgggctaaatgctccaattaaaagacacagactgacaaactggataaagagtcaagacccatcagtgtgctgtattcaggacacccatctcacatgcagagacacacagaggctcaaaataaagggatggaggaagatctatgaagaaaatggaaaacaaaaaaaggcaggggttgcaatcctagtttctgataaaacagactttaaaacaacaaagatcaaaagacacaaagaaggccattacataatggtaaagggatcaattcaacaagaagagctaactgtcttaaatatatatgcacccaatacaggagcacccaggttcataaagcaagtccttagagacctacaaagagacttagactcccacacaataataatggaagactttaacaccccactgtcaacattagacagatcaacgagacagaaagttaacaaggatatccaggaattgaactcagctctgcaacaagtggacctaatagacatctgcagaatgctccaccccaaatcaacagaatatacattcttctcagcaccacatcacacttattccaaaattgaccacagagttggaagtaaagcacttctcagcaaatgtaaaagaacagaaattataacaaactgtctctcagaccacagtgcaatcaaactagaactcaggattaagaaactcactcaaaactgctcaactacatggaacctgaacaacctgctcctgaatgactactgggtacataaggaaatgaaggcagaaataaagatgttctttgaaaccaacgagaacaaagacacaacataccagaatctctgggacacatttaaagcagtgggtagagggaaatttatagcactaaatgcccacaagagaaagcggcaaagatctaaaattgacaccctaacatcaaaattaaaagaactagagaagcaagagcaaacacattcaaaagctagcagaaggcaagaaataactaagatcagagaagaactgaaggagatagagacacaaaaaaacccttcaaaaaaatcaatgaatccaggagctggtcttttgaaaagatcaagaaaattgatagaccgctagcaagactaatgaagaaaagagagaagaatcaaatagatgcaataaaaaacgataaaggagatatcaccactgatcccacagaaatacaaactaccatcagagaatactataaacacctctacgcaaataaactagaaaatctagaagaaatggctaaattcctggacacatacaccctcccaagactaaaccaggaagaagttgaatcccttaatagaccaataacaggctctgaaattgaggcaataattaatagcctaccaaccaaaaaaagtccaggaccagatggattcacagccgaattctaccagaggtacaagaaggagctcataaccaatccttctgaaactattccaatcaatagaaaaagaagaaatcctccctaactcattttatgaggccatcatcatcctgatactaaagcctggaaaagacacaacaaaaaaagagaattttagaccaatatccctgatgaacatcaatgcaaaaatcatgaataaaatactggcaaaccaaatccaccagcacatcaaaaagcttatccaccatgatcaagtgggcttcatccctgggatgcaagtctggttcaacataggcaaatcaataaacgtaatccagcatataaacagaaccaaagaaaaaaaccacaggattatctcaatagatgcagaagaggcctttgacaaaattcaacagcccttcatgctaaaaactctcaagaaattaggtattgataggccgtatcttaaaataataagagctatttataacaaacccacagccaatatcatactgaatgggtgaaaactggaagcattccctttgaaaactggcacaagacaggttgccctctctcaccactcctattcagcatagtgttggaagttctggccagggcaatcaggcaggagaaatcaataaagggtattcaattaggaaaagaggaagtcaaattgtccctgtttgcagatgacatgattgtatatttagaaaagcccatcatctcagcccaaaatctccttaagctgataagcaacttcagcaaagtctcaggatacaaaatcaatgtgcaaaaatcacaagcattcttatacaccaataacagacagagagccatatcatgagtgaactcccattcacaattgcttcaaagagaataaaacacctaggaatccaacttacaagggatgtgaagaacctcttcaaggagaactacaaaccactgctcaacgaaataaaagaggacacaaacaaatggaagaacattccatgctcatggataggaagaatcaatattgtgaaaatggcgatactgaccaaggtaatttacacattcaatgccatccccatcaagctaccaatgactttcttcacagaattcaaaaaaaactactttaaagttcatgtgaaacgaaaaaagcgcctgcattgccaagacaatcctaagccaaaagaagaaagctagaggcatcatgctacctgacttcaaactttactacaagcctccagtaaccaaaaccacatggtactggtaccaaaacacagatatagaccaatggaacagaagagagccatcagaaataatatcacacatctacaaccatctgatctttgacaaacctgacaaaaacaagaaatggggaaaggattccctatttaataaatggtgctgggaaaaccggctagccatatgtagaaagttgaaactggatcccttccttacaccttatacaaaaattaattcaagatggattaaagacttcaatgttagacctaaaaccataaaaaccctagaagaaaacctaggcaataccattcaggacataggcatgggcaaggacttcatgtctaaaacatcaaaagcaatggcaacaaaagccaaaattcacaaattggatctaattaaattaaagagcttctgcacagtgaaagaaactaccatcagagtgaacaggcaacctacagaatgggagaaaatttttgcaatctactcatctgacaaagggctaatatccagaatctacaaagaactcaaacaaatttacaagaaaaaacaaccgcatcaaaaagtggccaaaggatatgaacagccacttctcaaagaagacatttatgcagccaacagacacatgaaaaaatgttcatcatcactggccatcagagaaatgcaaatcaaaaccaagatgagataacatctcacaccagttagaatggcgatcattaaaaagtcaggaaacaataggtgctggagaggatttcgagaaataggaacacttttacactgttggtggcactgtaaactagttcaaccattgtggaagacagtgtggcaattcctcaaggatctagaactagaaataccatttgacccagcaatcccattactgggtatatacccaaaggattataaatcatgctgctatcaaggcacattcacatatatgtttactgcggcactattcacaatagcaaagacttggaatcaatccaaatgtccatcagtgatagactggattaagaaaatgtggcacataccccatggaatactatgcagctataaaaaaggatgagttcacatcctttgtagagacgtggatgaagctggaaaccatcattctcagtaaactatcacaaggacaaaaaaccaaacaccgcatgttctcactcataggtgggaacaatgcgaacacttggacacaggaagcggaacatcacacactgcggccagtcatggggtggggggagaggggagggaaagcattaggagacatacctaatgtaaatgacgagttaatgggggcagcacaccaacatggcacatgtatacatatgtaacaaacctgcacgttgtacacatgtaccctagaacttaaagtataattaaaaaaaaaaaaagaaaaagaaaaaggaaatcagaaagtatctggaaccaaataaaaataaaaacactcagcctaggcaacaacaacaacaaaaaagaatctatcaatcagccaaaaatgaagattatatgctatatctgtggcctattccttatttataaaattaaaatttaattgcattaaattaggtctaaaataatagaacatctccatagtttggaatattttctaagtgtaaaaaattctactttttactaaaagactatttgttactttttctaaaccaaagtttcttgattcactttcaaattgccttagccaattatttataacatttcactattagagatctgaatatggtgtttatcttgctatagtaatgctgtgatattgaatatgggaaaaaatcactaagggaattaagacaccaagatacagtgccaaaaaaactttccttcgtcatttctgaatattttttgtcccaaatgaaacaagtataaatggtagtagtaaaaaagaaaaaaaagtagaaaagtatagttctatattgaatcagtaggaatacagcagaaacttgactctgggatattttgccctattattcaatgatacatgttgcttaatattactatagtattacaaagaaaaaaaacactaaaaattaacatagaaaataatatttatataagtttggtcttataatcaattggaaatgattaaagagaactatataatgagttaatctatgcatgaattcttgttagatgttttagtctgttctcatactgctaataaagatgtacctgagactgagaagtcttatgagaattacatctataatttctggcaaaatttaatctttctgtatctcttcaaagaaccaccaactataaaagtgtttttaaagaattctgcctgagatgcttttgagctttctaattaaagataaaatgttttacatgtgaaaagatagaggtgctacaattttcttatacttttctgtaccttgcctagataacaaaaatatatatcttttaaaataaaagcagcataattttactagtctttcaagtatgttataattgtactgtcatataatatttttccagtaagaaatttttgataatagaaattaaatgaaaaccaaatttggcatatatttaaaaactgttcacctagaagtatatataccctagacagtaggtattgtgaaatgcaataacaattccaagtcattttaatatattataaagatgtactaagtcaaaacacgagaaagtaattacagtctatttttattagagggtttccctttacagtgtcgtaccacttacttttaccaccattaaaagaatgatttcatgtcattgatataagtttccccaagcatcttctatttcaaattatacaataatttgtagtaaaatataattgtatatacgtttgtgttcatacaatgaagaaggtgatgactagaataggagattggatctctttaaaagttttgttcaaatgttatagtggttatgacagaaagataaatgtgaagaagaaaatggaagaagataaaagtaaaacatgtatcaggatataaaaaataaaacacaagaacaaaacaaaaacaacaacaaaaatatcttcgttcccacctggctccagacctccgataactgctttaggttatagaaatactttgattagctgcttagagttggaaagagaaaactcaataggcataatctttatgaagaccataaaaagaagacatggcaaaaaaaaaactatatgagtttaagagggatgtgtggagtatgagaatcagcagggagagtaaggagtgaagctccaagaaaggagctactcaacttagtgtcggtgagagttgctaccatagctgtggctaaagaatcaaataacgtttaagaacacaggtgtctaatattcaatttttaaaaatcaactctgagctatgatttacacacaataaaacatttgccactttaataagttttgacaagcttatatataacaatcaagatatagaatatttctaccaccccaaaaaagtttccttgtgtcactttctagccaatcaccctttccctgccatagacatgagtttgccaattaaaaaaaaaaaaatcttaccaggatttggattcaaattgctttgaatttagaatagaattttcattttaataatattatgctttccaatgtataacatggtatatctctcaattaatttactttcttaatttttttcagtgatcttctttagtttttattgttcagattttgtatatttttcattaagttctactctaaagagtcgacatttttgatgttgtcataagtcacattttaaatttcagttttcagtctttgcattgctagcaagttcaaatgcagtagctctcccttagtgcagtttcactttctgtggttgcagtcacttgcagtcaagtgtagtctgaaaatattacatgaaaattttcagaaataaacaacgcatccattctaaattatacactgttcggagtagggtgaaagagtttaaagaactctgcatgaaatctcataccatcctgctccattccagggtaggtgaatcatctctttgtccaatgcattcatgctatacaggctaatatgccactcacctgttggtcacttagtaaccatctctttgtccaatgcattcatgctacacaggctaatatgccactcacctgttggtcacttagtaaccatctcagttatcaaattgactatggcagcattgctctactttattattaactattgttgttaatctcttactgtggaaatttataaattaaactatatataggtatgtatctataggaaaaaacatagtatagtataggtacattccagtactgcccatggtttcaggcatccactggaggttttggaacgtatcttcctggattagaggagactactgtattccgatgttttatttgacctttcatcctgtgaacctgtggaatttactaattagttctagcagcttctttttagatctcttgagatttactacatacaaaatcgtatcatgtgcaaataaagacagtttaatcatcctgtgaatatttcgtactttttttttcttttgtgcctgggttagaccctcacataaaacgatggataacaatggtgagagtgggcattcctgccatattcccaatttatcatattgaggaagactacttctattcctaatttgctgagaatttttaatattaatcagagttgaattctgttaaatgcctttttcgcccctatgctcatcggtttttattttcttttactccattagtatgttaaattgcattgatttattttcaattgttaaacaacctcacatttcagggatccatgacttgatgtgaatatatttaacctttttatattaagctaaattcaacttgatattttgttaaagattttgtgtctgttcgtgagagatactaatttgtagttttcttatattgtaatctatctgtatggctttattattcaggaaatgctggcctcattaaaaggttaagtaatattttcttctttgtcatttataaaaaattagtagaatctctattttttgcttcttaaatgtttatgcttgatatgttcttatcagataacttttaatgaagaattcaatttatttggtaaatacagaactgaactactcagattttctaatttttttgagatagctcagtaacttatgtatcttgacgaatttagctattttatataagctgtcaaattctttggcaactagatattgacatatagctattcctaatattcattcttatctttttaattatatttttaatttttctgggtacatagtaggtgtatagatttatggggtacataacacagtttgatgcaaacacacaatgtgtaataatcacatcagagtaagtggagtatccatcacctcaagcatttatcctttctttttgttacaaacaatccaattagactcttagttattttaaaagtgtacaatacattattgttgactatgatcacctcgttgtgctatcaaaaactagatcttttctatctaactgtatttctgtacccattaaccatccccgcttcccctatgacccactacccttcccagcctctggtaaccatcattctactctctatttctatgaattcaattgttttaatgtttagctcccacaaataagtgacaacatgcagtctgtctttctttgcctggcttatttcacttaacataatgttctctagctccattcatgttgttgcaaatgacaagatctcattctttttcatggctgagtagtactccatcaggtacatgtaccacattttctttatccattcatctgttgatggacacataggttccttccaaatcttggctattgtgaacagtgctgccataaacatcacagtacagatatctctttgatataatgatttcctttcttttgggtatatatccagcagtgggactgctagatcatatagtagttctattttcagttttttaaggaacctccaaactgttctccatagtagctatactaatttatattcccaccaacagtgtacaagggttcccttttctctatatccttgctagcattcttgcttttttaatgtgtgcagaacatataagatgcccactttttaattcctgatattatatagtttttgttaattcaattttaaaatatttattgttatacagaaatacagacatgttttgttcgatatatcctttgtatctttttagtgtgtgtcttcttcttgtcttgaacgtaaataaagaattaacaattttactaactcttaaaaataattagtctttcattttatttttcagtatcactttttgttccattgggtttcaaactttttttttcttttctaatacaaatgttaaaaactgatgatatgcagaatggtacatgggaaaatcactgattttgaagttaagacagacccaggttccaagcttgatattactagtttatagctatgttactatttcttgctttcttcatcataaaatggagaaaatgttacctttctcataggatagttggggaaattaagagaaaaaaagaggtatacctagcttcttagttattttgattatggtattcaaataaaatgtgcctcatcaaaaactaaaatactcatatatcaattttcttaatttttatactaataaaaatataatgaaggagaaattataactaatatagcattcgcaatatgcaggtgtttcatcacctagaacataacattttctaaagccaaacataaaaaagttaagagtaatttcagtctatttcaagacttctctccttttgcctcttggtttccattaactagggaaaatcaatttacaattgttatagtcttttcttcgatctacattttacatcatcacatctatcagtgataaactgtaagtgccatacacttactatattcaaattttattaattctcaaattctgaaaatacaaatgattatatacgaactatttatataaaaactaaaattaagtctcagttttaagactgactgaatgaaaacttttacaaacattttataaggcttgttagatgtcataattctctaatgtgtttctctcctaaactactaataaagaccatcgtggaaaacgtcagccaacttactgtacaaagcgggctaggcctgtacccattacactaagatactgaactttgcaaagacagcaagcaatcttttctgatctccttgcaaattttctttctttttagtcttctctccttttgccgctaaaaatgtaaacatttcagatcattaaagaaataactgatattccacttaaatgatggcacctaatccatgaaaggaggccttacatgaaaagtttaaacaacaaaaaaaaatttacataattatcagcctttacagtaacttgtgactttgcatttatgtctctatttgcttttagtctgtaactcccactagttgtaaacccatgtaggcggggatcttttctgcttttgctcacgattacatctggaacaacggcacatctggagcaaagtgctcagtgcattatttccctatcatttctatttactttgcatgatgagatttttgccttttccagagatcccttatctttgaaaaataaaatattgccaattgtgtgagtgttctattgatgctgtaagaaattaccacaaatttgctggcttaaaataacacaaatttattatctcaaagttgtttaagtcagaatctggtgatctcagcttgtttctctgcctgtgtctcacaaggccaaaatgaaagtgtctgcaggtctttgttccttttctggattctagaagagaatgtgtttgaagtgacattcaaatttttgccaggattgagttccatgaagacataggagccctaattttcctggtagctgttggccagcagtcattctcagcttctagaggctgccctcattgctttgatcttgactcccctcctccctcctcgaggccatcaaggaaaggtcaagcttctctcgtgttttcaatctttcctctacttccctcttctgttgcatctctctcactgctcttctaccttcctcttctaattttcagtgtccatgtgattagattgggcccacctgaatagtccaggttaatcgccctattttaagcacagctggtgagcaactttttattacatctgtaaaaccctttgccacataacattaatatatttacaggttccagggatatgaacatggaggttgagggggaccattctttctacaaaaccaaaagcttatagcattcagtttttcagcattcctaatattccatcagttacgcaaattctaccaaacttttgcatactctctaagtaatcctgggagttcagtttatgtccctactctgaaaaagcaaagcagacttctgaaggtgtgttttcattatttcttactgacataggttcatttgaatttgtatttaataaaaccttgtgggtaaggtatgagagctttttggaaaaggtgcaatgagatggaaaactgtctttttgaactttttcccacactaaaaaaaatatattgtatagttcaaacatataggaattgttacaatctctgaaagcatgtaccctgcaatgaatttaatttaatttctacaaaacaacttgactggaaaacacagttcaggaggccatgctgaacaatgaatttcatttatagtgaaataaaattgctacgagtatgactataatctgtacttcatatatgacactgatgttacaattttttgtaacatcatttttctgcctagcactaaatgaaattttaaagttgtcaaagtcagaaatactttagaatacaaataatccctgtgaaatatagtttatatattaaagtcacattgaagtctcaagctgataagttttccttacaaattttttacaaatatagcagtgttatttttttctcattgtattcaattttgattaacaaagattaggcaaacttcaatacctctactattatcaggattattattacatatatagaactgttttgaagttaatgacacagtaatcatataaaaactattttatgatgatctcaatatacaggagcctattttttctgcaaatatacatatgatgcatctagaaccaagcataacaaataaaaaaaaaagtacgttgatgaaaccaccatagctattcaagctaatgaaaactgaggagaaacaacatttcccaaatgattatagcaaaaggaaaaaaaattacattggtagaagaatgctcaataccagcctaagctgcaagatgacaaataaataatatgaaagacaaagagatcttgaaaacaggtagagaaaagacaaatcacctgtaaagagatgacaattaaagtgtaaaaatggaagtgataatggaagtctgaaatcagtggaatgactctttaaagtgctaagaaaacttaaacattaaatagagtgataaagccagcaaaaccatattgcaagtataaggatgaaattaagattttttatgtttaaaaagctatagtatatactatatagttctagctatctcaaatttaaattgtccaaaaataagctcctgataatccctcaaaaatcagcacctcttaacgtttttctctatctcagataatggcaaatctcccctgctagggagacactaaaactttaattaatccttgacttctcccttttctcagtctaatcagaaccattggcatatactccgtgctttacctttcaaaaaatactgactgtaacacttctcaccaccctcactgccagcactctacttgaagccaccatcatctctcactgttatgacaatagcctatattaattgcttctactgttgatcacctcagtctataatctatagtaaccagagtgacttggccaaaacataaatcagatcttatcaatggtctactcaaaaccctctaaaagccttccatcccactgtgaagcaaggcctaccaagtcatacaatatctagatatacattacatgtctaggcacatctaatctccaaatctcctttctgttgtaactttactagcttccttgctatattatcttgaacttgccagaccttcttgcaatacctgttctctttgcagtgctttttcatcatatacctgcatatcccctcaattcttttggtcttcattcaaaagtcactttcctggctgggcacagtggctcacgtctgtaatcgcagcactttggtaggcccaggctggcagattgcatgaggtcaggagttcgagaccagcctggccaacatggtgagacccccatctctactaataatacaaaaattagccaggcttggtggggagtcacctgtaatcccagctgcttgggacgctgaggcaggagaatcactggaacctgggagacagaggttgcagtaagccaagatcatgccactgcactccagcctgggcgacaccatctcaaaaaaaaagtcactttcgcagtaagactttccttgcctaccttacctaaaatcgtcatttaatctgttccattttcacatttttctgctttattttttctgctaacaactatgtaacatactacatactatgtattttatattttattgtgttttttgcctatctctcagaattttagcaccatgaaagcagggatttatatatataaaattagagttttatatatacacacacacacacacacacacacacacacacagagaaatagcatacatataaattattaaagttacatatgcatatatctatgtgtatatttacatgcacttacatacatataaaacttcatgcccagtacacaatatgtacagctttgaatgaatgagtgaataagagtgcttattactaaaatcttttaccaaaggggtttctaaaagatatatttcaagaatgaaaatgaccctagaaaggtctgaatgcaaaaagaaacaataaatgaagaaaataataaatatacatgaatctaaacagcaatatattatataaaataatttataagatcaagtaaaagtaaagctaaagcactgttcagtcaaagaacatggatattgatgaaatacaaactctattatgtgtgcatgtagcaacaccaatagtatttactaaaaaagcaaaagtagagtttatatgtcccaaatcagtaaagcaaacaggtgaaataggggtggagatgtagaattgtggctaagacctgaatcatttcaataaaaagaaagagatatacactaataattcatatacttttccatatatattttaatgcaataattttttattttaaaaaatgcatggcttggaggttgttgattgtaactaataggtaaagccacaaagcttcatagcaatataaaatttgagctcttctctgttattgctttgtaatatatttatcattaaaagttacatataaaataacattccccaaatgctatactttaagggatggctatattgaatctaagttagtataatttttctttatgtgtaaaaaagacttttaaaatatattttcaatatctttgcatttcttagaatttcacattttattacatttcctctaaatgcaaatccctctcttagtgaagaataaactacccatataatctcaagttcagacaatgaaagcttctaacaaaacagaatgatgtcttaagttatagagaactgtaatgtattcaggtaaccaatgctgactctacaaagtatgctactaaaatcaatttttatcacttgaaatctattgcaattagagtgcaatgccaagtcactgacacactaatgggttttaaaatatttcaaaaagaataagaaaattgcaaagtgttttaattgaaatgaagctccaataagtataacaaattggataatatgagccttctctaaagctaccatatgaaactaccataccatagagtgttgagttttaataaatgtgcagcattgtctagctgcactttatataacaattatcctatatttaactattttaaaacctttattatagcttctactataaaagaagttctttctgtgttccaagtgtttgatttttaatttcactttagaacaatagtgcagtttttccaaagattggctctacaaaattagacgtggcttgcttgaaaagaatattatatctaactggaacatatttttgtttaattcaactacaacagtgcactacatggaaatgattaaacttaaattagaaaccaggttttgtaattccttgactaaattaatggttgcaaaaatgataatttctggccacaaagcttgtaataatacacagaaaaaaaatacagccactataataatgacaatcttcagtttttgtatctcaccctatttctttaaccatgactttttgtcatttagttaatgacatttcattccttgattctctgaatttctatgattatatttcctaggtttgaaaagggctcttccttgctccaaaacacatgtgtttctactttttttattaatttttctttctttctttattatactttaagttctatggtacatgtgcaccacgtgcaggtttgttacatatgtatacatgtgccatgttggtgtgctgcacccaataactcgtcatttacattaggtatatctcctaatgctatgcctcccacctcccctcatcctacgacaggccccagtgtgtgatgttacccttctggtgtccaagtgttctcattgttcaattcccacctataagtgagaacatgcagtgtttggttttttgtccttgtgatagtttgctgagaatgatggtttccagcttcatccatgtccctacaaaggacatgaactcatcttttttatggcagcatagtattccatggtgtatctgtgccacattttcttaatccagtctatcatacattgatggacatttggatgggttccaagtctttgctattgtgaatagtgccacaataaacatatgtgtgcatgtgtctttaaagcagcatgatttataatcctttgggtatatacccagtaatgggatggctgggtcaaatggtatttctagttctagatccctgaggaatcgccacactgtcttccacaatgggtgaactagtttacagtgccaccaacagtgtaaaagtgttcctatttctccacatcctttccagcacctgttgtttcctgactttttaatgaccaccattctaactggtgtgagatgatatctcattgtggttttgatttgcatttccctgatggccagtgatgatgagcattttttcatgtgtctgttggctgcataaatgtcttcctttgagtagtgtctgctcatatccttcgtccacttttagatggggttgtttgtttttttcttgtaaatttgtttgagttctttgtagattctggatattagccctttgtcagatgaatagattgcaaaaattttctcccattctgtaggttgcctgttcactctgatggtagtttctttcactgtgcagaagctctttagtttaattagatcccatttgtcaattttggcttttgttgccattgcttttgatgttttagacatgaagtccttgcccatgcctacgatctaaatggtattgcctaggttttcttctagggtttttatggttttaggtctaacattgaagtctttaatccatcttgaattaatttttttataaggtgtaaggaagggatccagtttcagctttctacatatggctagccagttttcccagcatcatttattaaatagggaatcctttccccatttcttgtttgtgtcaggtttgtcaaagatcagatggtagtagatgtgtggtattatttctgagggctctgttctgttccactggtctagctctctgttttggtactagtaccatgctgttttggttactgtagccttgtagtatagtttgaagtcaggtagcatgatgcctccagctttgttcttttggcttaggattgtcttggcaatgctggctttttcttagttccatataaactttaaagtagttttttccaattctgtgaagaaagtcattggtagcttgatggggatggcattaaatctgtaaattactttgggcagtatggtcattttcatgattcttcctatccatgagcctggaatgttcttccatttgtttatgtcctcttttatttcgttgagcactggtttgtagttctccttgaagaggtccttcacatcccttgtaagttggattcctaggtattttattctcttggaagcaattgtgaatgggagttcactcatgatttggctctctgttattggtgtataagaatgcttgtgatttttgcacattgattttgtatcctgagactttgctgaagttgcttatcagcttaaagagattttgagctgagacaatggggttttctacacatacaatcacgtcatctgcaaacagagacaatttgatttcctcttttcctaattgaataccctttattgatttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcataaatagctcttattattttgagacatgccccatcaatacctaatttcttgagagtttttagcatgaagggctgttgaattttgtcaaaggccttttctgcatctattgagataatcctgtggtttttgtctttggttctgtttatatgctggattacgtttattgatttgcctatgttgaaccagacttgcatcccagggatgaagcccacttgatcacagtggataaactttttgatgtgctgctggatttggttagccagtgtattattcatgatttttgcattgatgttcatcagggatattggtctaaaattctctttttttgttgtgtcttttccaggctttggtatcaggatgttgctggcctcacaaatgagttagggaggattccttctttttctattgactggaatagtttcagaaggaatggtaccagctcctccttgtacctttggtagaattcggctgcgaatccgtctggtcctggactttttttggttggtaggctattaattattgcctcaatttcagagcctgttattggtctattaaggaattcaacttcttcctggtttagtcttgggagggtgtatgtgtccaggaacttatccatttcttctagattttctagtttatttgcatagaggtgtttatagtattctctgatggtagtttgtatttctgtgggatcagtggtgatatcctctttatcgttttttattgcatctatttgattcttctctcttctttattactcttgctagtggtctatcaattttcttgatcttttcaaaaaactagctcctggattcatcgattttttgaagggatttttgtgtctctatctctttcagttcttctctgatcttagttatttcttgccttctgctagcttttgaatgtgtttgctcttgcttctctagttcttttaattgtgatgttagggtgtcaattttagatctttcctactttctcatgtgggcatatagtgctataaatttccctctacccactgccttaaatgtgtcccagagattctggtatgttgtgtctttgttctcgttggtttcaaagaacatcttgatttctgacttcatttcgttatgaaccccatagtcattcaggagcaggttgttcagattctatgcagttgagcggttttcagtgagtttcttaatcctgagttctagtttgattgcactgtggtctgagagacagtttgttataatttctgttcttttacatttgctgagaagtgctttacttccaactctgtggtcaattttggaataagtgtgatgtggtgctgagaagaatgtatattctgttgatttggggtggagcattctgcagatgtctattaggtccacttgttgcagagctgagttcaattcctggatatccttgttaactttctgtctcgttgatctgtctaatgttgacagtggggtgttaaagtcttccattattattgtgtgggagtctaagtctctttgtaggtctctaaggacttgctttatgaacctgggtgctcctgtattgggtgcatatatatttaagacagttagctcttcttgttgaattgatccctttaccattatgtaatggccttctttgtgtcttttgatctttgttgttttaaagtctgttttatcagaaactaggattgcaacccctgcctttttttgttttccattttcttcatagatcttcctccatccctttattttgagcctctgtgtgtctctgcatgtgagatgggtgtcctgaatacagcacactgatgggtcttgactctttatccagtttgtcagtctgtgtcttttaattggagcatttagcccatttacatttaaggttaatattgttatgtgtgaatttgatcctgtcattctgatgttagctggttattttgctcgttattgatgcagtttcttcctagcatcgatggtctttacagtttggcatgtttttgcagtggctggtacaagttgttcctttccatgtttagtgcttccttcaggagctcttgtaggacaggcctggtggtgacaaaatctctcagcatttgcttgtctgtaaaggattttatttctccttcacttatgaaactttgtttggctggatatgaaattttgggttgaaaattcttttcttaaaggatgttgaatattggcccccactctcttctggcttgtagagtttctgccgagagatccgctgttagtctgatgggcttccctttgtgggtaacccgacctttctctctggctgcccttaacattttttcctccatttcaactttggtgaaactgacaattatgtgtcttggagttgctcttctcaaggagtatctttgtggcattctctgtatttcctgaatttgaatgttggcctgccttgctaggttggcgaagttttcctggataatattctgcagagtgttttccagcttggttccattctccccgtcactttcaggtacaccagtcagacatagatttggtcttttcacatagtcccatatttcttggaggctttgttcatttctttttacccttttttctctaaacttctcttctcgcttcatttcattcatttatcttccatcactgatacccttccttccaattgatcaaatcggctgctgaagcttgtgaatttgtcacgtagttctcgtgccatggttttcagttccatcaggtcatttaaggacttctctacactgattattctagttagccattcatctaaccttttttcaaggtttttagcttctttgcgatggatttgaacttcctcctttagctcggagtactttgatcgtctgaagccttcttctctcaactcgtcaaagtcattctctgtccagcttcgttccattactggcaaggagctgcgttcctttggaggaggagaggtgctctgatttttagaattttcagtttctctgctctgtttttttccccagctttgtggttttatctactttggtctttgatgatggtgacgtacaaatggggttttggtgtggacatcctttctgtttgttagttttccttctaacggtcagggcccttggctgcaggcctgttagagtttgctggagatccactccagaccctttttatctgggtatcagcagtggaggctgcagaatagcgaatattgctgaacagcaaatgttgctgcctgatcgttcctctggaagcttcgtctcagagtggtacccggccgtgtgaggtgtcagtctgcccctaatggggggtgcctcccagttaggctactcaggggtcagggacccacttgaggaggcagtctgtccattctccgatctcaaactccatgctgggagaaccactactctcttcaaagctgtcagacagggacattcaagtctgcagtggtttctgccgccttttgtttggctatgccctacccccagagttggagtctacagaggcaggcaggcctccttgagctgtggtggactccacccagtttgagcttcctggccactttgtttacctactcaagcctcagcaatggcaggcacccctcccccagcctcgctgccaccttgcagttggatctcagactgctgtgctagcaatgagcaaggctccgtgggcatgggaccctcctagccaggtgcaggagagaatctcctggtgtgccgtttgctaagaccattgtaaaattgcagtattagggtcggactgacccaattttccaggtgccgtctgtcacagcttctcttggctaggaaagggaattctctgaccccttgtgcttcccgggtgaggcaatgcctcgccctgcctcagctcatgctcagtgggctgcacccactgtcctgcacccaccgtccagcaagccccagtgagatgaatccagtacctcagttggaaatgcagtaatcacccgtcttctgcgttgctcacgctgggagctgtagactggagctgttcctattcagccatcttggaacctccccatttctacacttttttatcatccacccagcttaagaaaatctatctccttcccttcctacttcccctttcatcctttctacatcccttcatcaaccctaatactactatcacatcattctcaaaaacaaaaacctttctgtttgaagtggtatttgaagaacttgcacaacgatttcttttgccagtaatatagaagctatggtgagtatgcaaaccaggcacaaatctagggcagtattttggccaatgacatggctgggtgctgttcagaaataaaattatagcagaaagtagctcatattaaaaccctttaaaaaatgtctctttttttctttcttcttccccataatatacactggggaacactggggaaggcagtatggggattgtctcacattcctttttttttactttcttcacagcatagcaggccatgacccattctcagttttgcactagtcccttattcacttgcttcacctttcctatcctatccctttattctctgcaatgccatcaattagaactgaacagatgtttcaaactttaataaaggattggcataacaggaattacaatgtaacgttaactttacatcaaataagactaagctttagttcagtgtttctcaaactagcatgcattagaatcaccaggaggacttgttacaacagaggttggttggactccacctctagagtgtctgaatctttaggtcaggtaagcgtctaagaatttgaatctctaataaagctccaggtgattttgatgctgttactccaggaaccacactttgagaaacactgttttagtctaattttgtgccctatcctcaggcccacatctctccataagagcacattcttcttcaaaaccactatcctttaggagacattttgaatgatgtggtttcacctcagattcatctctgcatatctaaattactttcaaaacatattctagagaacatttgacaactgtatatggcattctcccatgagtctcaaagcacacactaaggatgtcagaagtactccattctggtctccttcagtgttttctctacactgacaaggagttataaacattcctcattttccttctagttttctatcaagtaaatatacatatatatatgaagttaaatatatatatttttggcagagtttcactctggttgcctgggttggagtgcaatggtgggatctgggctcactccaacctccatctcccaggttcaagtgattctcctgcctaagcctcccaaatagcagggattactggcacccaccaccacacccggctagtttttgtatttttagtagagatggggtttcaccatgttggccaggctggtctcaaactcctgacctcagtttatccacgcacctcagcctcccaaattgctgggattacaagtgtgagccaccgcgcccggccctatcaagtaaatattaaaccacgtatacatattgacacacacatgcacacgaccacatacacactttcatcaccaacataaattctaggtgacagtaatatatttgaagtaaaaaaagatcaactcaagtattatgaacttcctttataatttgcaaagccacctctattacaatgaacttagttatatataacagtgtcacttcctttcaactaacaatctgactcacctgccctcaccaccccataaaatataatgctcttgtttttgtttttggattgtgccaggaataagaaataagactattattggaaaatataccttcagtttggcttccaggcctactcaatactaagacccaatatttgaaatccattattatttaaagctctattaatgtaaccatggccaccatcctccaaaatatatatggagggggaagaggggttctttcagtcacttgataagaagtttgtttcaaattctctttaaaatatgttcaccaaagatattccactgatacaagttactccatgtatttcaaaatgagaaatagatgttaaatatttttagaaacaatgtgattgtatctgtaaggaaaaatactaggttcttgaccaaaaaatttaaaaatcccaataaaacattaactttttaccacatgattcaggtcagtgagggtggaggtggaggtgggggaggatctattccaagcaggtatttaggacccaggctgtcaatggctttgccatcttctacaggagacttcccaagttctcctggggtgagacagagtctaaccctgtcacccaggttgaagtgttaatagcgtaatctcagctcactgcaacatctgcctcttgggttcaagcgattctcctgcctcagcctcccgagtagctgggactacaagtgcgtgccaccatgcctggctaatttttgtatttttagtagagacagggtttcaccatgttgaccaggctggtctcgaactcctgacctcaaatgatctgcccgcctaggcctcccaaagtgctgcaattacaggcgtgagccaccacgcctggccagaacactgacttcttgggaatactgacttcttaatcaattcatctccgatgtcacgttatttcaattctgtgggcaagagcaaatcacagtaccccacctaaacaagacatttaaaaaggcagtcactggttgggaggctgctttccagagacaactatgcgccacagaaggagaggttcctatctgtagcagttatctctgacacaataacaatactgatgctgctaaacatgaaaatccaaacgtttttatttctgcctttattttccagtctttgtcatatgcataaaacatagtttccaattaattctcatcataatataatgttataccttcttttaatctaacgtaatctacatgcttttaataattttattaagttaggtgtttctgctagagtaacatacacaatcgtgagctgcaaaacaatgtcttggtcaatgatgaaccacacatccaacagtggccccataaaatgataatggagctgaaaaattcctgttgcctagtgacatactgattatcctgaccctgtgtaggccctggctaacgtgtgtgtttgtgtcttagtttttaacaacaacaacaacaaaaagttgaaacttttttttctattttaaagtttaaaaatagaaaaaaagcttacagaataaggatataaagaaaatatttttgtacacagtacaatgtgtttgtgctttaaactaagcattattacaaaataatcaaaaaagtttttaaaaatttgaaaatttatggagtagaaaagttagagtaggctaaggttaatttattattgaagaaaataattttaataaatatagtgtagcctaagggtacagcattcactcaacatgcactcactcactcatccaaagctacttccagtctcaaaagctccattcacagtaagtgccctatacaggtgtaccattttttcatcttttatactgtatttttacagtatcttttctgtgtttagatacactatgggggtaatacttgccattgtgtcacagttgcctatagtattcagtgcagtgatacgctatgcaggtttgtaatgtaggagctataggctataccatatggcttagctgtgtagtaagctatataccatctaggtttgtgtaattacgctctatgatgttcatacaaggacaatattacctaacaacatatttctcagagcatatttccatcaccaaccaacacatgactatatgtgttcctgaaaatctctgtattttaaaaattcttccagtaaatataacagtgtttgtgggaaatattgggttgaaacagaactcctcaaaaccaaaagaacttcataacctgtacactaacaaatactcttctaatttatttatttacctttttttgagatggagtctcactatgttgctcaggctggagtgcagtggcgcgatctcccctcactgcaacctccctgccttccaggttgaagcaattctcatgcctcagcctctgagtagctgggattacaggcgcgcaccaccacaccctgctaatttttctatttcttttagtggagatggggtttcaccatgttggccaggctggtctcaaacttctgactccaagtgatctgcccacctcagcctcctaaagtgctgggattacaggcgtgagccaccgcacccagcctgttctaatctatttaaaagatgcctcatatgtttgttggccaattgtatgtcttctttagagaagtgtctgttcatgtcctttccccacttaagaatggggttattcctttcttgctggttgatttgttaagttccttatagattctggatattaggtctttgttgaatgaatagtttgtgaaacttttctcccattctgtaggctgtttactctgttaattttttttttcactttacagcagcttactaatcatcagagaaatgcaaatcaaaaccataatgagataccatcacacaccagttagaattcctattattaaaaagtaaaaaaaaaaaaaaatagatgctggcaaagctgcagagaaaagggaacactcatacattgttagtaggaatgtaaattgtttcagccactgtggaaagcagtttggagatttctcaaagaactaaaattagcactaccgtttgacacaggaataccattactgggtatgtaaccaaaggaaaataaattgttctaccgaaaagatacatgcactggtatgttcaacgcagtgctattcacaataacaaaaacatgaaattaacctagatgcccaacagtggattagataaaacagtggattagataaagaaaatgtggtacataaacacaatggaatactatgcagccataaaaaagaatgaaactgtgtccttggtagcaacttgaatgcagctggaggctgttatccaaagttaattaattcagaagcagaaaaccaaataccacatgttcttgcctataaatggaagctaaacactgggtatacatggacatcgagatgggaacagtagacactggggactagaaggagggaaggaaaggcacaaggattgaaaaacaatcgcttgggtaccatgctcactacctgggtgacaggatcattcataccccaaacctcagcatcacacaatatacccataaaacaaatctacacatgtaccccctgaatctaaaatgaaagttgaaaataaataataaataaaaaagctctcttaaaaagtcagtctccacagacatcacaatcatgccatcctctgctgggaaattatgcctcctttcacaggaactaggtcgtgagtgcattcacccctaatataaactaggttcatcaatgataaaaatatcatttgaggtagattttatcaatcaatgggtagttgtggaggagaggcattgttttgctttgttttgttttgtttaatacaaaaagaaatatctttgcacttctttatgctcttcttaagaccttcataaattgctaagcctttatctttaatcataagaaaccttgtttatcacaaagattgctgcctcaaaacataagtgcatatgaaccaagacaacttctgagccttactgacttctttctccttttctcaaataacaggtgagctaattcacattaaagaagcaagcatggcagtagaataaactgttcaatttttatcatcaaataatattccagttgcttgattttctgtgttatgttacatattccattattattagttaatttgtttccaatgtttttctataatataaatgatattgtactttattttcttccattgatgtaatattggaataatattaagtcaatattaattatattatattaataatataattcagattttcaccaattttgctttcattctcaaaatgccttaattcctttaatatgtttatttactcatttaaaaagtatataaatttgtttatgcatttttaatctttccttctgcctattttctgtttttgcctttaagctcctgaagaagaaagaatatgcttattttacttcctttacataccacaactctatctaaaaacaatccttaaatccctgtggttatactaagcattatgaatagacaacagattcccagttgaacagactgccccaaaatgttgatcattttgtgatatactgcctatcgtggaaataaaaataaaataattaaaatgaaaaacttaatgcattattcaaacagcagattatacacagaagagagaattgctgaactggaagagtagttcaataaaataccaaaatgaaacatgggggaacaaaaggatagaaaatgaaaaagttgtaagaggaaaaaaaaggaagtatttatttggaattgaaaagtgggcaggagtatgaggcaaaagaagagatatactgactaagaactttctaaaactggaaaaataaagaatacatcaagacacagactcaagaagcagtatgtaaatcaagcaggataaggatacaaaaaacaaaaatagctaggtacatcatagtaaaattttcaaaaaccaaagacaatgagaaaattttggaagcatcatgaaagcaaatatatactatcatcaaacaagcaatatttaaatagacagtatttagatgtttttgaattctccacagaaacaatggaagccaaatataattgaatattttaaagtgctgaataatggctgccaacatataattctaaatccaaaaatgcatttttaaatattttagacacaataaaaagaaaaagataattcttcaccagcagaaccatactaaaagactaaagagtatacctcagacagagggtaaatgaacacaggtagtatcttagatgaaaagaaaacagagcaatgaaataacaaatgtataaatgggcaaatctatatgacaattgactgcctatacaaaccaatactaatgttcttggttctaaggtataaataaatcaaaatatatgaaaataatagcagaaattgaggaaaacgataaacaaaattaaaatgttatagtgttctggcattattgaggaataagataaaagtcatcaactaatacctgactttgataagtgaaagaggtaatcgctaactatccactacgataaaaataaaacagtataatttccaagctaatataaaaatattttaaaataatttttcaaaatcctaaaaatactcaaatcataaaggcaataaaaacgcagaaatagaagataggcaggtgagaggaaataggaaacacttcatcagtggaagatttaaacccaactataacacttaaattattaaatttactaaaaagttctaattaaaagataaaaatttttaaattagatataaaaagacaaaaaccaaaaaaaaaacccacagaaacaacaaaagcacaaggatacagaaaggttgaaagtaaaaggaagaaaaaaatgtcaaaaaagacactaaaccaaagaaagtttatatagcttcattgataccagaatacatatgtaaacacacatgcatacacagactctcaagcaaaaaagctaaaactaaaaagtgatacttcaaacttcctttgccaggaagttaaaataattaataacagtctcaaaatatataaagaaaaatggactgaattactaggaaataggcaagtgggcaaaaaaagcagttttcaaaatacttctctcagtaacagaaaagacaagacaatgaatgtttttaaaatgcagattagacaacatgattggaaaataagaaacatctacaactgataatttaaatttaaaacttgttgagtgacatatggaagaaggaaataaacacaaaaattaaataatgaaaatgctctaactagcactaagatagaaatatctcaagtcctataaacacagaaactagaaattgaaaacacattgtaaaaaggaaggactataggaatggataatggtgacagagagagcagcacgttttaactaaaactgagtaaactagttgtgacaggcagaattctaaagaaacccccccaagattcccatcactgattttttaaatcaccacttatctacctactactttgaaatgatttttgtagacataattaaactatcagtccatttgactttaaaatatgtagatcagctgaatgagctggacccaattaggtgaaccctttaaaagcagagaattttcctttgacaaggaagtcagaatttgaagcatgagaacgatttgatgtgccttggctagcttgaggatggaggtagccatatctcaaggaatgtaaacagcatttatgagctcagagagacccactggctgacaatcagaaagaaaacatggacttctgtcctaaagaacttaattcggccaacaatctagttgaacttggaagctgacttttccctagaacctacagataagaacccagtttgatcaacatcttgatttcaacattttgagagacaaagaagggaactttaaagagctgcccagacctctgatctatagaactgtgagctgataaacgggtgttggtttaagccactgtatttgtggcaatttgttacacagcaataaaaaaaaatgcactagtatttaaaaaaataaaaaaactaatacaattgtaatgtatgatgctatattttgacccacagatgtcatgaataataatatatcttaagatgactatttgtacatatagcataattaaagatcaaacaaaactaattttcaaaactcaaaaacagaaataacacataaattaaatatcatagttggtgaattaacaaaaaatgttctttttgctgcccatatttacatatggactaaatcctaatacctaaagaatgaaagcaagccgggcagggtggctcaggcctataatcccaacactctgggaggccaaggcaggtggatcacgaggtcaagagatcgagaccatcctggccaacatggtgaaaccccgtctctactaaaaatacaaaaattatctgagagtggtggtgtgtgcctgtagtcccagctactcaggaggctgaggcaggagaatcgcttgaacccggggggcagaggttgcagtgagccgagattgcaccactgcacttcagcctggcaacagagtgagactctgtctcaaaaaaaaaaaaaaaagaaagcaatgctcacattttaaaaattgggaaaaaattatctgaatatgtacttatcactcctctaatatttcctaaagccttcccatgagtcaggctctgggacacaaagatgaacagacatagagatcctgccttccaggaactcacagtgcctggcacagcacaggttactcaataagcctatgttaaattaatgaattctaaataaagtgtaataggaaagcaaacatgcatctcataatgacaatatactgggataaaggccataatttgaatattatgctatttccacatttatataaaatgttacagaaagctattctttacaaaaattatcacaggataagcaagcaattttattgctttaagaaaccaggtacttaaaaccattataaagcattacaaatcaccaacaaattttacaaacattagtaaatggtggcataaaacacatttttcctaagaatttttcatcaggaattatgatggtaaggatcagattatatattcttttgttcacttcttaaaagtacaggcctttagttccttttttgttttggttcatctgttaagcagtgggggcccaatcagtgctcctttgtaaaaagacattttcccaaagaatacgaattactgttcaaacaggttgttgatgggtaataagggatgtttttgctgccccaaaaaggcttaacaatttaggcggttagtttacttaaaaaaaaaaaaatccgttggagacaaatactgaaaatgcaaactagtttctaaattatcagttccctacaagaaaaagcagtctgccagtgtttagtctcagaaaatgactggttggctctgtatctatatcagaacccaatatctacacatgtgttgaataaagtaacagcctttgatgaatttccttcataacatggttttagtgaagcaaacatttttattttttaagggcattgttctttctagttcatttctttttatgaaataaaattattttatttaaacatagttccattgtcatttctaaaaaatacagtattctcataagttgtagcagcagtaaaaaaaaaaatgttatataagtggttggggcagatttaactgattttgttaaaccaatttgtaggttactgcttctaatattacacttctaaaaagctgaatttatactcatgtcctaaaggagaatatgtggtaataaagtatatctgttaagtaactaattgaaataggcttggttttaagagttccagtatataatagtcacaaattgaaacctaattgacagtatctcttggagttccagtaaagtcacaaattagtgaataagcatgccagtgtgcaagggtaatggaaggattgttagcctatctaaatattcaaaattactttaaaacttcagtatgttttctgatttttaagaattcagaagtgttctgtaatggattcagatgtttcatttgtagtataatgaaatgtttacagaaagataactttttcattaatatatttttagaaaaaaagtacaggcctttttagcgactgacaaatataagttagtaaattagaaaatttatcaaagactgaagaaatacaataccaacaaatgtcacagtgctaaatagttaaatgcagtgtgaaaagataaaaataaatactaatttatttctaaccataacatagtgataattaagaatgcagatttgaatcaaattatcttttctgtacttttttactttcttacatattaccagatcttacttacaatggcctaagattcaaaaaattacagatgatctgttagattatgagtcataattttcaagtcttttatctctacttgaatattttatactagtgttcagacagattaggactattctctaagcatttccttcaaactcacagaaatgtttctgaaaagtaagtcacatttataacctgttccacatttacttctaaaattggatatcataaagtaattttaattcagtatatctaagaggcttttcatacttattttgtataatgaattgaaataatttgaacatgttgagttatatgttttccagatcactaaaatgttaattgatttgattttgaaagtaaaaaagagttttaaaagaaaaactatagaacaaaatatacgtctagtctatattagttcctcctccctatctgaacatctgaaaattgtaatgccccagtagcttagttctaggccccgttttcctcctaatcaatattctccccacagaagatcacctacaatctcatggatagaatggcatctgtatttaatgattccctactttttattttcaggccagacattctccctgagctttgtatttatatgttcaaataactacttacaattcaaatagaatttcacatgtaacaggtccaaaacagaatatctttctctttttacatctcatcttaaaacatcctccccaccagttgtcgctatcttaaatggcaataccagttgctgaagtcaaaaatcttggagtcatctttccctcatttccatacacatacaatctgctatcaagttctgttacctctactttcaaaaatatcccaatcttaactctttcaccactactgcttttttgcaaactatcatcctatcttttctgcactagtctctcatctgtctccctgcttccacttaagcctcctatctcttattataagaatctttccttgaataacgctaggtataactgtgcagggtcaaagtaaaaacagtaaaaaaaataaaataaaataaatggaaggctacctatcaggtactatgctcactaccttagtgataggatcattcgtgcaacaagcttcaacaatatgcaattaacctgtgtaacaaagctgcacatgtactcccaaatctgatacttttttaaaaaaagaaagtaacatttattgagcacttactatgctatgggtactatgctaggagatttaaatccatttttattgttaccataaaaaataagtatgtgaggtcatatagatgttaattagcttgactcaactattccatgaagtatacagatttcaaatttgtttaggtcagatgcagtggtgcatgcctatattcccagctactcaggagtctgaaacaggagaattgcttgagcccaggagttcaagtccagcttgggcagcatagcaagaccctgtctcttaaaaaaaaaaaaaaaaaaaaaaaaaaaaaaaaaagcatgttttataaataaaaaatgtacacaattttatttcatttaaatttttaaaatatatttaatatatttttaacttaagcattacaacaactttatgaaaaaatactaatgatttccttttatgggttgagaaactacagctctgaaaattgagaatcctgctaataagcaaaattcagctaaggttaggtcattcaagtaatcagaaagtcacaattagaatgcattctgttagaatccagagtccatctttattccagcatatcaagttgctttcagtagaatgtactctaaaaagaattgcatatactcacaccattaaattattacaatgataatacacctaatgagatcatgaaaaatcaaaaacagtaatgggatctgatagttcctccaaacagacataacattattgatatatttataacaaatgtattttgtttgtattgttgagatatattttattaatttcactttagtgacttacattattatgaaagatgaaatgaccaaaacaataccttccttaaatgtcaaaatgtcaaataactggttattctggtagccattatgcttaggctattaatttaggactttctaagatacattttgttttgttttgttttttgttttgagacagagtctcactctgtcacccaggctggagtgcagtggtgcaatctcggctcactacaacctctgcttcccaggttcaagtgattctcctgcctcagccatccaagtagctgagattaaaggtacatgccaccacacctgggtaatttttttatttttattatgggctgtggacaatagttggctaaatggtcagtgtgatggttaatactgagtgtcaacttgattggattgaaggatgcaaagtattgatcctgggtgtgtctgtgagggtgttgccaaaggagattaacatttgagtcagtgggctgggaaaggcagacccagccttaatctgggtgggcagtacctaatcagctgccagcatggacaggatataaaacaggcagaaaaacgtgaaaagactacactggcttagcctcccagcctacatctttctcctgtgctggatgcctcctgcccttgaacattggagtccaagttcttcagctttgggattcggactgacttccgtgctcttcagcttgcagagagcctattgtgggaccctgtgatcgtgtgagttaatactacttaataaacccaccccattagttctgtccctctagagaaccctgactaatacagtatttcttagtattactgtgccttgttattaaggtcaatgcaaaagcacaaccacccaattcaagcaggactaccaacgtcctgcacttttcagaaacgaaggtatgggtcatatcaccaggtaaagaaccatgactagctgaagtcagctttgctaaaggcaaagagaaaacataatggtagcgaaagaaagtaattacaaataccagctttgactatgtgaccagttacagaaacatttaccggtgtgtgtgtgtatgtgtgtgcatgcgtgtgcacacgtttgtatatacagcttgactatcccttatccaaaaggcttgggactgaaaatgttttggatttcagaatttttcagatttgggaatatttgcattattatacttagtggtttagcatccctaattagaaaattcaaaatctgaaattctctaatgagcatttcctttgagcgtcattcagtgctcaaaaagtttcagctttccgaatatttttcattttggattttggatttttagattaaggatactcaacctgtatatataaaatcttttgttttctttcctcactctcttgtcatgtaacataagatgtaatgactttatattatggtatttaagtattgttaattttacataataccatttaagtaacaagatgttgggaagaagggtaaatatcactcagggactttaccttctcttctgggaaaaggttagtgcatttttggttgtacacaggatagctgcactatgttaggcagaagtatgatcttgttatctttatttggagattaagtatggtttaagtagattcatatgaatgccaagctgacaagaggtagacttgtgatagctaatttcatgtgtcaacttgactggttcacaggattcccaaatacctgtttttttattattattctactttaagttctgggatacatgtgcagaatgtgcaggtttgttacataagtatacatgtgccatggtggtttgttgcacccatcaacccatcaactacattaggtatttctcctaatgctatccctcccctagcctcccatcccccaacaggcctcagtgtgtggtgctcccctccctgtgtccatgtgttctcattgttcaactcccaattatgagtgacaacatgcagtgtttggttttcagttcatgtgttagtttgctgagaatgatggcttccagcttcatccatgtccctgcaaaggacatgaacttatccttttttatggctgcatagtactccatggtatatatgtgccacattttctttatccaatctatcattgatagtcatttgcgttggttccaagtctttgctattgtgaacagtgctgcaataaacatacatgtgcatgtgtctttatagtagaatgatttataatcctttgggtatatacccaataatgggattgctgggtcaaatggtatttctggatctatatccttaaggaatcaccacactgtcttccacaatggttgagcaaatttacactcccaccaacagtgtaaaagcattcctatttcagagacctgtttaaagatcatttctggatatgtctgtgagagtgtttctgaagagattagtatttgaattggtagactgagtaaagcagattgccctcctcaccacggatgagcatcatgcatcctttcagggcctaaatagaacaaaaaggcagagaaagggagaatcaatctatcttcctttccttccttccttccttcctccctccctctctttctctacctttctttctttctttttcttttcttttctttttctttcactctctttctgtctctctctctttctgaccctcttccttccttccttcccttcctgccttcctccttcctttctttctctttctctttcactctttctttttcttttttatttctctcatatatgcacatacataaatataaatatacatttatacacatgtgtgtagaaaatatatattatatattttatatattatatattattttatatatacatatatttcctattggttctgtttttctggagaattctgacaaatacagggtgtacttaacaaagaatagaagttaaaagaacaggcccacatgccaaactgcctatatttgaatcccagctacattccaccttggaaatgtgtgactttagcaagttatgtaacttccctatgattcagttatcttttctgtaaagcatggtgattatacagttgttatgaagattcaattagtgtgtatatatatgatatatacatataataaatataaatttattttaaagatcctactggcactatgaactatctgataaattattgtttttactaataatgattactcttcacaatctattactataaactacattagtaataaaaatggtattgaattattttaaatgtcacgataaaattgtaagaattagcaaaaacatttcttaactttagaatacttgcttagacatggtgccatttccccttgaactgttctctataaatccaaattttccttataaatagaataaattatttcattatagtctatcacagtttttactgttgcattttacactggctgcttccccattatctagaggattattagactttagacatcgtgaaatgtgcttaaagtttctgaagttcagcttctcactctctgcagaaaatctatcccagagcattcctgaaaattaaattagatagcttatacttggataattttagtgataagaagccttttaactctagaggcaactcttccattaaaaggcaagcctatttaaaattttctatattttcttaaaattttcttttcctaatttccccacatttttcttaggacttaacttgactagcttcattcagatttgaaggtcagtagaagagctgtcttttatatgcatcagatctactcagaattatatatatatatatactctgtcctcagagtcatccttccttttccgtaaaaagtagcccatgtttacagctaaagagtttttttggccatttccttcctgtagaaatctgagagtccaaaggcctcttttcattttatatactgtttgtacctcttaggccaagctgaccctattatttttaaaactatgtgagcttttattgatttataaatcactccattatgcaaagccacaccacaagatgtttgagaaaagctctcttctatatattatctatatagagagatataaaacctatttatagtagtctgttcttatccacggggacacgttccaagaactccagtgtatgcctgaaatcaaggatagtatcgaaccctataaatactatgttttttcctatatatacatatccataataaagtttaatttctaaattaggcatagtaagaatgacaatagtaactaatcataaagtagaacaattacaacaacatattgttataaaagttgtgtgaatatggtctctctctctctctcaaaatattttattttactgtactcgcctattttcagactgcacttgattcaggtaactgaggccatagaaagtgaaaccattaaaaaaaagaagactgctgtattttcaatttttcttggcacttaacttcccatctcaataaataaaccaagtccactttctgctttgaggcttaccactctattttagactttaattctattatcctaatttatgttctaaaataccacttcatcagttttctcctccccactccaccctgcatattcaatctctcctcaaatgaagcttttcccagtcttcagttctttagaagtactcaaaaagtgaattactttattctaaatcagaaaactaataatctgtgtactatacatggaataattttatctataatatatgcttcttaccaaatataatcattctcaaattatgtgtagagaatttactctctctgtatatatatttatgtatctcttatataaatatacatatttatatataatataaataaatatatattatatataaaaagtgtccaaagaaacaaaaataatttgaggttgaaaattaataaagttagttcatgtttaataataaaatttctatcatttcgaataaagatatagaatccacaaatccccaaaactgatctgaccagcttttgcccacactcagaattatcctgcattttatcacctcagaagcatttctggcagctatagaaaaatgaccaaaaaagttatacatttttgcagtaggttaacagcactcagcaagagtgatgaactgcattttgaaacactttctagtacttctgaagctagaatattataagtcactgagaaaacagaataaataattaatttttacacaacagtgatttttacatcaaaggtattatttatgtttattgaaaaagtgagcaaaactaccttcatgagatatgttcaattaacttctaagataaattatacctgtttcctaaaataatttcctgtgggaatgtgatacggaaatcacaatgttattttcatgagtaatgatctactcattactgagtaaagtaagtctcagtacctgataggttaagcctacaaatgttgtcttatatgctatgcattgctgagtctatcattcatttaaatatttggtttctaataaaaattatgctgtcaacatcaactgtttttcttcatttatttaaaatctaaaaataatttaatattttaacatttaaatattttgctgtaaaatttaaaccatttaaactatttaaattaaattatttaattttattgttaaaacatttaaatttttaatatatttttgacttactataaagcagtatttgttcacatagagaacacaatgaaaaaattgaaaaaccaaaacataactttttagtaagcctaaggctgttactcaaatacaggcatacctcattttattgtgtcttgctttattgtgctttacagatactgttgggattggttttttgttttttgtttttttttaaattgaaggtttgtggcaaccctgcattagcaagtctatcagctctcagtgccatttttctaacagtatgtgctcccttcatgtctcaacgtcacattttggtaattttctcaatatttcagacttttccattattattattatatctgttatgatgaactgtgatcagcaatctttgatgttactattgtaattctttgagggcaacacaaaccatgcacatataaaatggcaaacttaatctataaatgtggtgtgtgttcctatggctccactgaccagacactctcccatctctctccctcccctccagcctctctattccataagacataacagtgctgaaattagtctaattaataacccaacaatgacctgtaagtgttcaagtgaaaggaagagtcaggggtctctcactttaaattaaaagctataagtgattaagttcagtgaggaaagcatgttgaaagcaaaaacgacagtagctagacctcttgcaccaaacagttacccaagtgtaaatgcaatagaaaagttcttgaagaaaattaaaaatgctaccacagtaaatacacaaatcaaaagaaagttgttaagccattcttccattgctataaaaatatacctgagactgtgtaatttataaagaaaagaagcttaattgcttaacagttctgcaagctgcagaagcatggcactgacatctgcttcaatgtggggaggtctcaggtagttttactcatggcagaaggtaagcaagagcaggcatatcacatggtgggagcagcacaaggtggcacagagaggttaccacacactttaaaaaaccagatctcatgagaactcattctctattgtaaggaaagccccaagccagaatggatcctccttcatgactcaaacacttcccaccaggccccacctccaaaataagatttggagggtacatccaaactatggcatttcgccctctgccccccaaatctcatgttcttctcacattgcaaattacaatcatgctttccaataggttcccaaactcttaactcattttagcatcactcaaaagtcccaagccccaagtccaaagtctcatctggagatgcattccttccacctatgggcctataaaatcaaaaacaggtagttactttaaaggtacaatggaggttcaggaattgagaaaacatgcctgttccaaaagagagaaactggccagaagaaaagggctccagcctctacacaagtctgaagcccagcaggacagtcataaaatcttaaggctccaaaataatcccttattaccccatatcctaaatccagggcaaactgcagtaaggagtgggctttctagaccttgggcaactctgcccctgtgtctctgcaggatacagcccctgcaactactctcacaggttggagttcagtgcctgcagcttttccaggtgcagggtacaagctgcaagtggatctatcattctggcatctggaggacaatggcccccttcccacatttccagtaggcagtgccccagcggggaatctgtgtggggcctccaaccccacatttcccctccacattgcactagtagagtttctctgtgagggctccacccttatagcaggcttctgcctgggcacccaggttttctcatatatcctctgaaatctaagcacaggccgccaagcctccctcactcttgcactctgtgtgcctacagacttaacatcacgtggaagcttccagacttaacagcttgaaccatctggaactacagcctgagctatacctgaggccctatgagctgaggcttggtctgagtggcctgaatgccagagtagtgtcccaaggctgcacaaggcagccaagccccaggcctggtcccccaagtcattctaagaagagctgccaaaaagatctctgaaatgccttggaggcctttttcccatgtcttggctattagcacttgactctttttagccatgctaatatctccagcaagtggttgctccatagcccctctgaattcatctcctaataatgctttttctttctctgctacatggccaggctgcaaattttccaaacttttatgctcagcttcccctttaaatgtaaattcaaattaatttttagttacttttttgctcctgcatctgagcataggctgttagaagcaaacaggccatttcttaaatgctttgctgcttagaaattttttctgctagataccctaaaatacagacaagttatttgctaaggcataacatgagttacatttgctccagttcttaataagtttctcattttcatctgagaccttgtcagcccagaattcactgtccatatcactatcagaatttggttacaaccatttaagcagtctctaagaagttccaaacttttcctcatctttctgtcttcttctaagccctccaaactctcccagcatctgtctgttactcagttccaaagttccttcctcatttaaaggttatctttatagcaatgcccaacttcttagtatcagttttctgtgttaggctattcttgctataaagaaatacttaagactgggtaatacataaaaaggcttaattggttcagtgttctgaaggctgtacaagcatagtgctgatacttgcttggcttctggggaggtctcaaggagcttttacttatggcagaagacaaagcaggagcaagcacattatgtggcaaatacaggagcaagtagggggtaagggtgccacacacttttaaatgaccagatctcataaatcactcactatcacaaggatggcaccaagccatgacggctctacccccatgacccaaactcttcccaccaggcaccatctccaaaactgggtattacatctctggagaaagtttgagtggtctaaattaaataacaaaccagccacaacatttccttaaaccaaagcataacccagagaaagaccctaattatctttgattctttgaaggccaagagaggtggggaagctgtagaagaaaagctgaatgctagcagaggatgattcacaaagattaaggaaagaagctgtcttcataacataaaatacaaggtgaagcaagtgctgatgcagaaactgcaacaagttattcagaagatcaagctaacatcatttatgaaagtggctacactatgcaaaagattttcaatgtagacaaaacagtcttataatagaaaaagatgctatctaggacattcagagctagaaagaagtcaacgcctggcttcaaagcttcaaaggataggctgactctggagctcatgcagcagctggtgactttaggttgaagtcaatgctcatttaccattctgaaaatcctaggatccttaaaaattatgctaaatatattgtgcttgtgctgtagatatagaaaagcaaaccctgggtgaatgcacatctgattacagcatggtttactaaatattttaagcctgctgttgagacctagtacttagaaaaagattccttttcaaagtattactactcattgacagctgttctgcctatggagtagccattctttattcctttagtttcttaataaacttgctttcattttactctgtggattcaccttgaattcttttttgtgtgagatccaagaaccatctcttggggtctggatttggacccctttctggtaatatctttctggcgaaccacagaagggatgatactgaagagacacccgacccaaaggaaaatcatctgtgtgaaacaccaattggctaactccgggtaagtgggatgaatttacccaggtaaaagatgggactggatccgaggcccaacctaggaaatttagagtctctcctaagacagagagagttaaaggcccctcttactaaaagcaaggacacttgactgaacctgggtttgagacccaacttagggaggtgagagtccttcctaagatttaggggatgagaggccccattcagtaaagtccctcttggctaacaacaggtttggcactatgggatattaattgctattctctttggattaatctgtctttcactctttgctgacggctatgggtggcagaattaggcatgtacaggatcatgggacatggggagtttttctccctaaaaggggaaatttgagagttgacggggctgctgggaaaaatccctgtgtgactgacaagcagctgcctaaacttttcagtgtggctgcagtgaatgggtctttctctggcctccctgagctcctagacttccccatcccattgcaggcaatgcttttctccctttcccttcctttctctctctctcataaacagttatttttaccattcattcaaagttgaatgaatgaactttgaaaatcattcaaaattgaatgaatggtaaaaatcatggtttatctcctctgtaaagttctgattaattggaaaaaggatttgtgaggctagccttaaactgtagcaaatctgttgtattttgtgctatgaatttgtctttctgtatctttctgtcagaaagaggggtaccttaggatagaacaggggcttagggccccataagccctctgttcaagacagcacagcaaactggtcagttatgtccttgggagcttgaccttgtaaccacgtggcactactttctcttggtctctgccatctggaggacagaaatttgggggttcatgaaatagtcagccctaaaaattatcttgctaaaagacttcacaagctcaaaattggctgctctagactccttctgggaagagcattggaaactgcccaatgctgtagctcagcagctaaagttttgccattttacgggggcagcctaggttcaatttctggcttagggaatgagtcctttctgggttgatacctgcatgacatttaccatttgttaattttcttcccctccaaaaaccatgttgaattgtcctttctctgagcatatcggaggttacctttagtaaggttcaaacgccagaaatattggctgtttggcctggctaaaatcaggtaataagaaatttaaaagttttttttttaagagtgctatgtttaaaagtcagcttaattgaaagtggatattcaagctctaacagcctgaggctccttggtaaaaaaaactgaagaggcaccacagaccccattttaggaaaaacttctcttttcctcatgaaatccaagaaattagaagtggataagagcccactcaaaatctaaggctctgttctgatttgcattgcattatctgacaactttaacttttgggggtgtcagaaattagttcacaaattacttcacattatgagagagctttggtgtgtaataactaggtaggaaatttacttttggggatagctaatggcagttatggggaaatactaagctctgcacatttgatcagagaagcatgctcttcgacacctagaagttatggaaatgtccccacccgacccctactgagagataagactcctgtgggagatgcattgattccctgttttaggagatccaagatctggtataaaaatgggacccttaaattctagaaatctgttttacctcccaactgtgcctgcttattaggccctagaaactgtatgctctcctggccctgttcctccaagggctccactctaaagccagtaatccaattaagaaactggtaaatgaaaaatcttacaactactgaatcttttgtctgtctgggtatttatatatattgtgtatgtgaaatataaaagagctttgattcattggtttaaaattaataagagcttaaatcaagtatgttatcagaaaaataaaaagtgtaatgccttttacttcatgtaacatatctttggtaaataaataaagttttaaagattattggtaaaataaaagtcttcaaaatttagacatttggtctaaattaggcaggtgatgtattagtttgctaaatgctttagggtcataaactgattctttgacttttctcaattattcagtttacttagtttggagcatcagattctataatagataaggcctggggtcatgtggagagccttgccctctagctatgcggggaagagtcagcttttatctacacttctgtctgatgtcataggctccacacctggtacataattacaatcacttattaaccaagtttttcaccaaaagaaaaagttgctaagagttaacagtgtaacacgtagttgagactactaagaaaacagttctacatgcaaggcctatcaggaaagtagaatgtacttttggtaaaagattataagaagacatgggaatgtgaatttcttgtctacatttagagggttaaaggattgttttatgtgagatagaaaaatatatataaaggtttgaacaagttgtggaaagtttataaaaaattaattgtaaagagattctgcgtgcaaacatattggctaaagttaaaggggtattattcagttcttccataaattgaacatagaaataaaagcacaacaagtgttacttacagcactgatctgctctttaaaaaaattgtaaaaggttataaaaggtttataagaaccttaccttatggtcaaactgattaagattgaatatatttgtcgacaaggttttattaagaattgaatttgacatcaataatgcactaacacaaaagtgaaatttgtattatttggtataaaaatgatacaggaactattgtcaaatattaaatggtgtttggctttctttgggctgtatttgtataaatatgttattggtatgtattccaaaataatgggaaactcctataattctgataagacacagtgtatattatcagtaataattgtaattgttacataaaatcattgtatgccacagatgtaaccaaatttctttgtcaatcatgtttttgactatggttgccctaagacattttgtcattcacagacaattgttgtcttgttttggtccccttcaaaaggaggttttaaaatcagctacaggaatttgacaggtgatcctgaatgcaggtttctgataacattggagattataacagtaaaatagaggaaaaaacttagaggaatctcaggcacagctgaaatgttcctgaacatcaaacaggggttaaactgcatggactaaattaagatagaagtctaaagtaatctttttgactctttgcttaaaatgttgctgatcctttgttttgtttttcagagttaaggaaacttttgagctatagacagctttttttttttttttttgagatggagtcttgctctgtcacccaggctggagtgcagtggcatgatctcggctcactgcaagctcctcatcccgggttcacgccattctcctgcctcagcctcctgagtagctgggactacaggcgcccaccaccatgtccggataattttttgtatttttagtagagacggggcttcaccgtgttagccaggatggtctcaatctcctgacctcgtgatccactcacctgggcctgccaaagtgctgggattacaggcatgagccactgcacccggcctagacagcttttaacaatcaagtaaagtatactcctgtgaaccaaatttgaggcatatttgtttctctccacctgatttctccaaaattggaaaacaagccgtgggtattcttaacttatggcaatatagttattgcataagtgcaataagaatattttctcttttgtaacaggacacaattggagaaactggttattttaccaaggctttgactggaatggcacactttcctttacggaatcaaacttgacttataaagccaataaaagacccttaagaaaaatggcctcataccttgcccatacaatctctatccagagttgctaacctgtggtaagtaaagaatgtcactttctgacaggcccgggagccccaagttatcctgggacctcaagaggagaggaatttacctaacttataggtatttaagggtacaaacccatgaccagacttggctttaaaaaaaagaaaaattttatctgatattccttttatggaacaaagttccatcaaagccaatttaaaaagcctctataaaataatcattcttggatttgatggcaagatggccaaataggaacagccctggtctgcagctcccagtgagaccgatgcagaaggtgggtgatttctgcatttccaactgagtacccagttcatctcattgggactgggtggacagtgggtgcagcccatggattgcgagccaaagcaggctggggcatcgcctcacccaggaagtgcaaggggttgaggaattctctcctgaactcaagggaagccatgagggactgtgctgtgaggaatggtgcactctggcccagacactgcactttttctaagaccttcgcaacccgcagaccaggagattccctccagtgcctatgccatcagggcccagggtttcaagcacaaaactgggcagctggttgggcagacaccaagctagctgcgggagatttttttttttccatatcccaatggcaactggaattccagcaagacaaaaccattcactcccctggaaagggggctgaagccagggagccaagtggtctgcctcagtgggtctcacctccacagagcccagcaagccaagatccactagcctgaaatttttgctgccagcacagcagtctgaggttgacctgggatgctcgagcttgatcgcgggaggggcatccaccactgctgaggcttaagtaggcagttttatcctcacagtgtaaacgaagttcgaactgggtggagcccaccacagctaagcaaggctgctgtggccagactgcctctctagattcctcctctctgaacagaaaaaaaggcagctgccctggttaggggattatagataaaaccctcatctccctgggacagagcagctgggaggaaggggtggctatgggcacagcttcagcagacttaaacatccctgcctgatggctctgagagcagcagatctcgaagcacagcgtttgagtctctgctaagggtcagactgcctcctcaactgggtgcctgacctctgtgtatcctgactgggagacatctccgagtaggggtcgacagacacctcatacaggagagctgtggctggcatccggtgggtgcccctctgggacgaagcttccagaggaaggaacaggcggcaatatctttgctgttctgccatctccattggtgatacccaggcaaacagggtctggagtagaactccagaaaactccagcagacctgcagcagagtggcctgttacaaagaaaactaacaaacagaaagggatagcatcaacatcaacaaaaaggacatctactcagagacaccatccaaaagtcaccaacatcaaagagcaaaggtagataaattcacaaagatggggagaaaccagcgtaaaaaggctgaaaattccaaaaaccagaacatctcttctactccaaaggatcacaactcctcatcagaaaggtaacaaaactggatggagaatgagtttgatgaattgacggaagtacacttcagaaggtgggtaataacaaactcctctgagctaaaggagcatgttctaacccaatgcgaggaagctaaaaaccttgcaagaaggtgagacgaattgttaaatagaataaccagtttagaaaagaacataaatgacctgatggagctgaaaaacacagcacaagaatttcatgaagcatatacaagtatcaatagccaaattgatcaagtggaagaaaggaatatcagagattgaagatcaacttaatgaaattaagcgagaagagaaaatgagagaaaaaaatgaaaatgaatgaacaaagcctccaagaaatatggaactgtgtaaaaagaacaaatctacgtttgttaggtgtacctgaaagtgatggggagaatagaaccaagttggaaaacactcttcaggatattatccaggataacttccccaacatagcaagacaggccaacactcaaattcaggaaatacagagaacaccacaaagatactactcgagaagagaaaccccaagacacataatcctcagattcaccaaggatgacatgaaggaaaaaatgttaagggcagccagagggaaaagtcgcattatccacaaagggaagcccatcagactaacagcagatctctctacagaaaccctacaagcaagaagagagtgaggaccaatattcaacattcttaaagaaaagtattttcaacacagaatttcatatccagccaaactaagtttcataagcaaaagagaaataaaatccattaaagacaatcaaatgcggagagattttgttaccaccaagcctgccttataagagctcctgaaggaaacactaaacatggaaaggaacaatcagtaccaaccactgcaaaaacataccaaattgtaaagtccatcaactctatgaagaaactgcaccaactaaggggcaaaataagcacctagcatcataatgacaggatcaagttcacacataacaatattaaccttaaatttaaacaggctaaatgccccaattaaaagacacagactggaaaaatggataaagagtcaagacccattggtgtgttgtattcaggagacccatctcacgtgcaaagacacacataggctcaaaataaagggatggaggaagatttaccaagcaaattgaaagcaaaaacaagcagaggttgcaatcctagtctctgataaaacagactttaaacaacaaaggtcaaaagagacaaagagggtattacataatggtaaagggatcaatgcaacaagaagagctaattatcctaaatatatatgcacccaatacaggagcacccagattcctaaagcaaattcttagagacctacaaagagacttagactcccacacaataatagtgggagactttaacaccccactgtcaatattacacagatcaatgacacagaaaattaacaaggatattcaggacttgaattcagctctggaccaagtggacctaaaagacatttacagaactgtccaccccaaatcaaaagaatatacattcttctcagcacctcatctgacttattctaaaattgaccacataattggaagtaaaacactcttcagcaaatgcaaaacaatggaaatcatagcaaacagtctctcagaccacagtgcaatcaaactagaactcaggattaaaagctaactcaaaaccgcacaactacatggaaactgaacaatctgctcctgaatgaatactgggtaaataacgaaatgaaggcagaaataaagatgttctttgaaaccaatgagaacaaaaacacaatgtagtagaatctctgggacatatttaaagcagtgtgtagagaaaaatttatagtactaaatggccacaagagaaagtaggaaagatctaaaattgacaccctaacctcaaaattaaaagaactagagaagcaacagcaaacaaattcaagagctagcagaagacaagaaataactaagatcagagcagaaatgaaggagatagagacacaaaaaaacctttcaaaaaatcaatgaatccaggagctgcttttttgaaaagatcaacaaaatagaccactaaccagactaataaagaagaaaagagagaaggatcaaatacatgcaataaaaaatgataaaggggatatcaccactgatcccacaaaaatacaaactaccatcagagaatactataaatgcctctacagaaataaactagaaaatctagaagaaatggataaattcctggccacatacacctttccaagtctaaaccaggaagaagttgaatccctgaatagaccaataacaagttctgaaattgaggcagcaattaatagcctaccaaccaaaaaacatccaggaccagatggattcacagccaaattctaccagaggtacaaagaggagctggtaccattccttctgaaactattgcaaacaatagaaaagaaggaatcctccctaactcatttattgaggccagaataatcctgataccaaaacatggcagagacacaacaaaaacagaaaatttcaggccaatatccctgataaacattgatgcaaaaatcctcaataaaatactggtaaactgaatccagaagcacatcaaaaagcttatccaccatgatcaagttggcttcatccctgggatgcaaggctggttcaatatatgcaaatcaataaatgtaatccatcacataaacagagccaatgaccaaaaaaaagcacataattagctcaatagatgcagaaaaggcctttgacaacacccttcatgctaaacactctccataaactaggtattgatggaacgcatctcaaaattataagagctctttatgaccaacccacagccagtatcatgctgaatgggcaaaaactggaagcattccctttgaaaactggcataaggcaaggatgccctctcttaccactcctattcaacatagtattggaagttctggccagggcaatcaggcaagagaaagatataaagggtattcaaataggaaaagagaaagtcaaattgtctctgtttgcagatggcatgattatttagaaaaccccatcgtctcagcccaaaatctccttaagctgataagcaacttcagcaaagtctcaggatacaaaatcaatgtgcaaaaatcataagcattcctatacaccaataacagacaaacagagccaaatcatgagtgaactcctattcataattgccagaaagagaataaaatatctaggaatacaactgacaagaaatgtgaaggacttcttcaaggagtactacaaaccactgctcaaggaaataagagaggacacaaataaatggaaatacattccatgctcatggataggaagaatcagtatcgtgaaaatgaccatactgcccaaagtaatttatagattccatgctatccccattaagctaccattgactttcttctcagtattggaaaaaactactttaaatttcatatggaaccaaaaggagcccgcattgccaagacaatcctaagcaaaaagaaaaaaagctggaggcatcaggctacctgacttcaaactatactacaaggctacagtaacaaaaacagcatggtgctggtaccaaaacagatgtatagaccaatggaacagaacagaggcctcagaaataacaccacgcatctacaaccatcagatctttgataaacctgacaaaagcaatggggaaagattccctatttaataaatggttttgggaaaactggctagccatatggagaaaactgaaactggatatcttccttataccttaaacaaaaattaactcaagatgaattaaacacttaaacataagacttaaaaccataaaaaccccagaagaaaacctaggcagtatcattcaggacataggcatggggaaagactttatgattaaaacaccaaaagcaatggcaacaaaagccagaattgacaaatgggatctaattaaactaaagagcttctgcacagcaaaagaaactatcatcagagtgaacaggcaaactacagaatgggagaataattttgcaatctatccatctgacaaagggctaatatccagaatctacaaataacttaaacaaatttacaataaaaaaaaataaccccatcaaaaagtgggtgaaggatataaacagacacttctcaaaagaagacatttatgcagccaacaaacatatgaaaaacaaaaaacctcgtcatcactggtcattagagaaatgcaaatcaaaaccacaatgagataccatctcacgccagttagaatggtgatgattaaaaagtcaggaaaaacacagatgttggagaggatgtggagaaataggaatgcttttacactgttgggagtgtaaattagttcaaccactgtgaaagacagtgtggcgattactcaagtatctagaaccagaaataccatttgacccagcaatcccattactgggtatatacccaaaggattataaatcattctactataaagacacatgcacacgtatgtgtattgcggcactcttcacaatagcaaagacttggaaccagcccaaatgcccatcaatgacagactcggtaaagaaaatgtggcatatatacaccatgggatactatgcagccataaaaaagaatgagttaatgtcctttgcagggacatggatgaagctggaaaccatcattctcagcaaactaacacacgaactgaaaaccaaacaccacatgttctcactcataagtaggaggtgaacaatgagaacacatggacacaggcaggagaacatcacacaccagggcctgtcatggggtggggcgctaggggagggatagcactaggagaaatacctaatgtagatgaaggggtgattgatgctgcaaaccaacagggcacaagtatacctatgtaacaaacctgcacactctgcacatgtaccccagaacttaaagtatcataaaaaattattattattcgtgctgcactttatacagataatcaggccaaatataataaagcaaattggtcgtactatgatttgtctttattaaaaatgggagactggagagagaaaaaaatatgtttcaagaaatatggtacacatgttattagatgctagtctcatcagttgttttcgagttttttatacaatttagactaaccctgcttattcctgtgttcaaccagtgatctctggctgctgctcagaagaaacaagagggatggatctcaccttttgttggtactgaagagttatgtattgccctgaccatacctacactttctgactgagctcctctctaccctgaatgcaagagacccaatagttaggcagcaatattattgcccctgttcagcctgaagttacagaagatggatcttcatccctctcaaacccttaggattaagggttctcttataaaagggagggggataatgtcagaggcatttgaatcagagtgcctccatcttaagtagtggttgggtaaaataaggctgagacatgctgggctgcattcccagttaagttgctcattctaactcacaggattagataggaggtcgacacaagatacaggtcataaagaccttgctgataaaacagcatgcagtaaagaagccagctaaatcccaccaaaaccaagatggtgaaaagagtgacctttggtcatcctcactgatacactcccaccagtgccacaacagcttacaaatgccatggcaatgtcataaagttatcctatatggtctaaaaatggaaggaattctcagttctaagaaatgccagaaaacgcatgaataatccaccccttgtttagtatataatcaagaaataactgtaaaaatggacaaccaacagcccctagggctgctctgtctatggagtagccattctttattcctttattttcttaataaacttgctttcacttacaaaataaaaatgttactacttgttgataaggcacctgtcacccaagagctctgatggagatgcacaaggaaattagtgttattttcatgcctgctaatacaacacccattctgaagcccatggttcaaagactaatttcaactttcaagtcttagtttaaaaatacattttgtaaggctatggccaccatacagagtgactcctctgggatctgggcaaagtaaatttaaaaccttctggaaaggctataccattatagatatcattagaacattcatgattcatgggaagatgtcaaaagatgaacacaaacagaagtttgaaaaaggttgattccattcctcatgaattgaggggttcaagatttcagaagaggaaataactgcatgtatggtggaaacagcaaaataactagaattagaagtgggacctgaagatgtctgaattgctaaaatttcatgattaaacttgaaaggatgaggagttgattcttgtggatgagcaaagaaagtggtttcttgaaatgggatttactcctggtgaagatgctgtgaacactgctgaagtaacaacaagggatttcaaatattagataaacttagatgataaaacagttgtagggttagggaggattaaccccatttttaaagaagttctattgtgggtcaagtgctatcaagccacatcagatgccacagagaaatctcatgaaaggaagggtcaatcaatgtggttaatttcattgttgtcttattttaagaaatttccagagccaccccaacctttagtaaccaaaattctgactattcagcagccaccaacatcaaagcaagaccctccaggagaaaaagaagactcactgaaagctcaaatgattgttagcagttttttttagcaattcagtatttttaattaagccatttacgttgttttattcagacataatgctatcgcacacttaatagactatagtatagtctaaacatattttttatgtactgggaaatcaaaaaaactcatgtgactcgctttattgcaatcttagttttactgcagtggtatgtaaccaaaccaagccatattgccaaggtatgcctttattaatttctcagtgaagccttccccattaacattatttggaattgattcactatccactctaaactctcaatccttttacctcttgtttgtccccatggaatttaaaaatgcttgattttccttcttcctctattaatctgtcaatctacctcttcatttattaaatgtcttatacttgaaatgaagctctataaacaagaatatttactgtatcacagcatatattattcattaattaataattaatattaacaatatttaattaataaatgataattaataacaataaattaatatttagttaataaattatattattaattaacattaatattaagctctatgaaacaagaatatttactgtatcacaagtccctggaagagtgcttaatacataagatagtctcaatacatatttgttaattgattgaaaagattaatcctatcttgttaccaagatcttcccatgtttaaaaaaaccatataacatttctaatattttcataggactctagtcagctgatatatcaaaattaactaaactccacttttctttccatttaggacattttggagtttttattacttttttaatgaagtccttgatgtttaagttttggtatcaataatagccttaggatgatcttagaagcagaattctagggtcaaatggcatgaatgcttgaaacattttgccaacctgcccttaagaaacactgatataaatttatactttcaacacaatgtatgaggctcctcaattttccacactctcaacaatgtttatatctattttctttttaaatttgttgagcatacccctgcccccaacccatgactaaaaacaggtcaatgtgagagataaagtgatgcttaaatacttttccacttaacaatttcacttaccggagttggatcaatcacaaaatcaattacatatccatgaattaaaacttggtgtaataagaaaagactgctttataatgtgataagcctcatttaattatttcttcattagacaattctaacgtgttttattagtcacacaacactaaagggtatacaatatactgagtctagatgtactatttccttctttaatttagactaatgaaaatgagttttatccctcttaagtatattccaaaaaactttacttataaataaaaccattttcatatttctaaataaagatgtaaaataatttgaaataaatacatggctataacatgagttattgaatgtcttataagttccataaatcccatgagattacaattattcacatatgcatcaacttcagttcttaacacttttacctacaaatgtaagatatccagtaatcaattttaattttccaataattctctatatagatagaaagaaaacgatgtgcgttttttaagttcaatgaggcacagcattctttctagtaatgtcatgacccaagtaacaaatatgcatatcatgttctccaaattaagtcagacaatgttatagttttatttatgtgtacacacatatatacatataacaatactaaataattttatctgatgtataagaaattctgcatccaaccaaaaaaggtctttccattgctattaaagcaaaacaaaattaccaatgtttaaaagagaaataatagggtaaagaaacttcttttcttattttgttactaagaacattatgatatgaaaggccatcattcataagataaacattccccacaccatataacaaatagaattattatcactgaatcttttgattatacaatgatgttttaaaaatcaaatgatgtcatgtattagttgtccctagcaaaagttagggtgtaaattacaaacagaaacaggctattttcattttaaagcaaaaacaatattaatatgtatatattaatattaaaaagaatagacaattttttggttatattgatcaaaaaaaacgtaaaactctatttaaaaattaggaatctatttagagacttgataatatcgcacttaaatcttgtccttgattagatcaatgtaacagagtctagacaaaggaaagttaatcttcaattaccagaatacggcatgatattaattgaattggccctgggcacctactaaatctattttagagcaaaattttggatggtataccttaaggtagcagattaaatttaaaaggataattccataattactacaatatctacatgtcagaagatacaaaatttcatatatcatggtatcagataatagcttcagaggtccatatggctttttccaatgtgttgataatagaggcacatggggtttctgttattatccctttgaagtatgggccactttaagatgcacgatagcaaacttcatgaattactggtattaaccaacatgataaactcttttcatttcacaagctgtctactctgcagttgtacagtgactttgacagtcactatgtctttgacttccaaataataactgtcttccaaatgaatacatttcccttacctctcaaattattttagaagttagtgttggcttaacattaggaagaaacatgtttcatattatgataagatcttatacttcaaaggagcttcaaaggttctgaaaatgactctgaaatatatttctcattaatcttttgtattctcatgaggcaagtaggtggcaaatatctcaactgtgaaaaacagaaactaatgaaacaattagctaatttacttgccctatgctaaatactgaagcaatgaaaagtcatagtgtcaatcctggcacttaactgaaactcttattttgcattccatcggtaagaatttttatgcagaggagagtaaaggaatacagacaaaaaatatcaggaaatatgatactcaacataatttacttcataagaccctgagattaatattatttcttatttaattgattgtgcttgatgatggtgatggtgctgaaacttcaaagaacttatttccctgggtgaccacagttgagtgtaatcagggacacactacaggagtttgaatcctacttcacagcaaagctaaaacctcacaaaatcaacatggtgtaataactcaagagaagaaaaagaaaataaaaagtgaaatttcaacttaaaatggatctataagctggcaatatgcctgattcttaaaaggcaatgagaaacaaagcaaacctctggatctcaggctgtccaagtattatttgctggataagttatattctcctgttttagtttttcattaaaaactttggaaaaaagagtttcttcattctgtttcatttttttctccatattctcataaaaattcattacaatggtatggttgtttagtgggaatacacctgtaatttattgttgaaaatgattgttcctgttctctatctagttttcctgtgtaaaatagcataataactgacttatcttcatttccagcaagtgttactgctttagaacaagaatgctgttactgatagctaagaccatccaaattttaaaaattaaaattaattttggaattgtaaatgctcaaataaatgtttatctttttaatatagcttctttctttatatttgaaaaaaaataaaaataattctgtacaactgccttgatgtatatcttctatatgactgattttccaaatcagggtaaagtgcctttctcctctaacaactttagcatgttatgagttctgtttttttccctaatagaatgctgaatgactttattagctttagtaaaactggtaaaattgtctttggtaaaattaagagacataacccaccctcccccaaaatcttcttacgtttgaaaaaaataacttaagtcttttactgaataagtattttcctttttggtttttgacctacacacttaagagagtcagggtaaatgcaaatgttgtttacaatcacagtaagtcctcacataacatcatggatggtttctcggaaactgcaactttaagcaaaatgatgtacaacacagcaggtcctcaaataatgttgtttagttcaatgttattttgttacagcactgatgagaaaaatggttttgttatacattattttgcttaacttttcagtctccaagaacctatcaatgattctagatattttaatatggaaaccttagaatttttttcctcatagctttataaggacttctagacttacctggcccatcagtcactttttctaggcaccgaggagttgcactaagaaaagaggcatgttttcttttagccactaaactacgaggtggcatatatttatgcttaacttgggacatctcatatgatttgtgaacatcatagctgcctggcgctggaataacctgaaaaaaaatttaatagatgagcataaatatatcttatactgaaaatatccaagaagataccagatggatggttacagtaagcaatgaatagaaaaatcctaatacttttattaattaaacattaaaaatagaaacttaaaaaggaattcttaaatctagcctgcctaataaaaatgtaaatttacttgccaaaattaaagtaaaataaacacaagtatgaactttaggatcatattctttaaaaaatagctttcatgatatagatcaaatatattcaatttaatcctgaaaatcaaattgcttataagaatgagagcaatgattacctgttttcctaagcagcagaactattcctgctttattgttgtaagtgaacattgttttacttattctacaaaatgagactgcttatttcatctttaatagattacaattaagttagaaggcttcctctttcatcatttatggttctttatatgaactgcagtcatagtaacatttttaatcaacatgaacccacatggatattaataaatataataattaattctaaactaaatgaaatataagtgccatatatttgttggacaagtaatgccttaaacaattagctaactatctcagtgaaaacttttttaaactcattttcctcaaattataacatattcctttgaaatctattcacctagattatgtataaagacaaaaactttttaagcgttaatgatttcccagtaggcaggaaagtgttatggctaagcatgtggactctggcactagacttcctaggttccaaatatctgctgcttactagctatgtgaccttaagcaagccacttaccctctgtgttcctgagtttttgcatgtgaaaagtgagaaaaatgatagtacttattttataatattattctgaggattaaattagttaaaatgagtaaagtacttagcttggtacctgtttctataaaagggttaagtgaatcttactattctagaaaagctaatttcaatgcaaaaacaaagcctgaccaatcagggtttgagctaacagggaagtattttaaagtttcaaataagtcaaacaaatttggatgctgagaaagcatacttttgaagtccctctaggagccatattttagaaaacacattttttcttgttccttacatccatattatcaccctcaagcatatgctaacaacattatcttccacttccaaagaatcacaaaatatggtaagatcatgactaggggaggggattcttacatgaaaaccccacttctggtttgagtcccatgttaaacatgaaatgtcatgataggtaagtcatcaaagaaatgctggacaccattttctttttgtctgcatcaagagtatatacagtaaaactaggctgaaaataagcaacagaggcaatatttccatggattatttgtgtatcttttggggctgcctctatggtatgtgaaaagaaaccggaagagattataaaaacacaaagagatcctgtgcatacaatatgcctagtgtaaataggaaagctttgcgaagatcttgattgtgcctactatacactttagttttcttatcagaagacattattgttcccatttcctgtaacaccctacgtggtgtcaccatctatttcttcttccagtgcctagactggatataattgataagtttggctactgccacacagaaactattttttttaataacttgaagcaaagacaagaaactgcatcagtgatcagtgttcttcaacaatagtttgttcacacctggaaaagtttgtcaaactagttccttaaattccagtagattcactgcctctcttaccaatccaatgtatactacccttgttcatgaccacctgctgctatgtatatttattcttctctgaaacttattcccttcttgtctactttactgatgttccctcctcttcctactcatcttaaattctaattttatctgaccaagagattaacatttcaagtaaatatcctaagctgatgattaataggacaaatctgaaactctgtctaataacaataatttaaacaacacctatataccatatagtaccctaaatgagctgaataccattgtcagggaaaaatagtatttgtagatgagatcatcaaatttgttggcgattctttatacatcatagaaaataaagaagggacatgaagaatggatataatagacatttctcatggttttttggtggttttttttttctctttttggcttattgcatgacttttttctcataccaatatttaaatcctgttcttgcatttgggaaattccacattatacagcagagaatctgggtcccaacacaaaagctaaaaatgtctggctctcatcttcctggtctcattttttagctagaacatgaatcctggtcataggcttagtgtcctgacttcctcatctggaaaaccaaagccctaccctaaaataacataaagaagcatagaatttgtatgattaatgtgcataaaattcttaaaatgttttctgacacataaggagtagcagtgttggctttcattgctatcatcattgccattggcattaatatctttattgggtataggacttacgaacccctcagtgatatctcccttgcctgaagagagatgctaatgggatatcaaaacggaattccctagtattttaagctacaaacaaatcaaaagtagttaagttgttgagaatcacataaagacagtgttccaggaagtttaaaaagaattcactggtttcaacctacttcaaaggaaggtgggtcagcctgtttgtattttggcaaaaccatttcacatactttgtgattttattcatttctgtcaagtcaaagtctctataaaattctacttgctcaatacccatgcaataactcacttaaaactcaagcctgactgacctgtaaccccagagaccaagagattaacatttcttggtctgatttcatacaaaattcagaatttgtatgaaaaggattcagaatttccaactgaatgaaattggaaaaactgtgaatttgtatgaaatcgtgaggtttcaggaggtatgaaacctcctgatttcatacaaattcagaatttttccagaatcaagaggtttcaggaggcatgaaacctcctaatttcatacaaattcagaatttttcaatttcattcaaggctcactgctattttgacatatgaaatttcgtatactctctgatctcagacatgtgaaactgcatgtaggttctgatcttcaaaaactttggttacaaaacagcaacaagtaaacccctcagccacagaaaggaatggagcaatggagcattcaatccctaaattgtctcccatgttgtagcatattgcaaataaagattgacctcaagttttagtctcagaaaaaaattttcctttaccatgcaatggtaaaagatccagacatatttttatttcatattcatttttgaataatagttttactaaatatagatttttttgcttgaaattttttactctcagccttttgcatgtcttttcactaatttctgacctccactgattctgatgagaagcctacaattagtgatactgtttccactatataagtttcctttttcttgttgctttcaagatgtcacctttgttctctttcactagtttgactataatgtatctaagtgtgaattctccttaaatgtattcaccttggagttcactgaacttcatggattcatggatatagtggttttttttattacatttggagagttttcagcaattatatcttcaaatattttttctgctcctttctttctcacctctccttctgggtcttttattatccatatgctaaaatacttgacattgacccacaggtctcaaactactcgtattgttcaatcctgttctgtgtttctcatattcaatgatttctattgatctatctttcagttaattaattatgtcttctgccctctcaaatctcctgagtcaagttagtaaattttttatttatgtttttgtactttacaactctagaattatttttgttcttttgtttctttgcttgcttctattatctattaagattctctattggctcactgctagcatgtttttctttaattatttaatcataagttccattaattctttgaaaaaaaattaatagctgatatttacatatctaataagttttttttttgaaaagtggacattttaagataagatagcaactctggattttttttctttaatgagatttgttgtccatttcacctaagttttcaaatttcaaacttgttaataatgcaaactgtttgccttttgctttcagaatctgtagagatgtccttattttcatttctgaaatttttcatttaagccatttctcattttttcttagtaagcaacattataaggtggtttattctattcgatctcttaagatagaatagatctatctaaataaatagaataggtttatctttacatttgaatttgtctttttctccttaaagttatttacgtcaatatttgctttgcatatatgtggagctgtgcatacaaatttaaattatcatattattctggttaattaaacattttaaaactattgaccgaccatgactatttacttctaaattgctttttgttttaacatattttatctggaatcaaaatagctacaccaatgagtaagtcttgataaactattactgataaacagtacattttgataaacctctgcattaaatttcagaaatagtaaaattttaaaattattgtttgaaagataacagagattggtaataataggaggatttttatgctaaattccaaaaagtagaagagaccttcctatgtaaattgagattacaagctgtgttccatttgcatagccatttactaagtctgggcaaggactaaagactggtattgtcacagattattctaagagaaaaagaaagaatttgtgggtcttttgaaagtcacatagtacagcatgactatgagagaataaaggctgagagaaggcagcctgaacttctgaacctgaacctcagcctgaactcagaggagcctgaactcagcatcactgattctttactatgaagtatttattgaatactgaagcaggccaaaggatagaggtctggactggaaagacagagtaaaatctcctgtaatctagtgatgcctaggagacaaagtcacactagagcaatgactgacaacaactacaagcttcttactcaagatagttgccatattttgaatctaaatgagatacaaagctaaagtagaaaacactgaagggtggaatatacgggaaagaagggaaaaggaacttcagactctcaatcaaaaaaccaggaaggccactgggtgtggtggctcatgcctgtaatcccagcactttgggaggccgaggcggttggatcacgagatcaggagttcgagaccagcctgaccaacatggtgaaaccccatctctactaaaaatacaaaaattagccaggcgtggtggcatgtgcctgtaatcccagctactcaggaggctgaggcaggagaatcgcttgaacccaggaggcagaggttgcagtgagccgagacggtgccactgcactccagactggcaacagtgtgagactccacctcaaaaaaaaaaaaaaaaaaaaaaacacaggaaggcaacatggagggcacaggaccacaaaggcagagtgaaatctcagtctttgcttaggagacaaactcttactggagagaagggcctgcgaaaatatgcagtaggtctaggtctaatagcaagaggtatatgaaagaaattcttgcaatacactagagttaaaattctgagcaattaagccagaactacttcctctttcaagttatgaaataaatgttcttccatttctgtgcatatatatcttataacttgttctagctgttatttcatagttaagtatattctagtctaaaattttatttcaaattcttaaatacataattttaagtcatatagaacttcttttacaatgaaacttgtcattatcattgaagtgacttaagaagacttcaaactttcaatcaaaactttcaagcaaaatctttaaccaaatatatatggtgaaaaaatttataggctataaatatagttatgtttgcctaaatattcagaaaactttgtttaagcaatttgccaatctgcttatccaaattacttaaatttggttctataaagaagaaaggcatttcagatgataatcaaattatctttgttttacatgttgcaaattataattactaaggtcatccttgccattttaagcatctctaatattcatcattgtaaacatatgcctcgtaaaatacatgacttagaaaggaatgtgttattttgataggaaaaagtattttaatatagatataaaattatagtattaattgtaagtagtatgtaaaaatggaaaatactgactttatttccatcttctcctggcacactggaaaagaccatttaggccaatgctgttttatgaaaggaattagaattgactggaaaacatgatacttcaaagctcagtaaaataataacaaaaagtgctgatagtcaaaatcacatagggaataacacaacagacttaacctaattcctgcagcataacattataccagtcatatttgaatcacaaagtttcaattgtgttctggacatttgcacatcattatcctcagatagccttaaaataaaacttattatcttcccttacctgcaactaccaaacgatgtgttctttcctcattgacttacaaaaattctttatttagccaagcctaaaaatacaaagctggcttttacttttgttcacctttctctcgcatatctaaaaatgaccaaggttatatctattgtaacctctctcaccttagacttttctgtcctttactaccaaaaagatcctggcatgagctccaaaatacttattacgtggcagttgtactaactgcttattttagctttaggtcttctagtccccaaccatttgcatgctagtagccaataaactgttgtactaaaaatgacataaactgctaaaaaccctcattggatccccagtgcctatgggaaaaactttcaggaaactctccttggcatccaaagcctcttttcaatttgaaggcaaatttacaactgtaaaagccagttcaagtagtatctctttcattaagcattcttgagaaccctagctagaagtgatatcttactcttctgaattattttattattcattatttgcataaatacataaacataaatagcacactgaacaaatataccatatatatttgaaatttactactttgcttacataagggcaagaaaaagataaagctgtccgatgagaaggaagacaaaatttcctcagataagattcaatttacccttcaaatttatcgagtaatttttccactattctctcaaattagtgaaaaatgacagtaggaatctaggggtatacaagctccataatatcatcaagtatttataggtcctttcatgttttttgctgcatcgtatttaggttgtgaccctcatccttatattctctcaagatattgactgtagctcctgtcataatgtttttatttcaaaaataaagaagatctaatgtttaaatctttaatccatcgtgaattgatttttgtataaggtgtaaagaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtagccttgtagtatagcttgaagtcaggtagtgtgatgcctccagctttgttcttttggcttaggattgacttggcgatgtgggctcttttttggttccatatgaactttaaagtagtttttcccaattctgtgaagaaagtcattggtagcttgatggggatggcattgaatatgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgattaaacgttagacctaaaaccataaaaaccctagaagaaaacctaggcattaccattcaggacataggcgtgggcaaggacttcatgtccaaaacaccaaaagcaatggcaacaaaagccaaaattgacaaataggatctcattaaactaaagagcttctgcacagtgaaagaaactaccatcagagtgaacaggcaacctacaacatgggagaaaattttcgcaacctactcatctgacaaagggctaatatccagaatctacaatgaactcaaacaaattcacaagaaaaaaacaaacaaccccatcaaaaagtgggcaaaggacacgaacagacacttctcaaaggtagacatttatgcagccaaaaaacacatgaaaaaatgctcatcatcactggccatcagagaaatgcaaatcaaaaccactatgagataccatctcacaccagttagaatggcaagcattaaaaagtcaggaaacaacaggtgctggagaggatgtggagaaataggaacacttttacactgttggtgggactgtcaactagttgaaccattgtggaagtcagtgtggcgactcctcagggatctagaactagaaataccatttgacccagccatctcattactgggtatatacccaaaggattataaatcatgctgttataaagacacatgcacacgtatgtttattgcggcattattcacgatagcaaagacttggaaccaacccaaatgtccaacaatgatagactggattaagaaaatgtggcacatatacatcatggaatactatgcagccataaaaaatgatgagttcatgtcctttgtagggacatggatgaaattggaaaccatcattctcagtaaactatcgcaagaacaaaaaatcaaacaccgcgtattctcactcataggtgggaattgaacaatgagatcacatggacacaggaaggggaatatcacactctggggactgtggtggggaggggggaggggggagggaaagaaaaataaataaataaataaataaataaagaagtagagcacagtaaaaaactaagacaaagagcaaaaaaagaaaaaagaaaaagaaaacttaatgtatacttcttatgatgttgtaaataccaacgtattatttccagaggttgaagtaattttaccatttttttttgttttgtttttaaaatgttatacagaatttagctaaaattatctatactttataaattttttcataagaagtatctagactttataatgatctgtatatgcacgtcattatttatatttctgatcctccattaaaattttattttctacttcttgcaaaaaataaaataaaataaagaagagaaagggtaaaaaccaaaaattgtttaacaactataaaagccttttctgaagtcttttctgaaagcctaatctagtaacttctattttctttgcattggttaaaactgtgccaaataactaccctcaagctgcaagggaaccccaaaaaagtagttgctttacttgggcacattgatattctaaataaaattgggttctgttagcaagaaagaaagaatgaatgaatactgggtaagaaactaataatctcagtcataatagctctctgtttttgaggtcattacaactgtaaaaaattaactcacttcagaaactatgtgtaatattgaactatctttgtcaaaagctttctgaccagggtttgttcattcactttagtctctaattcttgttaatcctttgggtctcaaatcttccctgaattcattagctctttcagctctgatatgttctcagaatacacagctcttaagtttgtagcagttattacatttgcaattaaacaagtctctaatgacgtgtttaatatcacccatcaccataggaatgagagagctccttgagtgttcagaaagcctctattttgcacaccattgtatctcccagaatggtaaatgtctttgcaaacagtaagtgactgacacatatttttaatcaatgaatgaatatgtcagttataagtgcatgaatgagtctaacagtatctgtctaccttgaggctttctttttgtttagccttgttgttaagttcttccatgacagtagggctgacactatgccttgaaagtattttcaacccatacaatgcttaaatttacctcacatgtaatcagttctatattctttatttagcaaagcctaaaaatacaaagctggcttttacttttgttcacctttctgtgttgtataaatatttttcaaatattgcttttgctaaagatgttcctgtttctaataaaggtggatacaatttataatctcagaaacgatatagaagtagaaatatgtccattaaaaccttgatcaagtactaactttcacaaaatcattacagagtgtctccaggtagttaaatttgattaatatttaatgtgagatgcattttcttctctttgctatcaaaaagtagactttgacttttaatgcttaagttttcatgaccacttttgacattagttttatagaaaaaaatgtgtatctcagcatattaaagtaaaatacaagaacagaaatggcctgtataacctttctcttccagcaaatgctaatgctactgaggcagagaataagcagattatctccaattataatagctctaattgacataatatccattcttcagagttctacttttagtctaaaagttaattcttttgcaatgttgaatgtaaagacagagaaattctttaaaaaggacataattgctcctagtaccagttgaacagatttggatatggcattaaaaatcaccttgataaacttgaagtaaattttgaacatgagttgtgagagatgtgtgaatttaaatagcagagttaggaaaattattcattaaccctagagaaatgtctacaagtaggattccaatcaatttatgttcatactttttaaaatcaaatgaatcttaacgtcatctactttggttcagtatggcaagaactatcccttgtatataaatagggaccattttaaggtagtgctactaaaataccacagaacttgaagtcagaattgctgggttatatttatagccttattattaactttaagaggccctcaagaacctcacctgctcatttacacccctcaccatgaagtatgtggaaggacactgtgcacaaggcatttctctgtattctttatcctgtgagattgtcagtgagacgaattgtagaactattcatatttggaagctgcctccaaaatagtaagggtaatggtgggcaggatgatccagccttgcttttctaagttataaatatctcagcatcccattacctacttcaaaaacaattatgtagttatattgagactgagaataataatggtgataacagggagaaatacactatgcaaaaggtaaagagaaaggagaaaaatcaagatgagtaagacaaggtatggaacaagaagaaaggaacattgtctagacagagacatatagatccccaataatatttaccatactcccaaggtaactatgttttccatgttatgacacatagattgtagatctcaatagaaaaaggcaaattgcacatttgaattgtaggaaatctaattattctacattaatgttcctataaattaacatattttctttttttttttttttttttttttttttgagacagagtctcactctgtcacccaggctagagtgcagtggagcgatctcggctcactgcaagctctgcctcccgggttcacgccattcccctgcctcatcctcctgagtagctgggaccacaggcacccgccaccgcgcccagctaattttttgtatttttttagtacagacggggtttcaccgtggtctagatctcctggcctcgtgatccgcccaccttggcctcccaaagtgctgggattacaggcgtgagtcaccgcgccccgccaaataaatatattttctaatgaatgaaatatattttcaatactcccatctgttgccagatttatagtgcttatgtgacaccaaaaaattgtgatagttcatgtatacgtatgtaacaaacctgcacattctgcacatgtatcccagaactgaaagtaaaataaaaaaattttaaaagaatattgaaaaaacagaattgtgcaaattagcttacatttcatgtcaaattcaatagcacattttttagtgacactaaatgtttcttgattaaataaacaaaaaaagaataaaacattcaataaaaaggctccaagggcactattactatttctcagcatcacacatttaaaagctataattatctaaaaacatccaaaatacttttaacttcatacgaatcaaaaagagatcatctaaaaaaattgtgaatatccttacttcttccttcccttctcttgaagaatttggtaggctgtttcccctgttgtataaacaaaatgctacggaagtgatactgtttttatttttttatttagaaactgggtctcattctctcacccaggctggagtgcagtgacatgatcacagttcactgcatcctcagactcctgggctcgagagctcctcccgcctcagcctcctgagtagctggaactacaagcacaggccaccatgcctaactaatttggggctttttgtggggagttttgtgtgttttttattgttgttgtttgtttgttttttaaagataacgtctcatcatcttccccaggctggtcttgaactcctgggctcaagtgatcctcctgccttagtttgccaaagtgctgggattataggcatgagccactattcttaaatgatactctattttagcatccgtctatcagcctaacaacaaacatttatagtctttcctatgcactggagttaatgtctaccagtagtaaaggttatggcctctgaagctgtgttgctggggtcaagccccaagtcagcttttttgctggctatataaccatataaccatggtcaaattatatttctcaattttctcatctgtaaaatgagtctaataataataatagttcctaccttcttgggttgtaaagattaaatgagttaaaatatgtataacacaaggcacatagataagcactacttaaactttagttattattaaataataacaatataatataatgtatcatatataatatatataatttatatattatttataattattatacctcatttatttagttctttttttacactagcaaatattcattcaataaaaagtatttttaaaaacatggggatcgggaataaaacagacatgagaaacatagcaaaatacaaaatggcaggtatcaaggtatcaattctaccatatcaataatgacattacatgtgaatgtatgtccattcaatccaaacaaaaggcaggtaccaattttattagattttttttcttttcaccaacttttaagttaagtggtacatgtgcagcatgtgcaggtttgttacataggtaaacaagtgcaattttggtttgctgaacagatcatcccatcacctacgtattaagcccagtatccattagctattcttcctgatgctctccctcccccaacgtcttgcctccaacaaggccccagtgtgtgttgttctccaccatgtgtccacgtgttctcatcgttcagctcccacttacaagtgagaacatgcgatatttagttttctgttctaggggtagattgctgaatataatggcttccaactctattcatgtccctgcaaaggacataatcttattcctttttatggctgcattgtactccatggtgtatatgtaccacattttctttatctagtctatcattgaggggcatttgggctgattccacgtctttgctattgtaaataatgctgcaacaaatatacacatgaatgtatttccctgcttaataacagaatgatttatattcatttaggtatattcccagtaatgagattgctgagtcaaatggtatttctgcctctcagtctttgaagaatcgccgcagtcttccacaatagttgaactaatttatactgcccccaacagacattatctcattgtggttttgatttccacttctctaatgatcagtgaggttcagctttttttcttgtgtttgtcttctgcatttatgtcttattttgagaagtgtctgttcatgtccttcgcctactttttaataaggttgtttttttttcttgtaaatttaagttcctgtagactctggatattagtcctttgtcagatggatagattgcaaaaattttctcccattctgtaggttgcctgttcactctgacgaaagtttcttctgctgtgcagaagctctttagttcaattcgatctcatttgtcagttttggcttttgttgaaattgctttcagtgtttttatcatgaaatctttgtccatgcctgtgtcctaaatggtattgcctaaattttcttctagggtttttatagttttgggttttacatttaagtctttaatccatcttccattaatttttgaatatgatgtaagaaaaaggtcctgtttcaatttgcagcatatggctagccagttcttttagcaccatttattaaataggaaatcctttctccattgcttgtttttgtcaggtttgtcaaatatcagatggctgtaggtgtgtggtcttacttctgagttctctattctgttctattcatctgtgtgtccattttttgtatcagtaccatgatattttggttactgtagccccggactatagtgtgaagtcaggtagcatgatgcctccagctatgttctttctgcttaggattttcttggctatttgacctcttttttggttccgtatgaattctaaaatagttttctctaattctgcggagaatgtcaatggtggtttaatggaaatagcattgaatctataaattactttgggcagaatggctattttcatgatattgattcttatccatgagcatagaatgtttttccatttgtttgtgtcctctcttatatgagcagtgatttgtacttctccttaaaaagatccttcacttcccatgttagctgtattcctaggtattttattccctttgtaacaattgtgaataggagcttacacatgatttggctctcagcttacctgttgttggtgtataggaatgctggcaatttttgcacattgattttgtatccccagagtttgctgaagttgtttatgagcttaagaagcttttggtctgagacagtgagattttctagatataggatcatgtcatctgcaaacatggtaatttgacttcctctcttcctatctgaatatgctttatttctttttcttgcttgattgccctggccggaatttccaataccatgttgaatagaagtggtgagagagggcatccttgtcttgattggttttcaaggggaatgcttccaggttttgttcatgcagtacaatattggctgtgggtttgtcatacatggctctcattattttgaagtatgttatttcaatacctagtttatgcagtgtttttaacatgaagagatgttgagttttatcaaaggccttttctgcatctattaagataatcatgtggtttttgtctttattctctttatgtgatgaatcacatttattgatttgtgtatgttgaacaaatcctgcatcccagaaatgaagccaacttgatagtggtggatgagattttgatgtgctgctggatccagtttgccagtattttattaaggatttttgttatcgatgttcaccaaagatactgacttgaagttttctttttctcttgtatctctgctatgttttgatatcaggatggttctggcctcaaagaatgagttagacaggagtctcttcttttcaactttttgtaatggtttccatagaaatgttaccagctcttctttgtagctctggaagaattcagctgtgaatccatctggtgttgggctttttcttggttggtaggctatttatcactgcctcaatttcagaactcactattggtctattcagggattccatttcttcctgtttcagtcttgggagggtgtatgtttccaggaatctaattatttcttctagaatttctagtttatggtcataaaggtgtttatagtattctctaatgattgtttatattttgtggggtcagtggtgatatccccttatttccgattgtgtgtatttgattcttctctattttcttctttattagtctaactagcagtctattttattaattttttcaaaacaatgtctcctggattcattcatttttttcaagagttattcatgtctctatctccttcaattatgctctgataaaagaaaatcaccaaataaacaaaacaaggcacaagagaccaatcccggaaaaacagagatatatgacctttcagacagaaaattcaaaatagctgagttgaggaaactcaaagaaattcaagagaacacaggaaaggaaatcagaattctatcagataaatttaacaaagagattataataatttaaaaaatcaagtagactttctagagttgaaacatgcaattgaaatgctgaggattgcatcacactttcctaatatcagaattgatcaagcagaaggaaaaattagtgagcttgaagaaaagctacgtgaaaatatgcagttggatgatataaaaaaattaataaaaaacaataaagcatacctccaagatctataaaatagtctcaaacgggcaaatctaagagttattggccatacagaggaggtagagtaagagataagggtagacagtttaataaaagtgataatgtcagagaactttccaaatctagaggagataacaacattcaattacaagaaggatacagaaatccaagcagatttactacaaacaagactacctcaagtcatttaataatcaaattcccaaatgtcaaggatcaagaaagaaccctaaaagcagcaagagaaaaaaaacaaataacatagaatggagctcaagtatgtctgacagcagaattttcagtgcaaaccttacaggccatgaaagagtagcatgacatattattattttattttattttatttcaatagttttggagaaacaggtggttttcagttgcacaaagaagttatttagcagtaatttctgagattttggtgtacccgtcacctgagcagtatacactgtacccaatagtattttatccctctctcctctcctaccatctctccaagtcccaagagtccattacatgattcttatccctttgtgtcctcatagcttagcttccacttataagtgagaacgtagacatttggtttccattcctcagttacttcacctagaataatgatcaccaactccatccaggttgctgtgaatgccattatttcatttcttttcattgctgagtagtattccatggtgtacgtataccacattttgattatccactcattggttgatggacattaaagctgataccatatttttggaattgtgaattgcgctgctataacatgtgtgtgcaaatgtctttttcacataacaacttatttcctctgggtagatacccagtagtgggattactggataaaatggtagttctacttttagttctctaaggaatctccatactactttccatagtgtttgtactagtttacattcccaacagcagtgtaaaagtgtttccttttcaccacatccatgctaacatctacttttaaatttttaaattatggccattcttgcaggagtaaggtggaatctcattgtaattttaatctacatttccctgacaattagcaatgttgatcttttttttcatacgtttgttggctatttgtagatcttcttttgagagttgtctattcatgtcctttggtcactttttgatgggattacatggggttgttttcttactgatttgtttgagttacctgtagattcttgatattggtcctttgttgaatgcatagttttcaaatattttctcttttctcccactctgtgggatgtacatttactctgctgattatttcttttgctgtgtataaatttttagtttaattgggttcatctatttattttgttttgttgcatttactttttctttcttttcttttctttttttttttttttgagatggagtctcactctgtcgcccaggcagggagtgcagtggggcgatctgccctcactgcaacctctgcctcccaggttcaagtgattctcctgcctcaggctcccaagtagctgggactacaggcacgtgccaccatgcctagctaatttttgtatttttagtagagatggggattcaccatgttggccaggctggtcttgaaatcctgacctcgtgatccgccaacttggcctcccaaagtgctgggattatatgtgtgattatatgcctggcctgcattagcttttgagtccttggtcatcaactcttggcctaagccaatgctgagaagtgtttctttgatgttatcttctagaatttttatggtttcaggtctcagatttaagtatttgatccatcttgactttatttttgtataaggtaagagatgaagatccagtttcactcttctacatatgacttgccaattattctggcatcatttgttgagcagggttccttctttctccattctacgttcttgtttgcattgtcaaagatcagttgcctgaaagaatttggctttatttctgagttctctattctgttccattggtctacgtgccaatttgtacaccagtagcatgctgtcttgttaaccatagccttgtagtataatttaaagttcggtaatgtgatgcctccaaattagttcctttttcttagccttgttttggctatgcaggctctttttttgttccatatgaattttagaattgtattttctagttctatgaagaatcatgatggtacttttatgggaattgcattaaatctgtagattgctttgagaagtatggtcattttcggaatattgattccactcatccatgagcatggaatatgtttccttttctttgtgtcatctatgattttattcagcagtgttttgtagtttaccttgtagaggtctttcacctccttggtcaggtatattcctaagttttattttattttattttattttattttattttattttattttattttattattttattttattgcaactgttgtaaaagggattgagttcttgatttgcttctcagcttggtcactgttgatgtagagccatgctactgatttgtgaacactgattttgtatactgaaatgttactgaattcatttatcagatccacatgctttttggatgagtcgttggggttttctagatacatgaccgtatcatcagcaaacagatagtttaacctcctttttatcaatttagatgcattttattactttctcttctctgatttctctggctaaaatttcaactactatgtggaatagaagtggtaaaagtgtgagtccttgtcttattccagttctcagggaaaatgctttcagcttttccccattcaacatgatgtttccttggggaaactctccaggatattggaatgggcagagatttcttgagtaataccctacaagcacagacaactaaaggaaaaatagacaaataggatcacatcaagttaaaaagcttctccacagcaaaggatacaatcaacaaagtgaagagacaaccctcagaatggcagaaaatatttacaaactatccatctgttaggggattaataaccagatacaggacctcaaacaactctataggaaaaatacaataatctgatttaaaaatgggcaaaaatttgaataggacatttctcagaagaagacaaacaaatgacaaatagacatatgaaaaaatgctcaatatcactgatcatcaaagaaatgaaaataaaaaactataatgagatatcatctcaacccaattaaaatggcttttatcctaaagatagccaataacgaatgctggcaatgatgcagagaaaagggagcctttggccactgttggtgggaatgtaaattagtacaaccactttggagaacagcttggaggttcctaaaaagtactaaaaatagagctaccacatgatccagcaatcccactgctaggtgtatacccatgtaaccaaaagaaaagaaatcagtatatcaaagagatatctgcactcctatgtttatggcagcactagtcacaatggccaaaatctggaagcaacttacgcgtccatcaggagacaaatggataaagaaaatgaaatgaagaaaaaaatgttaagggcagccagagagaaaggtcgggttacccacaaagagaagcccatcagactaacagctgctctctcggcagaaactctacaagccagaagagagtggggcccaatattcaacgttcttaaagagaagaattttcaacccagaatttcatatccagccaaactaagtttcataagtgaaggagaaataaaatcctttacagacaagcaaatgctgagagattttgtcaccaccaggcctgccctaaaagagctcctgaaggaagcactaaacatggaaaggaacaactggtaccagccactgcaaaaacatgccaaattgtaaagaccatcgaggctaggaagaaactgcatcaactaacgagcaaaataaccagctaacatcataatgacagaatcaaattcacacataacaatattaaccttaaatgtaaatgggctaaattacccaattaaaagacacagactggcaaattggataaagagtcaagacccatcagtgtgctgtattcaggaaacccatctcacctttattttgagcctatgtgtgtgtgcagagacacacataggctcaaaataaagggatggaggaagatctaccaagcaaatgaaaaacaaaaaaaggcagaggttgcaatcctagtctatgataaaacagactttaaaccaacaaagatcaaaagagacaaagaaggccattacataatggtaaacggatcaattcaacaagaagaactaactatcttaaatatatatgcacccaatacaagagcacccagattcataaagcaagtccttagagacctgcaaagagacttagactcccacacattaataataggagactttaacaccccatggtcaacattagacagatcgatgagacagagagttaataaggatatccaggaattgaattcagctctgcaccaagcagacctaatagacatctgcagaacggtccaccccaaatcaaaagaatatacattcttctcagcaccacaccacacctattccaaaattcaccacggagttggaagtaaagcactcctcagcaaatgtaaaagtacagaaattataacaaactgtctctccgaccacagtgcaatcaaattagaactcaggattaagaaactcactcaaaaccactcaactacatggaaactgaacaacctgctcctgaatgactaccgcatacgtaacgaaatggaggcagaaataaagacgttctttgaaactaacaagaacaaagacacaacataccagaatctctgggacacattcaaagcagtgtgtagagggaaatttatagcactaaatgcccacaacagaaagcaggaaagatctaaaattgacaccctaacatcacaattaaaagaactagagaagcaagaggaaacacattcaaaagctagcagaaggcaagaaataactaagatcagagcagaactgaaggagatagagacacaaaaaacccttaaaaaaatcaatgaatccaggagccagttttttgaaaagatcaatgaaattgatagaccgctagcaagactaataaagaagaaaagagagaagaatcaaacacatgtaataaaacatgatgaaggggatatcaccaccgatcccacagaaatacaaactaccatcagagaatactataaacacctctacgcaaataagctagaaaatctagaagaaatggataaattccttgacacatacaccctcccaagactaagccaggaagaagttgaatctctgaatagaccaataacaggctctgaaattgatgcaataattaatagcttaccaaccaaaaaaaagtccaggaccagatggattcatagccgaattctaccagaggtacaaggaggagctggtaccattccttctgaaattattccagtcaatagaataagagggaatcctccctaactcattttatgaggccagcatcatcccgacaccaaagcctggcagagacacaacaaaaaaagagaattttagaccaatatccctgataaacattgacacaaaaatcctcaataaaatactggtaaaccaaatccagcagcacatcaaaaagcttatccaccatggttaagtgggcttcatccctgggatgcaaggctggttcaacatacacaaatcaataaacgtgatccagcatatataaacagaaccaaagacaaaaaacacatgattatctcaatagatgcagaaaaggcctttgacaaaattcagcccttcatgctaaaaactctcaataaattaggtattgatgggatgtatctaaaaataataagagctatttatgacaaacccacagcccatattatactccatggacaaaaactggaagcattccctttgaaaactggcacaagacagggatgccctctctcaccactcctattcaacatagtgttggaagttctggccagggcaatcaggcaggagaaagaaataaagggtattcaattaggaaaagaggaagtcaaattgtccctgtttgcagatgacattattgtatatctagaaaaccccattgactcagcccaaaatctacttaagctgataagcaacttcagcaaagtctcaggatacaaaatcaatgtgcaaaaatcacaagcattcttagacaccaataacagacagccaaatcatgagtgaactcccattcacaattacttcaaagagaataaaatacctaggaatccaacttacaagggacgtgaaggatctcttcaaggagaactacaaaccactgctcagtgaaataaaagaggacacaaacaaatgggagaacattacatgctcatggataggaagaatcaatatcgtgaaaatggccatactgcccaaggtaatttatacattcaatgccatccccatcaagctaccaatgactttcttcacagaattggaaaaaaacaactttaaagtttatatggaatcaaaaaagagcccgcattgccaagtcaatcctaagccaaaagaacaaagctggaggcatcacactacctgacttcaaactatactacaaggctgcagtaaccaaaacagcatgctactggtaccaaaacatagatatagaccaatggaacagaacagagccctcagaagtaataccacacatctacaactatctgatctttgacaaacctgacacaaacaagaaatagggaaaggattccctattcaacaaatggtgctgggaaaactggctagccatatgtagaaagctgaaactggatcccttccttacaccttatacaaaaattcattcaagatggattaaagacttaaatattatacctaaaaccataaaaaccctagaagaaaacctaggcaataccattcaggacatagacatgggcaaggacttcatgtctaaaacaccaaaagcaatggcaacaaaagccaaaattgacaaatgggatctcattaaactaaagagcttctgcacagcaaaagaaactatcatcagagtgaacaggcaacctacagaatgggagaaaatttttgcaatctactcatctgacaaagggctaatatccagaatctacaaagaactcaaacaaatttacaagaaaaaaacaaacaaccccatcaaaaagtggacaaaggatatgaaaagacacttctcaaaagaagacatttatgcagccaaaagacacatgaaaaaatgctcatcatcactggccatcagagaaatgcaaatcaataccacaatatcatctcacaccagttagaatggtgagcattaaaaagtcaggaaacaacaggtgctggagaggatgtggaaaaataggaacacttttacactgttggtgggactgtaaactagttgaaccattgtggaagacagtgtggcaattccttaggtatctagaactagaaataccatttgacccagccatcccattactgggtgtatacccaggacaaaaaaccaaacaccacatattctcactcataggtgggaattgaacaatgagaacacttggactcaggaaggggaacatgacacatcggggcctgttgtggggtagggtgagggggaagggatagtattaagagatatacctaatgtaaatgaggagttaatggtgcagcacaccaacatggcagatgtatacatatgtaacaaacctgcacattgtgcacatgtaccctagaccttaaagtataataaaaatatatatatatttaaaaaagaaaatgtggtacatatatagaatggaatactaggtagccataaaaaagtgtgattctgtcatttgaaacaacatggatggaactggaggtcattgttaaatgatagaagccaggcacagaaagacaaatattgcatgttctcccttatttgtgggagctaaaaattaaaacagttgaactcatggagatttcaagtaaaacaatggttaccagaggccaagaagggtagttctgagtggagggaagggggaatggttagtggtaaaaatatggttagatagaatgaataagatctataatagtatttgatagtacaacagggtaactacagtcaacaataatgtattgtacattttaatataactaaaagagtataattgaattgtccataacaaaaaaggataaatgcttgatgtgataaatacctcacttactaggatttgattattatgcactgtatgcctgtatcaaagtatctcatataccccataaatacacacacatactacgtacccacaaaaactaaaaaatgttttaaaagaaaatcatttatccttacatatttctcttcctctctaggtttgatatccttcttaatgaagtatattatttagtagttctttcagaaagggtctattagggtaaattctttttgaaaaaaatctgttttcttggcactctgagggtattatctcattgtcttctggcttgtttttggtactgcaaattgtgatgttgagctaattatccctttttggtatgtgtgatacagaatatagatgggatcataaacttttttttcaactttcttctgctctgtcctgctgtattttggagactataaagctgaaaactgtatttcctggaaactttcacagctagtgatctcaataagattttttggtattcaaatgcatttgtgtaagcttgaatttggaactgagttatgtgaaagaggaggcagggtatcagaatttctttgctggggagaatagattaaaggcagtgtggcccaaactgacagttgcagcaaggtaaaaaaaacttgggcatttggcttcctgatcaagcagcagtagctaggtctgggggccagcagctatactggcaacctctcagttaaacaagtaaataattaattgtgcaggagcagcaagcagttcccatgctagcccagatctgaggagtagctttgggtgcattcctgaaagtgcagcctagaatctgtttattgatccatttagtactgacacaagcctgtaatatgctgtaataaactttctgtttaagccttttagattatattattttctcctcaactgttgataatcttttatctttggctgcttttttatagataatctccttttcctttggtattttgctgtctcattatgctgcatctagatgtgtattttttacttatctttgttggaactagattcagcaccactgaatctgagaagtcacattttcatttatattggaaaaatgtcagccatgacctcttcagatataatctctgccaaattttcaattaactccttgtgagattcttatcagatgcattctgtaaattctcatttttttctcctaatgtctccattacattttccaactgattatctctagtatattttaggaacttacttcaaatctatcttccagtatattaactttctccttgcctttttgttttacccattttagatgttataaagctacacataacagaagccttattacagtattgaccaaacaggaatttatttttatcacacaacatgacaacggaaagttggcagtccaggactgatgcagcagtcccatagtaatatcagttcccaagctcttctgttttctactctgccaaccttaacatgtggttgattctcatgattgccttatgatagcaaaatggatacttcattttattccttctgttgcctttcaggaaataagaataaagtaacaaagaggaaggaatcatggatagcaatttgaccaaaacattatcacatggatacactgctggaaggatgccaagcaatgcagtgtctgtttgtttaataattatattgccaacccaaacaaaattaggggttttattttttaaaagaaagagaaaatgggtattgtaaaagcaacttgaagtatctgccacacatattcattgaacttttttaaaaacattattactataacttccatatattttaattcttaaggtctacttgatttgtcttcaatttccctgttcgtttttcatagtgtcttgcttgcctcatatttcagttcttttatttatgcctttagccatttaaaaatatttgcatagtttttatctgattcttctatctatctctgctatttactgtaccatctgaatcaaattcatggtggattatttcctcattgatattataattttgatggtgagttcatctttggcggaggttcatctgtggaaatcttaggcatccaggcctgagatcatgtcttttcaggagacttgcgtatttttatcacaggaacttcctttcagggacaatttttatattaatttcttagcatacggattcccagacattagaggtagcataagttaagatcataagcctgtgtgaggcataggcccacggttataattctcagggaagttattttttaattcttggagctcagattccaaccaaaggctctcctgtcaaatttctgttttggctagtaaattttgccggtctgctttctcacatagagtgtactcctttacattttctgggtttgtgccgtctcatttacaactccccatctcagacagctccaagtctacatctttttttcctgcacagctgttagaatgtatatctgagatctgtaaatctcctactccctccaaacacaaagataaacacagtgtcaaaccatgtgtttaccaaaccaatttttaattgccttttttgttgcctgataaatattctcaatttcttttaaaaggtcatccttacattttttgttataatttatcaagcatttcaaagcttttgcagtaagagaaatttcgagttatcttatctcacattatgccagaaccagaagtcttttgatatagttttcaatgttaattagttttgtatcttgagcatgtgacttttctgaaaaatatggctatggtcaacagatgttaggaccagaaacaaagaaagtttgaagagctcataagttattttgctaaattgtttgttgatgagtttaacgtcaaaagtgttactaagtcctcaatactctcagttgatacacaaaacaccttaatattattttcaagaatttaataagtagtaaattagaatagaataatctatattcaattagtttataattttaaaactaaaattagctctaaaatgccctctaaaatgtcatctttatttattaatgaaaaaactaaaagttaaaggctctgttaacttacctaggtcagagcctaggtaagttacagagttctacagagcccaggtagactaactatttagcaatacaagaaggtaaatattttggtgcatttttaaacagataagcttttgacattttcagcatttaggtattttgatacatttagatttttaaaaaatatttatttagattaggagttgaatgcagttataggagataaatggaaaagacaacccttgattagcagggttcagcctttgtttttcatctagaatgatgcatctgtaaccttaaacttatataagtctactcagcagccaagctactatagtcaaccagaccctgccactttagaaagcagttctgtcattatctactactagtcaaacataacctttagaagtattgccctgccctccaaaaagaagctaatgaagtagtattcagtaatttcctgagagtatttcagataatataatttttaatttcttttcatatctagtcatggtttgagcctcaaatatttgtctacaagttgtaggtcatcttctcaccaataatatgacttgcttacatcactgtttggcagagtcaggacaagaacccgggtcttccacttgcaattcagtgctctgtaaattacatcttccttcatttaaaattctgctcaggtatttctttcaaccagcacacaattatttctccttatgtgctaatttatatttaacatcatcaaaataatctgatgtgtcctattcaaatatgataacttctgccctgtcctctcttaaaatcatgtcatatcctaagggattaaaattatttctcccagaaaacacaatatgtatgttcttgataatacattcatagctaaaggaatatctaagccaaaaggtatggacaggaaaaagaaagctcctgcctacacattttcacgaaaatgtgatataacaaaatattatgacagaatagaaactacatatattactcacagaaataaatgtgaataaacttaactcacttgttaaaataaaataattttcatataggtaacaaaataataaaatacatacaattatatgaacaaaactacatatatgaaacaaagggatttcaaaagtctgggaaaaataaaagggtaagcaaagatgaagcatgtataccaggcaaatgtaatcaacattataataaaaagtctgtgatcataatattataaaaattacaattcaatccaaaaagtattaattgtaatgaagaacattttctgggctaaaaggcaatctactatgaagatataaaactatgacttcatgtattaaataatgtatcattgacaattataaaacaaaaattgcaggagacttgagaataataggtagaagcatactagtaggagtcattaaactcaaatattcagttcaagacagttccaatggtcccaaaataaacagagatgtagaaataaacaatacaccaataacgtaaatcttaaggatatatgttgaactttacagcctgatactctaaaatacaacttctcaaacacatataaaaaattcacccccaaaaaatcatacattttatgtcacaaagaatgtgcctacagtaaggtacataaaatagaaatattaatgacacttcctgatcataatgaaataaaacaagaaattttaaaatagaaaaaaatagccataaagacctttccatccaaaatttaaagaacgtaatactaaatagctcgagtgaaaatgaaaatacaaattcaaattatagaatttctgaaaacaataatgataatgaaaacactaccttataatgtatggaatataaaaagtggtgattaaagtcttaaaaactcaattaaaggaaataataaaaataaattaaattctcatataaaagatgtaggaaaataacaatcacataaagcaaaagaaagcaaagaaaggaaataaagaaaaagggcaggaattttgaaggtagagaattttttaaataataaatctaattttaaaagatcaaaatcctggttctttgaaagaattaacaaaataatcacaccagtagctaatctaatttttttttaaaaagggggggaatcataattttttaaaagtaaggattgacagttgaaaacagggaaataattattgaatcagaagaaatgaaaaaagtcatactagtctacttttcagaccttgatttaaataaatttgaaaacttagataacatgaataatttctttagaaaatacagtttactaacatcagttttgttagaaacacaaagctaaaaaatgtcaaattttgtagaaaaagaaaaaacagttacaaagaaagcatcagacccagatttcactggggaattctaactacgaagttgttattactgttaaacctagtctcaaagctacataaattgttctaaggcatagaaaatgaagaacaaacttccaaattattttcataaaggaaatataatattgattcttaaatcttataaatgtgatatgaaaaagaaaattatagaccaatcacacttatgaaaatgatgcaaaaatactaaataaaataattgtgaacagaattcaatacaacattaagaaaataataaaccatgaacaaatggggcttattctaagaatgtaatgcttatttaagattatgaaattgatcataatacaccatgttaatatctctaaaaagaacagtcatatgatcatctcataaatgttagaaagacctttaacaaaggttaatacctactcacaattttaacaaaagcattcaataaaatgagaataataaaatactttattgataaaaatatatatgcttagttacaaagttactgatttcactcaatcaggaagtgctaggggtatttcactaacatcaggaagaaaaaaggtaagtgttacctccaataatatttaatattgtactgaaagtattagcctgtgcaggaaaacaaaagacatcactaaaggcttaaacatttttaaagaagtaacactgtatctatttgcaaattatataatagcacatctggaaaatcctaaagactcagtgataataaaataatttagtaaggtagaaggatacaaaattaacacacagaaacaaatatccttcacatacacaaacaattattaattagaagacactctaagtagaaaacccctatgtataataacaacaaagaagatgaaaaaacacgtaagaataagtattcaaaaaaatctggaaaacacacacaaaaattaaaatatttctgaaatatgcaaaattagatttcaaaatatggaaagatatctttaatctgtataaaatgaatgggcatcataaacatgacagatcataggttaattaataaatttaataaaaacaatcatttttatgaatctacacattttgactcacagattcctgtttttttctatattataacttattacaattattacttaattttgatgctcaaattaccccagatatagtcagttgggggcaccttcaagctaattcttgtgtccttttgtcatattctaattattttctcatgtgtgctaatttttaacatagccagatattcctgtccctgcgatgaaagcagtaatttctctaaggatctctggaaacttttaagttatgaatagatttcagaactccaagtctaagaactaggtatgttcattgctactgggaccctttcagcacacagagctaggaaaaaataatacacatatacgtatgtacacacctattacctatatctatatcctcacgtacccacacatacaaccaaattatatctccaatttcaatttaattctagttttctttctttctctctccctcccttccttccttctttccttttttccttcctcctttccttcccttctttctcctttccacatttataactcctttctctaataataagaaacagtttccattattttcaaaatatttactctttcatttattcctagatcacagagaaagtagcttaaaattgttaacctaaaccactgtgaaaaccagacctcctaaatacagtgcaacatttgtttatagttcttttttattttagtctgaaaacacagtgttcaaaagttttagattattactaataacattttaactgtagaaaaattacactacaataacaaaaagcactattgaacatgaaagctttctctcatatgtatcttctcttttaatatgtaatgttgtacaatcctaaaaaatatcatatcatatagaagaaacaacatgtcaatgtgtcatgccttttctttcatttcaaactactcaaaagtatcctagtactaagatcctcatatccttagatccaattgattttcccagagacagaaacagaaacaaaaacaaaatcattctactccagtgcccttaccatgtttgaattgaagatattttcatctcttgcaaaattaaaattctaattagtaacttaacacattaattatattaaatacatggagctattcagtcaataaatagccttgggctttaataagttcacagcacctttttattttttattttttgaaagtttctattactgaagctggccaagaaaattgtatttttgaaaaaaagtcaaagtattttctttatattttttctctaattatgtaattaaaataaaacaatggataagtagaatggacataatgaaagagaagcttaaaacattaatatagcctcttttgcagtgaagaattttccatcagaaacaaaatagtaaaggcagatatcaaaagtaaattttatcaatcaaaataaagggttaattttaaagctttgaccaactgaaatgaaaattagttatttaaaactccactggaaacttagggaatccattatttcctggggttgactattcatgttcattatcatttcaataacttatttttgcttgtcattgctgtggttttctctgtgtttttataacatacatcaatttctcttatctcccaagtaattttttttgcaactttgctcatgtataattgacatacagtaaacttcacatatttacagtatacaattaagttttgacatatgtcacatgcatgaaacaatcacaacaatcaaacaataaaaattttcaccccttttaataaaagtttccttatgttcctttgtaatccatcccaccttccatagacatccacgtggaaacagtgatctgctttctagggctatatataagtttgcattttctagagttttataaaaacagattcaaatatttcatagtattttgtttctggtttccttcactcagcattatgatgctgaaattcactcatgttcttgatgttcttgtatatatgtatatcctatggactcaatgtgcccccccaaaatttgtacattaaagccctaatcccaaatgtcacagtatttcgaaatggggcctttaaaaggtaattatgtcatgagggtggagcccatatgttgtgactagtgatcatttaaaaaaaagagacatgagaaaagttatgactctctccgccatatgaggatacagcaagaaaactccttgaccttgaacttcccagcctccagcaatgtgagaaataaatgcctgtcatttaagccacccaattgaaggtaatttgttatagcagcctaaaataagacattatatttcatttattttatttgctgattagtattccatcatatggatatgctagtctgttgatcattcactagttaatgaacatttagattgtttccagtttttggttaataataatggctttggttaataagactgccataaacgttcacctagatgttttgtggatatttgctttcatttcccttgaataaacatttaggagtagaatatctgggtctttggtaggcgaaattttaactattggacttttgaataaaactgcctgtttttccatagcggctatacataattgtctctttatatacttacgtatattgcaactacatacatcattttatatattttttaaaggccaaagacctctgaaatgctgggctaagaaaaaaaaagatcagagcctaatgactcgtaaggaaaaaaaacacactgggaattcatcatgacattaaattataggtagaatatacatataaatgaaaaaggaaattatttcaaataataattttaaaaaacaagttattttccacagaattttttaagacattaattccacttttggatgaaattcttccagaggaaaaattatagttatccttatatccccagtgctaacacagtgattagaacatagcaaggtcataacagtgttttttagaattataaatttagatgagctagtataagacacaattggacaaaaattataattagtatgcaaatattaagaacttataaaacaaaatgttttatgccacagttgggctctaatatataatttttcttattgctattttccaacattatcttcagatcaagattgatttgtctttctttcatttcacaatcataaatatacaacaaaatgttattaaagtgtttgtgatgggacatattagaaagagagttaccactgaaaaaaatataaaaccaacaacaggcactttgagaaacaaccttatatgcaaaataaagggaaaaatttcaggaaaatgaaagtaaaaagttgacttcattaaaaattcagccagtacacagttcgtctactgtatgaactgtggcaagacatcagaataattatgatcccatgaatgcaatctaatctcaagcgaatgctaaaaagtctgtcttccaattaggacattagtggaacttgcctaattaaatcaattgaatatcagtagaagaaaatccccttaagtatgcactatgagactcatatgaagaaacagatgtaatcgtgtatttacaatgcacattagaaaattgttggcaaatgtttaatatacgattttttatatagcaaatcaaaggtctagaaaaggtcttaaaccctagtggaaatgctcaaatgtgcaaattcagattttaaaagtctactttgttaatgcttcttttataattaagcaatgatgtcttaaaagcatatttatagaattggatgtgggaccataaaaaggagtcaattaattttctaaatataaatgccatattagaaggtaattataaagtcctcagagatatttatcattaaattacatgctgcttcctttgttttctagagtttagggaactgctttattttctttgaatatcttttccatactaatcatcacatacataaaaagctaaggatattctactctatgtaagttttaaaacattttttaaaaagtttttttaattatttaaaagaagatgaaacaatagaatgcataaatatcattttttcttggtatttctacataaacagtatttcattaaaggttgcattttatatcgatgagaattttgaatatatttattttctgcaaagagactctatgttttcttagcctggaaataagcaagagagaatagaaaaaatttggaccatgtcatagcagaattttaaaatataggtaagatcttccataaaagatattgtccattttcaatttatttttatttattttagttgacaaataataattatgtatatttatggggtacaatgtgatgttttgatctatgtatacattgtagaaacattgataaaactaattaacaaatccatcaccttaacaatttatcatgtttttgtggtaataacatttaaaatctattattttagcaattttgaaatatacatttacaattatggtcaccatgcagttcctccagtctaactgaaactttgtaccctttaatcaacatcttcccttttctcaaccctctcccttttcccctagcttctggtaaccacctctttactcatttctatgaaattcattacaaggaactcaaacaactcaatagcaagaaaacaaatcacctggtaaaatatgggcaaaggacatgaacacacatttctcaaaagaagacacataaataatgtattagttcactttcacactgctgataaagacatacctgagactgggtaatttataaagaaaaagaagtttaacggactcacagttccacgtggctggggatgccttatcattatggtgaaaggcaaaggcatgtcttacatggtggcagacaagagaaaatgaggatgaagtgaaaggggcttcccattataaaaccatcagatctcaagagacttattcactaccatgagaacagtgtggggaaactgcccccatgattcaactgtcttccactgggtccctcccacaacatgggggaattacgggagctacaattcaagatgggatttgtgtggggacacagccaaactatatcattccacccctggcccctcccaatctcatgtcttcacatctcaaaaccaatcatgccttcccaacggtccccaaaagtcttaactcatttcagcattaactcaaaagtccacagtccaaagtctcatctgagacaaggcgatcccttccacctacgagcctgtaaaattaaaagcaagttagttacttcctagataaaatagaggtacaggcattgggtaaatacagccattccaaatgggaaaaattggccaaaacaaagaggctgcaggccccatgcaagtctgaaattcagcagggcagttaaatattaaagctccaaaatgatctcctttgactccatgtttcacatccaggtcacactgatgcaagaggtgggtccccatggtcttgggcaactccaaccctgtggctttgcagggtacagcctccctcccaggtgctttcactgctggcattgtctccagcttttccaggtgcacagtgcaagctgtaggaggatctaccattctgaggtctggagtacaatggatctcttttcacagctccacaagacagtgtcccaataggaactgtgtgcggggactcacaccccacatttcccttctgcactgccctagcagaggttctccatgagggccccacccctgcagcaaactcttgcctggacattcaggaatttctatacatcctcttaaatctaggcagaggttcctaaaccttaattcttgccccttttgtgcaacccataggctcaacatcacatggaagctgccaaggcttggagcatgcaccctgtgaagccacagcccaagctgtaccttgctccattttagccatggctacagcagctgggacacagggcaccaagtccctaggcacacagagcaggaggtccctgggtcaggcccatgaaaccattatttcctcctggcctctgggtctgtgatgggaggggctgctctgaagacctctgacatgccctgaagacattttccccattatcctgcattgtctgggggattaacatttggctccttattacttatgcaaatttctacagccaactcaaatttctcctcagaaaatgggtttttcttttctattgcttcctcaggctgcaaattttctaagcttttatgctctgtttcccttttaaaactgaatccttttaaaagtaccaaagtcaccccttgaatgctttgctgcttagaaatttcttctgccagataccgtaaatcatctccctcaagttcaaagttccataaatctctaggcatgggcaaaatgctgccagtctccttgctaaaacatagcaagagtcacctttactccagttcccaacaagttcctcatctccatctgagaccttttcagcctgcatttcattgtgcatatcattatcagaattttggccaaagccattcaacaagtctctaggaagttccaaactttcccaaattttcctgtctacttctgaggctttcaaactcttccaacctctgcctgttacccagttccaaagttgcttccacattttcaggtatctttatagcagtgccccactctactggtaacaatttactgtattagtccatttttgctgctgataaagacatacctgagaccgggtaatttataaagaaaaagaggtttaatggactcatagttccacatggctgggggaggcctcacaatcatgctggaaggcaaaaggcatgtcttacatggcagcagacaagagagaatgagaatgaagcaaaagtggtttccccttataaagccatcagatctcatgagacttattcttataccatgagaacagtatgggggaaactgcccccatgattcaattgtctcttaccaggtcccccctgcaacacatgggaattatgggagctacaattcaagataagatttggttgtggacacagccaaacacatcacagccaatagatacatataaacattctcaacatctctaatcaccaggaaaatgcatattaaaacacaatagggtatcatctcacacctgttagaatggtaatcaaatgaaagacaaatgatatcaaggtgaggaaaagggaacccctgtatactattggtaggaatataaattagtacagccattatgaaaaaataatgttgaggttcctcaaaacactaaaaatagagttaccatattatccagcaatcccatttctgagtatatatctaaaggaactgaaatggttatgttgaagaaatatctgcatgcccatgctttttgcagcattattcacaatagctaaattatggacccaacctacgtctccatcagtgaacaaatggataaggaaaatgggatacatatgcagaatacaataccgtacagccttctaaaagaaggaaattctgtcattcattataacacagatggaactggaagatattatgctaagtgagataagccagaaacagaaagacaaataatgtatgatctcacttacatgtgaaatataaaaaagatcctttacattttgtttcaatgggatcaggttcatttgaagcttctcattttgcatgcatagatatttaaataataacaataaaaaagcagagcaagcaaaatagcaactggcaaagacagagcaagtatgcccaaatagaaagtcgtacagaatgaaagaagattgtcttcacacatcacaaaaaatggcaagatctatttcatttagaagcagcagagtatagaaaataaacccttgagaagggtatcagaattcctgatttctagttcagagtcccttacaatataactggaacactagggaagtccgcaaattagataatcctacattaaaaatgatcttggtggttaagaaaatatgtcttttaagaattgatcatatatgaggtagataaagacttgacattactagaagtcatttctaagaaatacaaattacccacttcagctaaagaacactttttttcctgagcatttttgcatttttgcatgctggtaagaggagccttcaaggagaaagggaatatactcaaattgaagagcaggattgaatatatcacacacttaggagtaactgagctatacatccaccaagacttccaataccagttcagaaggatgctggcatttttgttaacataattttaatatttgagagcttcaaatattctttgttattgctgctattctcaaactgttctcctataaaaattactcttaatgaggaaaggatttatttaccaattttgaagaaataaaaagagcaaaactgagaagataacaggtgatctcagtcacaaagaaggcccaggaaataaaggaagtgggcatacatgtaaagaaaaaaaaaaatgggatctagtcccctggatctggtaaaaactagtaaagagtgcaaagtgaataaaataaagtctgagaagaggccactaagtcttaaaaattaaaagacaaaacaaaaagctccttctctaacagagctcatctaagccaaccctctcattttttacaagaaatccttttccaatattttccataagtcacttaaccttttcaccccttaattttctcatctctaaaaggtaaaaatgttactttaaaagttccctaaggtctattccatctctaaaatgctgttattttagtagttattcttcccttaaatactcattaatatgaccttgcaaaagcattttctatacttttggctaatattctttaaggaagtaaccaaactcataaatgggcaagtaagaaaatatctcagggtttaaaacattcctatagtcataaataaaatgacttagatgattctttgggaaatgacataaataatattctgcctcatttaccatgagaaaataacattcagaaacaaattgtatggtttaaaagactggctttatcagagaagatttagactaaaatatttcctacttaagtgcactttaaaatgctacatcataaaaactcctcagactttcatacttttcccatttctctagtttcagccatcattgtccaacataaagattattgaaacaatatcctaatagtactccatcacaatctccaaatctgttcacccttggttagtcagacttaatgtttttaatttcaaaactgattttcagcatctatttagggtattgaaagctggaatgagtgtcactaccatcctaacaacaaaatctaattgacttttctttttctcaaacctataaaagagcaataaattagcctgaaatttaatgaaaggcaggtgcccccctccccacacacacacaaaaaaaataccatgtcacaagcacctgtttatctggagtgcagtacaggaggatgatgagaaacaccacataagctggtatgagaaattttcagtgggttgcttaagattaagtgtgggctagctagtgtaagaatatggaatgccggggaactgaagatacaaagagaattagcactacactatggactgtatgttcacaaggaatattaagggacagggtagaaaactagagaaagcatttcttactgtgtagaccttggggaggaaaatagctgccactgtgaaacaagcacaaactccacccaggtcattctcccatgtgatataaaagactcaacctacaggaagaaaggcagtaaaccatgttgcctcaagggcacaggtgcagatccctggagaaagaaaactttcctctgagggaggactgggaaatgatagcatttttgtagaagttcaaaacaactgtgaaagatccagccagatacccaaggtcatggatctgactaaagctatggctaagctaggacaatgtagactacctacccaatgcccctcataccactagcaagacctaagcaagaagtaatatgaggcataaactgagggtggaaaagaaatattgaagaaaaaccttctggcaatgaacagccacccaaaacataaggtaatgatgaaaaaacatgaaactagcaatgcactgaggtaaattccagcaacaacaagccaagcctccaaaccaactcaaatcctgaacaagactgacacaaccctccatgttaagccctatcagaagaaaaggtaaggcaaaggtatgcaaatcaaagcataattattgtgtactttattctctactctgctacacaacatgtctagttttcaaccaaaatttacaaaacataaataaattttgtaaagaatctacacatacataccacatacacacacacacacacacacacacacacaagtacacacaaaattatcaagagagaaagcaagccagtcatggtggctcacgctgtaatccccacactttgggaggctaaggtgggaggatcgcttgagcccaggagtttgagactagcatgggcaacatagggagaccttgtctctacagaaatatatatatatacacatatatacatatatgtatataaatatacatatacacacatacatatatgtatatatttttttaattaactggccttgttggtgtgctcctgtagtcccagctactcgagaagctgaagtgggaggattgcttgagcctgagagatcaaggctgcaatgagcagtgattgtggcagtacactccagcctaagtgacagagcaagaccttgtctaaaatttttaagaaaaaaaaaatagagagagagagaaagcattcagatacagttatgacccagatgttgaaactttcagacagggaatttaaaataactataaccaatgataaagcctttagtggaaaaggtgactaacatgaatggacagatgaagaattttagcagcaacatgaaattataaacaaaacaagtgttagaaatgaaaaaaacagaaacagagataaagaatgcaccctattaattcatcattagactcgacagagccaaggaaagaatcactgcattaaagatggatcaataaaaattattccaagtcaattacaagaagaagaaaaaaagttttagacagaatccaagagctggacaatagtcaatgttctaatactcatgtaattgaaatcctcttagaaaggggaagagagagaaagaaggcttctcgtcatatttcagaagaaatagttaagagagaataaccaagaattttcaaaaagtaatgatcaaagaacctcagagaacaccatgcaggataaataggaaaaggaaggaagaaaggaaggcagataggaacagaggatgtggtggctgagaggcaaagatggggaagaagtttttgcgggggtggggagaagtgctctgcacactcatgggcaactgcaaggagtccacaatacgttctggagactgaatcagtccaggcccaataaactcattcaaaacaaaccaaactattatgggaagagaggggggaaaggaagggagaattgctttgcacattcacgggtaattgcaaggagtacacaataagttataagcaactgaatcagacagggtccaataaactcttcaaaacaaacaaactattatgagctgaaacgtgtcttcccaaaatttttacaatgaacttaaccctaaccctcagtacctcaaaatgtgactatatttgcagatcaggcatttaaaatggtaattaagttaaaatggtgttgtaaaggaaggccctaatccaatataagttcaaattgagattctttttataaaaagagaaaaaggacacagataacaatttacagaaaaaccatgtgaagacaccagaaaaagatgaccattgaaagccaagaagagaggtcttagaagaaaccaatcatgaccacacttcgctcttgcacttctagcctccagaattgtgagaaaataaatttattttgtttataccatctactctgtggtatttgttcaagcagcactagcaaactaatacacaaacaaagcttcattttaggacatagctctacattgggtaaagaaaaaaagaagcaaagaaaaagtaagggccaaaaaaagaggggtctagaaaaaagaagggttatagagctaagaaattatagaaaagacaagggaagagttttaaacacttctaaaaaacaaccagaggaggaaccttagtgttataaattagaaaagctcttctgacctaccttttccttctcacggttcaaatttggtatcataatgaccaaaaaaaaccagactgttacagaaacctacacaaagatattatgaaacaaaagaaaacaagatgcagaaaagcatccctacagacaaagatagccttctaggaaagacataattataaaaacaatttaaaactgtacctcagtatatgtctgggtttgattaaaaaaatagctactaaaggtactacagaaacgtaacgcttaacatagaaattagagcttatatcaatgtgggaaagtctagacagtgtacatttagaagactccagtcagtgaactggagaaatagtaactaacaacttcagcctgaaaccctggagttggtgaagataccagaactcagaacagtgagaacaagaatttaaaagtgagagactgttgggtccagctgccacaaccataaaatagtatgtgaaaagatctctaatgccactgcaactgggcatcatgacatccccagaataacaaattctattttacttccactttctaaatatcacgtgttaccatagtcaaactcttacctaaagacaaagagaaaatagaattgtgaaaaatgtattttccaacctagtagaaaatattggtgatattcaattgaccacattaaatccaggatacctagtgtttcaaagcaagctaaagatgaagaaaatagcataatatataaatgaacaatataccattggccactgaataacatgcgtttgaactgcacaggttcatatatacacagatttttttcaaccaaacacaaattgaaaatactattcatggatgtgaattccacaaatacaatgggccagcatttgtaaacatagtttctggaaggtcagttgtgggaattgtgtatccatggacgttggtatacgcaggaggccctggaaccaatcccccatgcatattgtggtacaactgtaaatcaaaattagcaaaactcacaaacaacttgagaaaactcaagaaaaatacaaagataaaaactatttaagaagagaagaataaacttaaagaaacacaaagataaataaaagtcataaaatgttctaagattaaagtgaggtcaatttttcacaattaaaaagaaatgaccaagtgttcaaggtgaaatgacaaaaatatgcaataggcaaagatcaaagtgtatgtataaaataaataatcaaagcagtggaatagaatacatactaatacttataattcaacaaaatcttcttgaggaaaaaaatttatagctacatatgtaaagagcatagtactcatctgggaaaatcttcctagagtggcaaaatcgaagtgtattctagtagaattactgaactttatagaaaaaaataatttaggcatcgaggcaaaaaagactaaatcaattaaaagggaaaaaataaaacatttatttgacttttcaacagtaatgctttatgccagtagaaaacagactaactaacatatttaagatagtcaagaaaagaaaacaggaaccaaagattttaaatgcagccaatattattttaaagtaaaaaggcaataaaatgtgttgtcaacatgcaaaatctaagggaacaaaattcctgtgagcactttcaaagaaatctactgaagaacaagcttcaaaaagccaaaatgaatggagatatatccacatatgactaaatggaaacctgtaaacgtatgtttctggaagaactcaaactaaagaataattttaaggaaaagactatgccttcttttttctactcttcacgtcaaactattaaacaagtactatcaatctgctttttaggtaattactttccttctctttcatatcaactaatttggttattgatatggtttggatctgtgtcactgcccaaatgtcatgtcaaattatagtccccagtattggacgtggggtctggtggaaggtgattgaatcatgtcagtggttgctcgtgaacgctttagcgccatcccctcagtgctgttctggtgatagtaagttataatgagataagattgtttaaaagtgtgcagcacctttctgttctctcccttgctcctgctacaccacataaggtaagccagctgctccccctttgccttccaccaggatcgtaagtttcctgaggcctccgcaggagcagaagtcactaggattcctgtacagcctgtggaactgtgagccaattaagcctcttttctttataaactactcagtttcaggtatttcttcatagcaatgcaagaacagaccaatacagaaaattggaaccagaagtggggtattaatataaagatacctgaaaatgtggaagcaactttggaactgggtaatgagcagaggttggaagagtgtgaagggctcacaaggagacaggaagatgagggaaattttagaaattactagagactggttcaatggttatgaccaaaatgctggtagtgaaatgaacagtgaaggtcaggttgacaagatctcagatggagatgaggaacttattgggaactggagtaacaatcactttcgttatgccttagaaaagaacttggtttcattgtgcctcttccctagggatctatagaagtttgaacacaacagtgatgatttagggtatctaacagaagaaatttctaagcaacaaagtattcaagatgtggcctgtctgcttctaaaaacctatactcatatacatgaggaaatcaatgacctaaagttggaacttatatttaaaggaaaagcagagcttaaaagttagaaaaatttgtagcctgctcatgtggtaagaaaagaaaagtttattttctggggaaaaaattaagcaggctgcagaatttgcataaccgaaaaggatccaagtactaatagtaaagacaatgaaaataagacttctaaggaatttcagagacatttggggcagcccatcccatcacaggaccagaagcctaggagaacagaatggttttgtgagccaggcccaagggcccactgccctgtgcagccttgggaaactgctccctgcatcccagccactccagcctcagtcatggctcaaaagtgttcaggtacagctcaggccactgcttcagaggatttaagtcataagccttagcagcttccacatggtattaagcctgtgggtgcacagagtgcaagagttgagtcatgggcacctccacctagatttcagagaatatatggaaaagccctggtgtccagtcagaagcctgctgcaggggcagagcctcaaagggaacccctactagggcagtgcagagggaaaaagtggggttggagaccccaaacacaggttccactggggcactgcttaggcgagctgtgataagagggccaccatcctccagaccccagaatggtagatccaccgacagcttgtaccctcagcctggaaaagctattggtactcaatgccagcccttgagagcagccatgggggctgagcccttcagagccaaaggggtggagctgcccaagaccttgggagcagaccccttgcaccagtgtgctctggaggtgagacatagagtcaagagagattatactggagctttaagattcagtgactgtcctgctgggtttcagatttgtacagggcctgtagcacctttcttttggctgatttctcccttttagaacaaaaggagatttagaacaaaattgtatcttggaagtaactagtttttgattttacaggctcacaggcagaacacactgccttgtctcatataagactttggactgtgtacttttgagtcaatgctgaaatgatttaagactttgggaaactgttaagaagagattattgtacattgcaatgtgagaagaacatgagacttgggaggggacagaggtggaataaaatgctttggatttttgtccctgcccaaatatcatgtcaaattgcaacccccagtgttgaaggtggggcctggtaggaggtgactggatcattgggacacatttcccattttggtactattctgatgataaagttctcacaagttacagttatttaaaagtgtatggcacctccctccactccttcctccttcttcagccatgtaagatgagcctgcttccccttcaccttcagccattgtaagtttcctgaggcctccacagaagctagcatcatgcttcctgtacagcctgcagaactgtgagcccattaatactgttttctttataaattatccagtgtcaggtatttctttatagcaatgccagaacaaactaatacacacctattatcaaaaaggcaaaagacactaagtgtttgcaagcatacagagaaaagggaaacctagcacactgttggtggggatgtaaattagtatagcaattatggaaaacagtaaagaggtttctcaaaaaattaaacctaacatatgacttatcagtcctactgctgtgtatatacccaaagggaagtaaatcagtatgttgatgagataactatattcccatgtttattgccacattattcacagtagtcaagatatggaataaacctaagtatctatcagcagatgaacagataaagaaagtgcggtatatatacataatggaaaactattcagccataaaaagtaaacccttctattcacagaaacatggatgaatctcaaagacattatgttacacaaaataagccaggcagagaaatacaaatactgcatgatctcactaatatgtggaattgaaaaaattgatttcatagaaatagagagtagaactgtgattactaatggctggtagtaagggaaaaagtttgggggaaagagagttttggggacgtgctggtcaaatgctgcaaaatttcattcagacagtaggaaaagtccaaaagatctattgtataacatggtgactatagttaatatattattcttgaaaaatcctaagagagtgacatacaatattttctcagtacgaaaatgataataatgtgaggtactacacattagttagctacaggataggagttttgttgttttattcttaaaagtagttcaagcaatgcttgccctccctcaaaaagagttggaagacaaaattttcagaaatctaattaatttgaaatacattagaagataaaaggaaaattaaagacataaggagctattaaaggcaatcagtttttccagattggtggcataattctcaaaagagtaatctttttctagctaacttttcttctaagcttctcaaaccaagaactagtcacagagttcctgtgagttaccatgataatcctgaatgtttcccacaaaataaagaaatgtggcaaaaatcaggtctaccaggattaccataacaagatcactaggagagagattgatgggtgaaggtatcttaaaagggcctgtaaaaatgttatcatatctaaaaactaaaaaacaaaatacagcattaccactcacaagacttgccaacaccaaatttaaaaaaattttttttaaattattttgtaaaagagtgaaaagcatgctagcaaaagaacaagtccttatgattcttttggaggacagaacttctaaatgttgcataaattttaaaaaattatttaattattatttaaaaatccaaatagaaatgataacattagcttaaaaggcaacccacatttaatacaaagttaataaaactgaagagaagttggtgacggggtacaaaaatgcagctagacagaaggaataatgtctaatattcaatactacagtaaggaattatagttaataatttattatatatttcaaaaaacagctaaaagaagagttggattgttccacaaacaaagaaaggtaaatgtctgaagtgatagctatcccagttaccctaattttatcattatacactatataaaggtatcaaaatagcacatatgcccccaaaatatgtgcaactactacatatcaatttttgagagtgaaaaaacttatgacaagatatgaaatatacatcagcacatgtacaaactatataaacaaattaatatataaaaacaaaataatcaaaattcacgtttttcatagaaataagtcagtacataatactgactcttgaaaaaaattaagaattagtattataggcatataatttagaaatatattggtaggagaactgaaaccaaaaagtgctagaaataattgtctctaaaaattgaaagtcaagggagaacagaacaggggttgcctgattttataaaaagcattgtacaactattagacatactaaattctgtgcacgcattactttgctagagtaacttttaataagcaaaacctacttaaatgtcaaaaaagttattacttaatctcactttgtgatcattaaaagtttatctgtataagaacataagttcttaaaaataagtaaataaataaattgacttttataaaagaaaaatgtgagaaactcaatcagctggaagctaaaaacacatgccaaattctcactgctataaaggttatgagagaactttgtgtaacagacattttgagaacagtaatatctctcacttttcatatattctcctgagtgcatgtttaagaaataaagctttatttaccaaagcaggtaactaaaaaaaaatgatatatctaaatagcaagaacaattgataaataaatagtatgttgttattttatgaaaattataaacgtattgctttttggggtctttttaaatttgcttaggtatttctttcagtcctatctgaaagccaaaaatatatcttgctcttattcattttcctacaagtagaaaaaaaatcttaaagaaaatatagaaaaataatgtaaaactttgcatgcactgcatttctagtcttgttttttgaagaagaggatgaattttctggattggaattacctaaatctctaaaggaagaataaatttaactataatacagcaatatttcatttgaatggaaagaacaataaatttaattacaaaagcagaaaaaatgcttaaactccatgaagtcagaaaccattatgtctacctttttcagtaaatcagccaatcccccattgctggctatctggtatgtagtagaggtttcctcatcctgaactacctttctattcccatggtaccccactccagtgctcctcactgccagaagtcatctgcataacttccactcaggtatctacttttctctaaaattttctctaccaacgtacttatcacaccctattataatctttgtgcaataaaatatagagatataatcatgggttttagaatcagacaaaagcaagttcaagctctgacttggtcatttactcagtgtaaaaatgtgggcaagttactcttagaacaataagtccatttttaagaagatgaaaaaatgaggccagataagtaaggtcaggagtccatactgacttgtccccttgtgtgaagccctgtgagctcctttcacatcacttgcactctcatgcatcagcacctaattcttttgcaagataagcagtcctacagaataacagtctattgccagatagttacaagttcctaataccctatatggcccaggaaagagaacaaaatgccttatttatgttatcacttccctaatctccagtcaatcagtaccaaagaccgcataagctatcagttacaaattcctgtcttggaggagctagggacttctcctaggtcccacatgcacagctaagcttaaggtttagcttatagtgaccttttcctcatttaatagtttaaaaaacaacctaggtggaaatttcatatgctaatgatacctgtgatgtgtgttagggcatgtagatgctgagcacatgcaccaaccacagggctgcctttgcatatttggtctcaccagtattttatgcatatgtatgtacagctcccataaagagaatccccctaaggcactagcagctgtcacctgctttgcatagcccactctgcctctcagagtgtactttcactctccaataaacttctttgcctacttctactttggactcactctcaaattcttttgtacagcaaaatcaagaaccagaaccaatccaaaaacaacagaaagagatgagtattcaacagagaattaaattaaaaagataactggtggaaagatcaaattattcatgtctgaaagtccacaaccttacccttctcctttgaccataacattcagataccacctgcttagcttcttccagttagggagggaaactaactacattcctcattaggttcctcatagcaggggtactgcatggcctatatcctaagtgctatacggagggtgttggtgaaagagagaattcttctgggagtaggaggatgagtgggattatataaagaattataatggactattcatttggaaccacaaaaaaaagatcccaaaaaaggatcaaaatgatatttttggactgaagcactttgactaaaacatgactcacactgaaacatttggtaatcaaatatagatttcattaaatatagaaatacaaaatacagtggcttaagtaaaatagaagtttatttctctttcgtttaaaataattccaggggtaggaaattcagggctgatataacactcctagaagttgtaagggatttaagctcttccaactcactgctttgcagtccctagatgaggcccttgtcctcattgtctaaacaatggaaaagaaaaatcatcccctcaattttcaagaaatttctcagagtaaaaaaacttactgctgtcaggaaaatgtaaggaaggagactattttactaaagagaaaatcagattcagagttaggaagtaaattaaattacctttcatcggccaaaacttagtctacaactacatgtagttacaaatggtacattattataacagaagattcagaggttctgccaataagaagaaaggaaagaatggatgttgagggagacaggtggcaatctctagacacctgtgttacatttgtctgagtcccctaaaatctattatttataaatttggaaagcaaagataatggaccctagtatcaggaacagaaagggtaaaagtcgatggggtatgaaacagaatgtaagagaggaaaattaaaatatgttttcttccgtgccaataacaacaaagtagctattcaattatatagagtataaaggtctatgtgtttagaaacaaaagtataagatactttgcagaaatctagatgtataaaagtttggccttatgtaactatgaaagatgaaccatattctagatttgtggtaggaatgaatccagttctaaatatgaattcacttttgaaatccatttttcacatgccttttttgtaatacaggtgactcatgaataactttaatatttatttatacatcaccttatatcaaatgaaatttaaggtgttaaattcctacattaaaatattacaattttcctcacaacattcatctacgaaaaaatacaatgtagtacaatttcccattgtaactactctgaatataggttattcaaacaaaagcaactgcttctgcctcctcgtttcaaaaatagaagaaaatttcctttctaagataagaaattccttctgtctactttggctgtaactttgtcttctagcaactcccatttcttatgatcatttctgatgggttcaacttttctctcctcagttcatttatctcaggattcccaattaactgctctactcaatcttaaccatgctcttcagctgtcagcttattttaatattgagcatattcaaatgctcaatatgatcttcagttgtcactgtccctactagtttacgtgtctaaattgaaatcttccttgatctaaatttatgtcagttcaggaagcttgcacaaatttccaaatgctggtatcctaattcagagactggggtctcaacaatagctgtcagcctaaggctagcgagcaaaagcagctgagagaaagagtaagaaatggatttctaaatttgttttaaaaattattcaagtgacagtgcaaagaaaaatatttaaaaattagcaagaatatttgatctatcacttgcagtctcaatttgatgattttcaaccactctctaaagtttttaaataaatatgaccaaatgttaaataaaatcacacagctcaaacagaacataagaatactgtgtttatttcaagaatcacaataattgtgggctcaaggtataacccagaaagaaaattcaatctagatatagggccaagcaattgcaataaagtatgatagtgatgacacggtaataataataatagaagaaatctaccattgtgccagaaaaatgtaaaaacagggcttgttgctaagatattacctttgaactgcctaatctacacctaaaacatgacaaaggaaacaaaaaggcaatctctgtctataacgtaaagagtaagaaattataaatcaacactgatatcacataaactttcaagagatatagtctaatttattgcaaagtatctcctatgcaactgaaaaaagcatggaggatgtatgtcgattctgtatacactccattaattagccaatacaaaataagtccttttataaagtcataattattccttctgaaatatggcttgacatgtacttatctcatagcaatggtttgcatgattcccttttttttccaattttgctaacaaattgaacttaatagctaccagaatttttaataaatcctagacctagattttacatgctggcataagaattctgtagtgatgctttctttcctaagttcttctaataaaatccccttcccttgtctatcagtgagatttcttctggttgcataaaacagacaaagaaacaaatggacttaaataatacagtaagttacgggctcatgttactgaaaaacctagagcaatggctctcaatcctgtctgtgggaatcacttggagaggtttataaaataattcccttgcccatatcccaaggcatcctccccagaaattatttaagtggtcttgggtactttaaaatataatttcacaagttcccagataacatcaagtgtgaacacaaggctaaacatccctgctttagaagaaagtaaagaggcttcaggtgtgactttaaaagtttttcaattccatttttctctgagtctgtaagcccaatttccttccaagtgtcatctcctgcaggaaggctttcctcatgatagtataatggctgcagccttatatccatatgttacacaattcagaaaaagatcaagctttttctccaaacatagaacacaatctggggttattctctgggccaccatagctcctattccacctgaactcatcactgtggcaagagagacagaattatggtaatcatcataactaacccaaatgaagaaacatagaattaatataaaattttgtgtctagaaggaatgaaacctattacatacaaactgaagcaaacatgtcaactaccacttaaggatgcctatataacttagaacacaaatggaaaataagagaaaaaccccaagtaaacagtgtcaaaagtaaacaagtgcagttgctgcagatgtttaatttgcaaaaagcactacataagtaggtaaggatgacagaaaatttaaaaaattaaacctgtgagagatatggctaaaaaaatctatgttactaatctattcttaagttataatggatggttgccgaatttaaatacacccatcactatctatttattcctacataaaagtaatgattaatttaattgagagttgaattatgggacatctttatgaatgcaaatttcacatcaaataaatatttttatattttgtaaaaattaaatgttaatgaaaatggtttatagcataaaatgtttatgatatagtcttattaaagaaaaactacaaaaaaagatattttcacagtattacaatgaaagaaaaattcactaaaacattaacagttgctactattagttgggaagactatataaacttatctttttccttctgcttttctttatttaacttttattttaagttctgggtacatgtgcaggattgttatataggtaaagctgtgtcatgagggtttgttgcacaaattatttcatcacccaggtattaagcctagtacctattagttattattcctgatcctctccctcctcccaccctccacctttcaataagccccagtgtgtgttgttcacctctatgtgtccatatgttctcatcatttagctcccacttacgagtgaaaatatgcagtatttggttttctgttcctgcaatagtttgctaagaataatggcctccagctccatccatgttcctacaaaggacatgatctcattcttttttataattgcatagtattccatggtatatacgtaccccattttttatccagtctatcactgatggacatttaggatgattccatgtctttgctattgtgaatagtgctgcaatgaacatatgcatacatgtgtctttataacagaatgatttatattcctttggatatatacccagtaatgggatcgctgagttgaatggtatttctgtttttaggtctttgaaaaatcaccaccctgtcttccacaatagttgaactaatttacactcccactaacagtgtgttagcattcttttttctctgcaaccttgtcagcatctgttattttttgactttttaataacagccattctgactggtgtgatatggtatctcactgtggtttcaagttacatttctctaatgatcactgatgttgagctctgtttcatgtgattgctagctgcatgtatgtcttcttttgaaaagtgtgtgttcacatcctttgtctattttttaatggggttttgtttttctcttgtaaatttgtttaagttccttatagatgctggatattagacctttgtcaggtgcatagtttacaaaaatttcctcccattctgtaggttgtctgttcactctgttgatagcctcctttgccatgcagaagctcttaagtataattagatccctcttgtcaatttttgcttttgtgtaattgctttcagtatctttgtcatgaaatctttgcccactcctattccagaatagtattgtccaggttgtcttcaaggttttttatagtcttgggttttacatttaagtctttaatccatcctgagttaaattttgattatggcgtaaggaagaagtccagattcaatcttcggcatatggctagccagttatctcagcagcatttattgaacagtgactcctgtctccattgcttgattttgtcagctttgtcaaagatcagatggttgtaggtatccagacttctttctggactctctagttgttccattggaatatgtgtctgcttttgtatcctttgcatttttctatcttcaaaaatttcttcaatgatcatgtgttactcttataaattttaaaaaatcttaattaccaataagttgtccaattacagaattgttggaaatgaggaaaataagaaactctcaaaaatccttcacttcattttaatacttgaacttctagattttttttccagtaattgaatatttaatcataaaatctgtgtgaatgttctttgtataaatgtcaaaggtatgttatttcaatgcttaaaacaaatgaaaatatcaatatctcgaatgtttctatacaagaaaacacttcacagtaccctcagtaaccatcatctagcccttgtctaacataatctccatgaggaggcatttagttttacatgacactgcctaccatataatttaaaagctttaattattagattacaaacaacttaagtgcaatgaaagaatcatatatttagaatcaaaatgctgataaattaaaattttaaaattctgaaaggatatggggaagagagaaaaatgatgagcaaaattcgtatcttttataattaaattacattttacacatataaaaattcaattattatttgtataatgaaaatgaaaggaaatgggagaatgactttgaaaaggataactttaagaggtgaactcctattcaacatagtattgaaagtcctagtcagagcaatcaggcaagagaaaaaaataaagggcatccaaaaggaacagagaggaagtcaaactatctctgtttgcaaattacatgattctggatctagaaaaccccataatctcagcccaaaagctccttcagctaataaacaactacaccaaactttcaggatatgaaatcaatatacaaaactcactaccttacctatacaccaacaataggcaaactgagagccaaatcaaaaatgtaatcttatttacaattgccacaaaaagaataaaataacaaggaatacaactaaccagagaggtgaaatatctctacaatgagagttacaaaacagtgctcacagaaatcagagaagacacaaacaaatgaaaaagcatcccatgctcatggataggaagaatcaatatcattaaaatggccatactgcccaaagcaatttacagatttaatgcttttcctatcaaactaccaatgattttcttcactgaactagaaaaaaaattttaaaattcacatgaaaccaaaaaagaatccaaatagccaaggtaattctaagcaaaaagaacaaagctggaggcattacactacccaaattcaaattatattacagggctacagtaaccaaaacagtgtggtaatagtacaaaaacaggcacataaaccaacagaacagaatagagcacccagaaataaggctgcacatctacaaccatctgatctttaacaaacctgacaaaaacatgcaatggggaaaataatccctattcaataaatggtgccgggataactggcagctacatgcagaatattgaagctggaccccttccttataccatatacaaaaatcagcttaagatggattaaagacttaaatgtaaaaatccaaactataaaaacccttgaagacaacctaggcaatatcattctggacacaggaatgggcaaagatttcatgacaaagatactgaaagcaatcacaacaaaagcaaatgaaactatcaacagagtgaacagacaacctacagaatggaaggaaatttttgcaaactatgcatctgacaaaggtctaatatccagtatctataaggaacttaaacaaatttacaacagaaaaacaaccccattaaaaagttagcaaaggacatgaacagatacttttcaaaagaagacatacatgcagccaacaagcatttggggaaaaaatgctgaatatcactaataattatacaaatgcaaatcaaaaccacaatgagatagtgtttcacaccagtcagaatggctattgttaaaaagtcaaaaaataacagatgctgacaaggttgcagaaaaagaaatgctaatatactgtcaatgggagtgtaaattagttcaaccattgtggaaagcagtatggcaattcctcaaagagctaaaagcagaattaccattcaacgcagcaatcccattaccgggtatattcccagaggaatagaaatcattctaccataaaaacagatgcacatgaatgaatcactgcagccctattcacaataccaaagacatggaatcaacctcagtgaccattaatgacagactggataaagaaaatgtggtgtatatacacaatgaaataccatgctgccataagaaagaacaagatcatgtcttttgcagaaacatggatagatctggaggccattattcttaccaaactaacacagaaacagaaaatcaaataccacatgttctcacttttaagtgggagctaaatgatgagaacttatgaacacaaagaagataacagcagacactggagtctacttgtgggtggagggtggaaggaaggaaaggagcagaaaagataactgttgggtattggacttaatgcctgggtaacgaaataatctttacaacaaacctctgtgacacaagtttacctatgtaacaaaccttcatatgtatcctcaaactgaaaataaaagtttttttaaaacataagaggtgaaaataacctttaaactttcttattttgttttgattttgcaaatcaggcaacactcaaagaaaaaaacaaatccacattgcaagttcaagattttaatgcaattgtccttgtaacatattgaataaacaaacaaaacttacataagtatatggaagacttgaataacagaattaacaaatttaggatgattgacatatttatatcattgtgtcccataactacagaatgtacctcaaaatgaaaataaaggccatgtatgacaagcccacagctaacatcatactcaatggggaaaagttcaaagcttttcctttaagatcaggaacaagacaaagatgcccactttgccacttcaatctagtactagaagttctagccagaacaattgggcaagaaaaaaaataataaaaggcatccaactcagaaaagaagaagcaaaattgtttctgtttgaggatgacatgttcttacatatagaaagctctaaagactactgcccccccaaaaaaagttacaactaataatacagtaatgttacagaatacaaaattaacatacaaaaatcacatgcttgcactaacaacaaactatttgttaaagacattaagaaaaccatcttatttcttatagtatcaaaatgttatttaggaataaatttaaccaagagggtgaaagatctgtatgctgaaaactataaaatattgataaaagaaatagaagatacaaataaatgaaaagataccctatattcatgaatgtaaagaattaatactgtcaaaacattactgaaagtaatatacagattcaatgcaatccctatcaaaatttcacgacatttttcacagaaataaaaaaaatcctaaaattcatatggagccacaaaagactccaaataactaaagcacacttgagtaagaaggacaaagttgcaggcatacagatccttatttcaaatatattataaagctataataatcaaacagtatagtactgacatagcagatacatagaaaaatagaacaaaatagaaagcctggaaataaacccacacatatactatcaacaaatctttggcaaaatcaccaaaaatgaatgatatagaaaggatattctcttcaataaatagtcttgagaaacctgagtatccatgagcaaaagaataaaatcagatccttaacaccatataaaaagatcaattcaaaatcaattaaagacttaaatgtcagacctgaaaccacaggatttctagaagaaaacagagggggaaagctctatgacactggtcttggaaataatctcatggatctgagatcataagcacaggcaacaaaagcaaaattaaacaagtgggactatataaaacttaaaagcttctgcgctgcaaaggagacaatcaacaaaacaaaaaggcaacctacagaataaaagaaaatatttgcaaactacatacctgataagggttaatcttcaaaacatacaaagaactcataaactcaacaaaaagaaacaaataactaacagttggcaaaatacttgaataagatatttttctaaagaagacatttgtatggccaatagatatatgaactaatgctcaacatcactaatcatcagggaaatgaaaatcaaaaccacaaggagataccacttcacatctttaagaaggattatcatcaaaaaactcaaaggtaaccggtgtagctgaggatgtgtagaaaagaaagctcttacatattttggtgggtatgtaaattggtacagtcattatggaaaacagtatagaggctcctcaaaatattaaaaatagaactactgtatgatcctgcaacttcacttttggctatacatccaaaagaaataaaatcagtatgttgaagagatatcagtacttccattttcattgcagcattattcacaagagccaagatatgaaatcaacataagtggccactaatggatgaacagatagagaaaatgtgatatatatatttatatgaatgaatattattcagcctttaaaaagaaaaagtttgcatgatctcacttatatatagtcttaaaaagtcaaactcatagaaacagagtagaaggatggttactaggagtcaggatatcagaaaaatgagatggtggtcaaagggttcaaactcgaagttacaaaatgaatatattctggacacctaccgcacagcatagtgactgtaataataacagtgtattgtatacttgaaatttgccaagagaatagatctcaattattctaattacatacacacaaaaaggaaactatatgagataatggatatgataatatgattagttgtggcaattattctacaatgtatgtgcatatatgtgtgtatctcaaaacatcacattgtacactttgaatatacacaatttttatttgtcaattacacttcattatagctggaaaaaattaaaattaaaaaatggccaaaaatcaagtatctaagcatacaattaaaaatctaaaaaaaaaacagcaaattaaataaagtaaataaaggagaaaaataatagacagtgagtacaataaatatagaatcaaaaataaagccacaagacggctattttaaaagaccaataaaactcatgtagtaagaccgattaacaaaaaaagaggggaaggagccaagatggccgaatagcaacagctcccagcgtgagcaacgcagaagactggtgatttctgcatttccatctgaggtactgggttcatctcactagggagtgccagacagtgggcgcaggtcagtgggtgcgcaaactgtgcaggagccgaagcagggcgagacattgcctcactcgggaagcgcaaggggtcagggagttccctttcctagtcaaaaaaaggggtgacagatggcacctggaaaatcgggtcactcccacccgaatactgcgcttttccaacgggcttaaaaaatggcgcaccacgagattatattccgcacctggctcagagagtcctacgcccacagagtctcgctgattgctagcacagcagtctgagatcaaactgcaaggcagcagcgaggctgggggaggggcgcccagcattgcccaggcttgcttaggtaaacaaagcagctggaaagctcgaactgggtggagcccaccacagctgaaggaggcctgcctgcctctgtaggctccacctctgggggcagggcacagaaaaacaaaaagacagcagtaacctctgcagacttaaatgtccctgtctaacagctttgaagagagcagtggttctcccagcacacagctggagatctgagaacaggcagactgcctcctcaagtgggtccctgacccctgacccccgagcagcctaactgggaggcaccccccagcaggggcagactgacacctcacacggctggccaggtactccaacagacctgcagctgagggtcctgtctgttaaaaggaaaactaacaaacagaaaggatatccacaccaaaaacccatctgtacatcaccatcatcaaagaccaaaagtagataaaaccacaaagatggggaaaaaacagaacagaaaaactggaaactctaaaaagcagtttcctgcctctcctcctccaaaggaacgcagttcctcaccagcaacggaacaaagctggacagagaatgactttgacgagctgatagaagaaggattcagataatcaaattactccgagctatgggaggacattcaaaccaaaggcaaagaagttgaaaactttgaaaaaaatttagaagaatgtataactagaataatcaatacagagaagtgcctaaaggagctgatggagctgaaaaccaaggcttgagaactacgtgaagaatgcagaaggctcagaagccgatgcaatcaactggaagaaagggtatcagcgatggaagatgaaatgaatgaaatgaagtgagaagggaactttagagaaaaagaataaaaagaaacgagcaaagcctccaagaaatatgggactatgtgaaaagacaaaatctacgtctgattggtgtacctgaaagtgacggggagaatggaaccaagttggaaaacactctgcaggatattatccaggagaatttccccaatctagcaaggcaggccaacattcagattcaggaagtacagagaacgccacaaagatactcctcgagaagagcaactccaagacacatgattgtcagattcaccaaagttgaaatgaaggaaaaaatgttaagggcagccagagagaaaggtcgggttaccctcaaagggaagcccatcagactaacagcggatgtctcggcagaaactctacaagccagaagacagtgggggccaatattcaacattcttaaagaaaagaattttcaacccacaatttcatatccagccaaactaagcttcataagtgaaggagaaataaaatactttacagacaagcaaatgctgagagattttgtcaccaccaggcctgccctaaaagagctcctgaaggaagtgccaaacatggaaaggaacaaccggtaccagccactgcaaaatcatgccaaaatgtaaagaccatcgagactaggaagaaactgcatcaactaacgagcaaaataaccagttaacatcataatgacaggatcaaattcacacataacaatattaactttaaatgtaaatggactaaatgctccattaaaagacacagactggcaaattggataaagagtcaagatccatcagtgtgctgtattcaggaaacccatctcacgtgcagagacacacataggctcaaaataaaaggatggaggaagatctaccaagcaaatggaaaataaaaaaaggcaggagttgcaattctttgaaaccaacgagaacaaagacacaacataccagaatctctgggacgcattcaaagcagtgtgtagagggaaatttatagaactaaatgcccacaagagaaagcaggaaagatccaaaattgacgccctaacatcacaattaaaagaactagaaaagcaagagcaaacacattcaaaagccagcagaaggcaagaaataactaagatcagagcagaactgaaggaaatagagacacaaaaacccttcaaaaaagtaatgaatccagcagctggttttttgaaaggatcaacaaaactgatagaccgctagcaagactaataaggaaaaaaagagagaagaatcaaatagatgcaataaaaaatgataaaggggatatcaccaccgatcccacagaaatacaaactactatcagagaatactacaaacacctctacgcaaataaactagaaaatctagaagaaatggataaattcctcgaaacatacaccctcccaagactaaaccaggaagaagttgaatctctgaatacaccaataaaaggatctgaaattgtggcaatagtcaatagcttaccaaccaaaaagagtccaggaccagatggattcacagccgaattctaccagaggtacaaggaggagctggtaccattccttctgaaactattcctatcaatagaaaaagagagaatcctccctaactcattttatcaggccagtatcatcctgataccaaagcctggcagagacacaaccaaaaaagagaattttagaccaatatccttgatgaacattgatgcaaaaatcctcaataaaatattggcaaaccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaccccgtcaaactaaaaattctcaataaattaggtattgatgggacgtatctcaaaataataagagctatctatgacaaacccacagccaatctcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagggaaccccattatctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttccaagagaataaaatacctaggaatccaacttacaagggatgtgaaggacctcttcaaggagaactacaaaccactgctcaaggaaataaaagaagatacaaacaaatggaagaataatccatgttcatgggtaggaagaatcaatattgtgaaaatggccatactgcccaaggtaatttacagattcaatgccatccccatcaagctaccaatgcctttcttcacagaattggaaaaaactactttaaagttcatatggaaccaaaaaagagcctacatcgccaagtcaatcctaagccaaaagaacaaagctggaggcatcatgctacctgacttcaaactatactacaaggctacagtaaccaaaacagcatggtactggtaccaaaacagagatatagaccaatggaacagaacagagccctcagaaataacgccacttatctacaaccatctgatctttgacaaacctcagaaaaacaagcaatggggaaaggattccctatttaataaatagtggtgggaaaactggctagccatatgtagaaagctgaaactggatcccttccttacaccttatacaaaaatcaattcaagatggattaaagacttaaacgttagacctaaaaccataaaaaccctagaagaaaacctaggcctgaccattcaggtcataggcttgggcaaggtcttcatgtctaaaacaccaaaagcaatggcaacaaaagccaaaattgacaaatgggatcttattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcaaaaagtgggcaaaggacatgaacacacacttctcaaaagaagacatttatgcagccaaaaaacacatgaaaaaatgctcaccatcactggccatcagagaaatgcaaatcaaaaccacaatgagataccatctcacaccacttagaatggcaatcattaaaaagtcaggaaacaacaggtgctggagaggatgtggagaaataggaacacttttacgctgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacatatgtttattgcagcattattcacaatagcaaagacttggaaccaacccaaatgtccaacaatgatagactggattaagaaaatgtggcacatatacaccatggaatactatgcagccataaaaaatgatgagtacatgtcctttgtagggacatggatgaaattggaaatcatcattctcagtaaactatcgcaagaacaaaaaaccaaacaccgcatattctcactcataggtgggaattgaacaatgagaacacatggacacgggaaggggaacatcacattctggggactgttgtggggttgggggaggggggagggatagcattgggcgatatacctaatgctagatgacaagttagtgggtgcagcgcaccagcatggcacatgtatacatatgtaactaacctgcacattgtgcacatgtaccctaaaacttaaagtataataataataataataataataataataataagttgtggcagctgctataataaacaacccatcaagccccaataaacaatcaaaaggcaaacaaacaaaaacaaaaacaaaaacaaacagaaagagtgaaaaagcataagctaatcaggaattttaagaagcaattgttaattatatatcctagaaacattaaaaataataaaagcacattatgaacaactttatgcaaatacatttgaaaatttaaataaaatgaaaagaaattggcagaagaaaaaaatgaaaaataatttctaaatctaccaaatctaccaaatttaatctgttattaaaagctatcttacataaagaatctaccctcaaatggttacaccagtaaattcaacaacaatctcacacaaattctttcagaaaatggaaaaacaggcaacacttaccaactttatgtggtgaccataaccatgacatcaaaccctaacaaggaaattactaaaaaggaaattacagaccaatgcatcccacaaaaatagaaacaaaagtcctaaataaaatattagtaaatagtgctgtgacatattaaaaggatacatcaaaaacacctacattttattcaacacatgcaaaaataaatttgcatttaaaaagtaatcaatataatttacttgataagagaattaaaaaatcataagtaacccaatagatttgaaaaaatgcttaataaaatttagaatatattcctaatataacacttgataaactagaaatagaagcagacttctttaaatggtaaataatatttttaaattactaagcatattatacagtatagtgaattattaaaactttcccccagaaacaagctaaggatactcacttgcaccagttttatccagcatcctactgatgatgccaatgccactacactaaaacatgataataataataatattcataggatttgtaaagtcactttccatagattatatgactttgtatgtaaatattctgaagtaaatccctgcagaaaaacttgtgactataccctctctgctccacagaaataccacaaaaggaacttcatcctgccccttccccaccaagttttgtagagattgttatgcagagtcctgttgactccctaggtactgtactaacaaggtgacattcctcccactcaccaccgggtgctgcagaaactcttgggcagagccatgtcatcgaactcatcctgtactaagtaaataacagcaaaaggcagcaccttgcctcttcccagctagataatagttgagaagtggtagattatggaaaggtcggggaaaataaaggaaatgttcaaatctgtgtatgaaatcctgcatatactcccaaaagactcataggtgaaactaaaatcaatatagcaaaagctctgaaaattaaattatcatgtggaatactgtccatgtttcaaaaagtccactgggtaccatataaacagaacagaaaagtactgtggcgtttttaagcaccaaattgacatctgaaccacagcccacaaaagtggtccaggatatatgctttaaacccaaataatctgactttctactaaaacagaagatgtaaatagaaactgtaatttcataacacgatactgaaaatgtatagaacgcatttcaaaagtactcatcataacaataaaaagaaaaaatttcaactaaaatgagaaaagacagtcaacagatgacaacaccaagatggaacaaatgctagaagtatctgacaagacatttaaagcaggtatcatacgaaagtatcaacaagcaattataaattcttggaaaaaaataaaaattagggggcaggccaagatgaccaattagaagcagctgcgaactgcggctttcacagagaagaacaaaaatggaaagtgaattctacaccttcaactaaggtatccaggttctcgtttggtactgactacgcaatcggcgtgacccatgtagagagaggaaaaacagagtggggcaatagctcacctggaagcacaagccgcatgggcaaggggagctcccagctccagccaagaaagggggtgagtgattgtgcgaccctgcctgggaaaccaggcttttcccacagatctttgcaacccacgaataagatcccttcaagcccaggccaccagggccttgggtgaaaagcacagagctgtgcagactgtcagcggctgatctggcacacacagaaacacaggagtttttgcatactccgtgcctgggaattccaatgaggcaggacacccgtccattcctgtagaaaagccagggagccaagcaggctcgttcagcaggccccactcccagagctcctcacaagttaagacccactggcttggaactccagacgcccagtggcaataggttggagactgcctgcgactaccaagttcccggggggcaggggcagctgccatctctgcagctggagtcagccatcctggcctgcagctcctggaagtctgggtggtccagattgggaggaattccccacaacacagcacagctgctgtggcaaatcgtggccagactgcttttttaagtgggaccctaatccatccctcctcaccaggcaagtccttcctggaggaatttcagcaactctagcaagggttttaccagacagaactctgatctccctgggagggagcccctggtggggagaagcgacaaaggtcttcacggttcagcagacatagcatttcctgcctgccggctgtggagagtctgggcggtctgcaggagaagggttctccagcacagcggagtcaccccaccaagaggcagccagactgcttctttaagcaggtccctaatcccgttcttcccgactgggtgacctccaacaagagtctccagacacctcctacaggaatatttgagctggcatcaggttcgtacccttctggaacaaagctccctgaggaaggagcaggctgccatctttactgtgttgtaatctccactggtgataccgtcaggtgtgggagggacccaggcgattagggtccggagtggaccccccaaaacacgcggcagccctgcagaagagcggcctgttagaagaaaaacagaaagaaaaaaaaacaccctacaaaaaaaacattcaaagatcagcaacctcaaagatcgaaggtagataagcccacaaagatgagggaaaaaaatcaacacaaaaacactgaaaagtcaaaaaactacagcgcctattcttcaaatgatcacaatgcctctccagcaagggcacagaactgggctgaggctgagaccgctgaattgaaagaagtagacttcagaaggtggataataattaacttggctgagctaaaggaacatgttgtaacccaacacaaagaagctaacaatcaagataaaacaatacaggagctgacagccacaatagccagtttagagagaaacataaccaacctgatggagctgaaatacaacacaaaaacttcacgatgcactcacaagtatcaataccagaatagaccaagtggaggaaagaatctcagagcttgaagatgacctttctgaaatgagacaggcaaacaagaatagagagaaaagaatgagaaggaatgaacaaaaaagaatgaaaaggaataacaaagcctccaagaaatttgggataatttaaaaagaccaaacctatgaatgattgaggtgcctgaaagagacagaaagaacagaatcaagttggaaagcatactgcaggatatcatctaggagatgccatgcattggcattttgtaaagttctctagatgattctaagaagctttttaagagttgagaaacgctggcctaaataagtgacaaataattttgacctaccataaaatggagacatctaattgtactaatgacccaataatacaattctaaagaggaaagagatacctttatgataaagcttagaaggacctgatagcttctaacaaaaagttcttttagcagaacaaatttacgctgatgtctatcttccaagaatgctaacaacataataggtattttataattgtgctaaaattcagctttattctgaaaatagtttgtataatataagcttcaaggaaaattcagagttgtgacagagacagaaacaggcaatgaaggagaataaataagctgtcctgggaagttaacaaatgattctatttttcttcatctttatcaatcactttattaactttaagaacaagctcaaattttacttccctcaaaaccggtatctgcctaatccatcacttgagctgtattttccaatacttacatgctgtttgtttggaattagagcaaataaagaagttacaaaaactgattggttttggatgcattaaaattagaaataccaattagaaatccaagttgagacatcagagagacaagtatgaatatgtctgaagtcaaggaagacgataggctatagacataaataacttattgggttcctaacctatagaacagctcctcctccttgcgcatataataatgatagtatagctttaaattatcaattaagattacagtgcacagtgataggtaattccaagtttggcaatattcccaagggtcatcagtagtggaacacacacctccacattatggaataaagagtaaaaatcctcattccttataggggcttcataatgttgataaataaaacaaatatcagaatcaataggtttcaaattttaaaactttctagtgcatacataaaccccaaaatgttctacataatctgatgctaaatttgaaatttaagtgtgaatatattaaatttaataagcaaatttaaatgagcaagttgaagaaaaattttaacatttacaataatataatttttagatacttcctgactttgagtgtttatttcaatcagaaataacataaaattataattgcaaatcctgagaatattcaagctcaaatcaaagctgtacattcagaataaggtactaaaagtaaaatttctacgatacgtaacagctatgaaacatagacctacacatgcaatacaatcaaacctttgaaatgatttatctgaactggatacacacagtgcttgacaccaacaagcacgaaaatctccctctatagagctgttttcagagtaatctttgtctgaaagtaaattattaccccaagttaaactgattgctcatcatatattccaagaaatttcttttaaggtaaacacaactaatctgaggattctctgaagcccaattgaaaacattgtaatagtggtccaccatcactgtaaaaaaaagaatcagcatactgaactaaacttaagaaaacaggcatcaaatagctcaccaggaaaataaaatactaggtcatgaaaagattttttttaactttttttattgttgtaagacacataaaatgtatcatttttataatttttaagtgtacagttaagcagtactaagtaccttaccattgttgcataaccataaccaccacacacctccaaaactttccatcttcccaaacagaaacattgtaccattaaacaataactctccattctctcctccccacttgcaaccaccattctacaagttgcacactgagtattctttatccaaaattcttgagaccagaagtgttttggacttcagatttttttggagtttggaatactcgcattatgccaattgagcatcccaaatccaaaaatccaaaatctgaaatgctccaatgagcattttctttgagcatcatgtcggcattcaaaaagtttcagattttggagcgtttcccatttcagatttgggatgtcaacgtgtactttctgtttctatgaatttcactactctaggtacttcatataagtggaatcatatagtatttgtccttttctgtctggcttatttcacatataatgtcctcaaggttcatcatattatagcacgtcagaatttcattcctttttaaggctgaataatattccattatgtgtataccacaatttgtttatccattcatctagtgatagatatttgggtgtttccaggacaacatattcttaatttaatcccacagtttaagacttacaggtaatttaaattaaattcaacttactgagtagttactaagggtaactcactatgggaagtactgtgggaagtacaagggtaaatcagacatggtgcctgctcttaaggaatttacgatacactgggaaaagagaagaaaaggaagtagacgtaaccagcatttactaattgcttgccatgtgccaagtgttttacccaatcactgcatatatagctcccaatgactctgtgaggtagatactgtaacatccattttatatagggagaaaaatgaaggcactgagaccttaagtaaccacctccaaagctgggatttaaactcacatcttggattcagaggcctgtgttcattccactatacatgttgttccctatgattcaaggcagaatgtgacaaatcctggggaagctccaggaaggtagaagaggaagagaagagactgccccttgcctgagggtaaaggcacatgacaaaggtaggtcttagaggtcaggaaggcttatgtttgacagagatagagggtggaaaaaaattgtacaagcagagcaaaatgacggaggcaggaaagttcagtacatacttagggcccagtggaattgtggaccataaggctggaaagtgatgcagggaaaaatcatggtcataatgaaatgctagctcaaggagtctgaactccaccatcaggcaatggtgagccactgtaggtttttgagatgggacatagtcagagctatgcttcgggaagatcaccatggcaataatgcattgcaaggatagagggggtgagagtaatttaaaggtaggaaaagcagttagaaggtcactggtgatagcagatggggcataattagtcagaatggaaaagaggatatggacgtgagagatatcttagaggtgtgaatgacagaactcggcaatcactgcatttcataatgcatcaagtaggctgacaatatatcctgatttgcctgggatatgttttcctagtgtaattacaaatggcacccttttactctccaaaaggtccatgtttggacaataagctatattatcatattaattaggagcaatgagtaaaaggaatcaaaggtgactccaagactttaaacctggattagtaaggaaagtggtaacacctttggaaacacagaagggaaatcaggttttggggaaatatgttgagttttgatctggacatgttaactttgctgctgaggtgaggatttatttaacagcaagaagcaccttgcccatggatttcccctgtatcacatgaaggaaggcatcactgacctcctccagcttgaaaaccattccaacatatggttggatgcgcccttgttggcagtactgaagcactgaagacaggctcctggagaagacgggaaagttcatttctttgtattgaccatagtacaggcccatcacagagaccttcttcaggagcagaaggttggctggcaccgaaacaatgctccctccagcaaatcccaccactgcaatcctgccctcccatgccaggctgtggagagcctccaggaagacgtctcctcccaccatgttgatggccacattcatcccacccttgcccaccagcttcctcactgcatccttcaggctgctctgactatagttcacgctgaactgtgtgcccctctgcatcaccaggttgcacttctcgccacttccagcagcagctattaccttggcctgaagagcatttgttgccacatctatcactacaaggcctgtggctccagctgctgccatcactaaaacaatttctccaggttgggtatgggccgatgctcaagagcaaaaatagcagtgccataagataaatggaggacagcagcttcttgtagggagaacttttctggaatctgccacaggttcttctgatcagtgacacattcttcagccatacatttaaagtttcttatgccaataactctatctccctctttaactgtgctgacatctgtgtctgtctccaatcctgtcccagaaaactccattccaggtatgaagggaagatggggcctttcctaatattcaccacagcagaccaaaacatcagcaaagttaactccacagaaatggacatcaactgtgacctcgtgaggcctgacggggcggggggccacctcttcaaccgtcaggggcttcttcagctctgcgcaaatcacagcgcggtagtgccggccgcagtcctgcctctctctcctgcagagcaacgactgagagaggcactgcctgcagagcactgccgccatagccaggccaagcgaggggcaagcaaaagatttttaaaataagagaacaaattgagaagatctcaatacgggttcaacaccagcaaacaataaatgactttcatattttttcatttttatgtaagaacataatttacccctggctaaaaaaaaaattcaaaacataatggttaaaacttaaaataatatagtagcaatttcaaatagatacaataaacttaagcttttaaaaatatattcaggtaaaaatatatcttaaaagctatcttgatacagaggatagaaataacctcaaagagctgttaatctcataaactctggggacaaaagcacactaaaataggtgcagaatacaatgtcaaagaaaacccactctctggacacttttttttagacaagataaaggatttctcttagactacatcctctaaatttcatctttttaggcttattaaatatttcataactatatccattccaccgttgaggtaggacactactcataggaaaaaaaagagtggctgttgacttgcattcttccttaaatataaaagtatgtactgagaacctactgtgtacctagcatgataccaaaactacaatggagaactctgcatttaacaaataaacaatctttctaaaattaaggcatgcgtatataaggaagataaaaaaaaacctaaatctcatggcaaatgttcctcagtaaatttgtgaaaattcttgagtaattatattcataaaagacttattagactgagaaagaaaaattactaaactcctatattatacctatcttttccaacaaaaggtaactttcctggtgaaaataaaaaactagttcataaaaatagacttcaaaatagatgaaaacaattgtcagagataaccaagatgttccagataaattcaggattctgaattgatattgtaacaatacagagaaagccagcacaggaaattgtgtatactgttaagaattttttatgcattaaggagaactctctatatatcacaaagtgatgatgggtcattactttcacacacacatacacacacacaaacacacacacattggtcacatgctgatccataggtccatgctgtgtatgtgtaataaaaaactagttttttaattttcaccaggaaataaataaatatatatgtgtatgtgtatatgtatacacatatatatacacacacacatacacaccatggaatactactaagccataaaaaaggaatgaaataatggcattcacagcagcctggatggagttagagaccattattcaaaataaagtaactcaggaatggaaaaccaaacatcctatgttctcacttataagtaggagttaagctatgagaacacaaaggcatacaaatgatataatgaactctggaaactcgggggaagggtgggagacaggtgagggaaaaaagactacacactgggtgcagtgtacactgctcgggtgatgggtacaccaaaatctcagaaatcaccattaaatagcttatttatgtaaccaaacaccacctgttccccaaaaactattgaaataatttttaaaaattaaaagcaaggtttaatagattgaaataattgagtatgctctacttcaatcatggaagtatgcttgaaatcaataacaaataatgaaaaataaaactacatagggattaaacacacttctaaatatgtcaaaatagaaaaacaaacatgaattaaaaaacatcttacactaagtgaaaataaccaacataacagaatttgtagaattcagctaatgtagcacattaaggaaagcgatttctgcttcaaatatatacataatcaaaaagaaaagaagctgaaaattatcaatttagggttcattttaagaaactagaaaaaaaacaaatgaaaatcacaagaaatgcaaaagaaaaaatataaagaaatagaaattaaatatataatagagaatatcaacagtcaaaagtttttctttaaaaagagtataaatattgataaactcctagtaagacttattacagaaaaattaaaaaaaagaaaatacgaatcaccaacatcaaagggaaaagagggaacttaactatagttttcataaacacaaaaaaaagaagagaatgttatgattaactttaagcaaatatatttggcaatttgaaaaatggatatatttctcaaaaattgaatgaataaaagtagacaaaagaagaaatagttcaatatttattaaaggaactgaatatttttttcaaaaaccttctcacggagaaaaatctaaggtccagaaactttaacagtgaattcttataaatatttaagaaagaataactcaatcttggaaaaaacctagtaaaaactcttccagtgaattcagggggatactcttttttaagaacccagaataccttgacccccaaacctataaaaggtcattataagaaaggacatttgcattccctgtctataacttttttttacttttgccaacactgccctccttgaatttattgaatagcctatgtactgccatgttaggcagtatattatttcccatcaaggaacaatttcagaggaaaagaaatgtaacaatggactcatgtccatagaatttactaggtctaacacatcttcatcagttaaaagtagctggcctaaaagaacagaaaggactgccaaaaactcgattatggtgccaattgagagacaaaacactgagaggacaggattctggcttacagaatttaaaacaggctttgtatcagacatcaatctagtgcagtctttccccatatccagaactcataagtccagcaaccaaggaatagaagttcaaatagctcttctcactatttcgccttgtcacacactcacaaaatttttgcctcttgtctctacaactttgagctgtacttgtttagaagtcttggttctcaaggaaggaatgtttccacactctgattctacaaaactaaaagttgagactgccaactagtattttatgctactcgtgccactggaccaaagtaaaagtttctctaccgactggggtgacttatcacaattaacaagtggaaattgggttgatgttacgtagtgagggcaggtgtcagtggattctctgaggttcctgttaataattttatctccttattaagagttaatgaaaatgtaaatcaaccaaaaaaaaaagcagtgccacagaggatttatatccttcaaaaatgaagggtgtagattattccaacaaataaagaaccctgaacagctgacaacctggctgagagtaaaggaaacatagacaggaccatagacgtgagaagtaagaaatatcacctatggtctttgaccagttaacacataaggactgtggcaactatgcatattaacttttttacctagtgtgtgtgttaacttttttcatctttcctcttatccctcctttttttattttctaaaagtcttacaagaaattaacaacgaagagtggtatctgcaagatgggagaataggactttccaacactcatctcattacagaaacatcaacttgaacaactgtccacaagcaaaatgttgtggataaccttaacaagagctaaagaattcaggtgagacattacagcacctgggtgtaacacagaaataataaaagatgcattgaggttagaaagtaccggtttacattatttgtgtcactcccatccccaagcccaggcagcatactgtgggcagagatagtctcctcatagggggaaggagagtgaagtgatcacctaactttgccatgcacccctgaccaagcaggcactaatggcctcaggctccaggcccactccactaccaatcctgctccggcagccccaggatccagctcaattcctgcagactcatagtccagacctaccccagtttccaaagtggcctgacaagtcaaaataattgtcttaagaaaattcagtgatctacaagagaacacagacaactaagcaaatatcagtaaaacaatatggaaacaaaattagaagttcaataaagagatagaagccatggaaaagaacccaaaaagaaattctggacaatgacaaaactgaaaaattccacagagagctccaatagtacactaaatcaagcagaagaaagaattagtgagcatgaagataggttatttgaaattacccagaggaacaaaaagaaagcaaaaaacctacaagacatatatgggacatcatcaactgaatcaatatatgcattatgcacttcccagaaggagcagagagaaaaaaaggatagaaaagttactgaaaaatatgacagaaaacttcgcagatctggagtagaaaatgaacatccagatcgacaaggctaagtgttcatcaacggataaagaaaagtggcacatatatacaatgtaatattattcaacctttaaaaagaaggaaatcctgtcatttgcaacaatatgaatgaacctagaggacattatgataagggaaattagcagatacagaaagacaaattctgcatgatttcacttatatgttgaatgtaaggaaattgaactcttaaaagcagagagtagaatggtggtttccaggagctggagggcaggtgaagaaatggagagatttaggccaatggttacaaagtttctgataggaagagtaagttctgatgaataagctgcatgatgactgaagttaataataataggtcatatacttaaaaattgttaagatcttaaatgttctaaccacaaaaatgtatttgtggtgatgaatatgttaattagttttattacatcattttacagggaatacatacatcaaaacatcacattgtatgtcatatatatatatatgtaatttttatttcctaattattccttagaaaagctggagaaaaaaaggaaaaaataatgtaacagttaacaacaaccataaatttaaaatgtataattcagcatttaagtaacagaatatttagatggcctgactaaatttggccagagatgaaaaaaatgactgttaaaaacttgtgtctcctcattttgaagaaactgagaatgcctttgttgtacaaaaaatggttgtatcttattactaagaaaaaaagttgtttgtagtgctgtgtggaagttcaaatatgtataaaaatgcacaggtatgctgaatagccaatggggtgaaatgtatgaaattttaaactactgtctctcagctccaaacctaggaatctgcaaaccatatttatgctttgccagatggctctctgttaggtcctgcaaacaggagatgctagacagcatatgcaaggttaggggaagaagggatttccccttttcaataggcttctacattctggaagcagcagttccttcccataattgcaattttccaaatccacttgcaatttttccaacatgcttctgcttttttcccggtgtcattatgtaccctatgaaactttataacatgagtatttctttctctcattattttccttctttatactcctccttgcatctctggccttttccttttcccctcttttctctacaaatgtcattttatttttctaccaaagtcatttcaactatataaaactgttagttttccacactggtttcccatgtacttgtgttgataataataatattgagaggtgacagcgtgctggcagccctcgcagccctcgctcactcttggcacctcctcggcctgggcgcccactctggccatgcttgaggagcccttcagcctgccgctgcactgtgggagcccctttctgggatggcccaggccggagccagctccctcagcctgcgggggggtgtggagagagaggcacaggtgggaacaggggctgtgcgcagcgcttcccctcccaccccccccgccatgggctcctgtgtggcccacctccccgacaagtgccgccccctgctccagggcgccccgtcccatcgactgcccaagggctaaggagtgcaggcgcacagcgcaggactggcaggcagctccacctgtggccccagtgctggatccactggatgaagccagctgggctcctgagtctagtggggacttggagaatctttatgtctagctaagggattgtgaatgcaccaattggcactctgtatctagctcaaggtttgtaaatgcatcaatcagcactctgtgtctagctcaaggtttgtaaatgcaccaatcagtgctctgtgtctagctaatctgttgggtacttggagaatctttttgtctagctaagggattgtgaatgcaccaatcggcactctgtatctagctcaaggtttgtaaatgcaccaatcagcactctgtgtctagctcagggtttgtaaaccaatcaacactctgtatctagctaatctagtggagaacttttatgtctagctcagggattgtaaacacaccagtcagcaccctgtcaaaatggaccaatcagctctctgtaaaacagaccaatcggctctctgtaaaatgggccaatcagcaggatgtgggtggggccagataagagaataaaagcaggctgcctgagccagcagtggcaacccacttgggtccccttccacaatgtggaagctttgttctttcactctttgcaataaatcttgctactgctcactctttgggtccacactgcgtttatgagctgtaacactcaccgcgaaggtctgcagcttcactcctgaggtcagcgagaccacgaacccaccagaaggaagaaaccctgaacacatccgaacatcagaaggaacaaactccggacacaccacctttaagaactgtaacactcaccgcgagggtccgcggcttcattcttgaagtcagtgagaccaagaacccaccaattccagacacaataggatgttacttaataaaaacattttaaacatatgtgatggaaaatgccttttcctctacacatgctatagtaatacaataggacttttgtctgcccctaaaaactcccaatgggaaggtcattagtacatagttttgtatataattaggagcagatgctcaaaattttaatattctgaattggtcaaagtataactatgttaagcatatcagtgactcatatttctacatgtaaatccagcattaaagatgacagccttcttcattaggggaggtaattttgaaaagggatatgagttcttaaatgtttaaatatactaatgcaaggtttactcttcatgaatatgttcatcttaagatgattagacatttgaagtcaatttttaaatgtcatgttttattcgtcataaatttgatataaagaggttttaatgataataataccatattataacatatgtagaggtagtagataagtcatgtttgcatcagggaccttaaattatggagttaaaagtcctggctaatcatctctgtatcatttttaatatattgtccctcttttcactcccacattttctaccaaacaatgacttgttgatacaaaatgttggatggatgccatagatgcagcagcagaatttatttctcagagattatgtagaatatgaatcatttgttgttgttcattctaaatgaatatggcaccttcaaaattagaacagattgcattctcaaaacacatgagaaaatgttatcaaccaaagagtaaagataaaattatttctttgcaaatctattacttctgagatttatgtactgcaaataaaaataaccagaactaaaagttctaacctagaagttctgaattgcattctcttcacaatctatataaccagacaggcaatagcactcaatcaggaattaagttgttagaatctggtttatcacagtgcatcatgttcagcagtttccttcactgttccttctcggccttgatgaagatggcaactatcagcacttattcctgctgtttgcttatcaaacccattttctgagctaatgaagttagacaattaaataaaaaatttataaaaagtttaaaatgtaatggaagtacaggaagtatataagttcactatgaccaattcactcttcagtgtgtcagaaatcatttatctaaaatcctttacttgtactgatggccctgcagtaagaaaatttattataatgtgctgtctcccatcagtggttagttgtataataagataacaacagaccaaccaacaaagcaaaccctaaaaactgtccaagaatctaagaattttccatattcaatgagaaagtataacaaaagaaagaagtgagagtaacaaaatacagtttttagtcagaataactttgattcttattcagctgaaattcatttctaatgtgtttttactatcttcaggatcccaaggatctgtgtcccaggcccaggggatctttattttgagctcctgagacacttttaccagctgacctgtgacacctcttcagaagtctgaattctgaatcccagctccataagatctctgcaagctttcaaattttagtaattctaacctataccttttattcctcaaggcttaatgacggtggcatttcctgtatcactacctccatgataccttagtgttccttcaccttttcagctttccaatatccataattccttatacaattttatctcaaaactactagtatggttctgtcttctgactagatcctgactgatcataggccctctctacctaaatgtatctttatgcattttgatctgcagtagccacctactgcatgagacaaggagggtgttactctaacacctttccagactttcagatagaaaatgaagttcatacttcatcatccctgggatttctagacccaagtctgtgattatcctaccactacttcccaaactccagtcttaccagggttcacccacaatgtgagagagcataaaacagacctcaaattcagatctcaattcccttgtttttctactctttttgatccttccatgtccttcccatccaagaagggctctctctttcattttaccagacttcccctatcttgtacttttcctattctctttctcatagaaatgcttttatatctctgccatcaccattagaagaacatgctccacctatcctgctggtcccaagaaccattataaagtcatggctccccacaactattgtctctgaaatgaactttaagaaatgtttccgaagtaaaacacttattctttccatgcctttgcatttctgacatagaaattctaatcctctgcaagacaaaggagcttctggtttaaaaagatgagtttcactttcaaggaagtgtgaaaaacaaaaagacatcactaaattttaacatgttcttcattaatattatattaatagaatgatgaaaagagacatgttcttcattaatattatattaatagaatgatgaaaagagaccacaggcatgagactgacttagctttgaaacataactctaccatttttacaatttttatagctaaaaatatagtaggcttatagcctactataggcaacacagtgaaataaatgttgtacgtaataacacacttaattcttaccatggccctatcaggtacgtcttgttatccttacttaatagttaaggaaactgaaatttacagaagttgcctaaactcacgcaactaggcagtggagctgagatttaaaaagtatttttctaattccaaagcttttgctgttaaactttaacctagctcgagatgatacacaaaatatttaacaactcaaattaacaaattaatatataaatcaaaatttatttttaaattccttttcattctcaactctatgtattataactgataagtgatacaaaggtagcacaaattgttcactaaataattctaagaaatttcaagtcatttgttaacttttagaaaatgttggtataatttttgtgatatattttgttatgagtcgtcactagccaatgattgccctttctgagccataaattgacctaagaaagtatatcaaactcttctactgcctttcccactaacctgatagtcaacttttagtttctcaataactaaaggaaagttttaacttcaacagtattgtttatgatgctgaatcctctctcagtttatgctaaacaatagtgattacattttttaaaaaaagttatataccttataataacatccgagatctttatgcttatatagctttttaaaaaatcacaaaaaaagtttataatactatcatattcattttagtcaaccctaatttttcaagccagaggaaagtgccatgaaatcaccctaaagagagtgacttctattggattgcctcagtttgaattctggctctgcaacttaaactttaaactctgcgcctccatttcttcatttttaaagattaccataactatagtactcaatgagttaatatgcatttggaatggtgcctggcatggaataagtactatataagcattagctcttattttcattaataaaatcaatgtcaccaatgtctgtgatacacagtgttttgtggtttttaataatttaattcattaaatgaaagtgaaatataacatattctcagggtgattcccctaacacatactcaaaaccaaaacattcaacacaggcaatcttcctttcaatcctctggtaagtagaaagggtaaatttatttgcatttcacttttaacctgcataggttgaccactagagttttagtgtattaatgaattttctttgagactacccactacaagagtcttaaacttggtttccatctgagaggccctccttggccataaaaattaaaacctaaactcatctggtagggcaaatgcccttacggtgaaagttagctttagaactttacttgccactctgggttcctccttaatttagcctgtgtattgtgtactccttactttctaactcttggaaaaattcattaatatgttttgtttcttttgtgtagaagttttgttattttcagagagtgggtcaatacagataccagtacatcatagtgccattccaaatgcatattaaatcatttgagtactacttctacttttatttcaaaataataccttcacttcataaacaaaaatataatcatatacaagggtctaaaataaacagtaaaaatgtcctcctttgacctctccctgggtccattctaagaaataattcctttaagtaattaggtctttaagggatttttgttgtggggttgtttttgtttttattttgtttgggttagttttgttgcatgtaccattacaagtttaatataaggcctaatactgatttgtgaatttttaacatctgttaactctgcattatgaaatgagaaatatggaacatatactatctcccaatctctttattattttatattaaggtttataaagtttatattctgtcttataattaagtcttcttttatttgtgtagttgatttaaaataaaccaattttattttttttaactgttattttaggtttgggggtccatgtgaaggtttgttacataggtaaacttgtaccacagagatctgctgtacagatatttcacaacccaggtattaagcccagtacccactgtttatcttttctactcctatcccttctcccaccctccaccctcaagtagacccagtgtgtactgtttcctcctttgtgtttataagtaactatcatttagctcccacttgtgagaacatgtagtagttggttttctgttcctgcattagtttactaaggataatagcatccagctccatccatgttcccacaaaggcaggatctcatttttttatgggtgcatagtattctatggtgtatatgtactacattttctttctccaatctgtcattgatgagcatttgggttgattccatgtctttgctattgtcaatagtactgcaataagcatttgcatgcatgtgtctttatggtagaacaatttatattcctttgggaatatacccagtaataagattgctgggttgaatgggatttctgtttttagatctttggggaattgccacactgtcttctacaatggttgaactagtttacactcccaccaacactctacaagcattcttttttctctgcaacctcactagaatcttttattttttcacttcttaataatagcctttctcactggtgtcagatggtatctcagtatagttttgatttgaatttctctaattatcagtgatgttgaactttttctcagttgattgttggccacatgtatgtcttcctttgataagtgtctgttcatgtcctttgcccactttttaatggggttttgttttactcttgtaaatttgtttaagttccttatagatgctgcatattagacctttgtcagacgggtagattgcaataattccctcccattctgtaggctgtctgctcactctgttgatagtttcctttactgtggagctcttaagtttaatcaaatcccatcttccagtttttttgtttgtttgtttgttttgacacggagttttaccctatcaccaggctggagtgcactggcatgatctcagctcactgcaacctccacctcccaggttcaagcgattctcccacctcagcctcccgatacctgggactacaggcaagcaccaccacgcccagctaatttttgtatttttagtagagatgaggtttcaccatgttggccaggatggtctcaatctcctgacctcgtaatctacccacctcagcctcctaaagtgctgggattacaggcatgagccaccatgcccagcccaatttttacttttgttgcaattacttttggtgtctttgtcatgaaatctttacctgttcttatgtccaagatagtattggctaggttgttctcaagcgtttttagaattttgggttgcacatgtaagtctttaatcatcttgagttgttttctgtatatggtataaaaagggggtccagcttcattcttctgcatatggttaaccagttatgctagtgtcatttattgaattgggaatgttttccccattgcttgttcttgtcagatttgttgaagatcagatggttgtagatgtatggccctcatgtctggtctctcttttttgttccattggtctatgtgcctgtttttgtaccagtgccatgctgttttggttactgcaacctggtagtataatttgaaatcaggtaacatgatgcctccacctttgttctttttgcttaggattgccttggctattaaggctcttttttggttccatatgactttttaaaggtttttttctagttcagtgaagaatgtcactggtagtttcatagaaatagcattgaatccacaaattgctttgggcagtatggccattttaacaatattgattcttcctatccatgagcgtggtatgtttttctatttgtttgtgtcttctgtcttctctcattactttgagcagtgttttgtaattctcattttagagacctttcacctccatgattagctgtatttctaggtattttattctttttgtggcctttgtgaatgagttcatttgtgatttggctctcagcttgactactgttggtgtatgaaaatattaatgacatttgtagattgatgttatatccttaaatttatctgaagttttctattagctgaaggggcttttgggccaatactatgggattttctaaatataggatcatgtcatctgcaaacagatatagtttggcttcctctcttcctatttggatgccttttatttttttctcctgcccgatggctctggctaggacttccaatactatgctgaataaaagtggtgagagaaagcttccttgtcttgtgacagttttcaaaaggaatacttccagcttttgtgcaatcagtataaggtaggctgtggatttgtcctaaatggcttttattattttgggaaatattcattcaatacctagtttattgagagtttttaacatgcaggcatgttgaattttatcagaagcctttctgaagctattgagataatcatgtggtttttgtctctagtttggcttatgtgataaatcgcattatcaatttgcatatgttgaaacaaccttgaatcctggaaataaatcctacttcatcatggtggattaccttttagatatgctgctggattcagtttgcaagtattttgttgaggatttttgcatcaatattcaataaagatgttggcttgaagtttttttgtttttggtttttttgttttttgttgttgttgttgtttgttgtttttttatctttttgtgtgtgtgtgtgtttctgccaagttttggcatcaagataatcctggtctcatagactgagttaggaagtagtcccttctcctcaattttttttaatagtttctgtagaaactgtaccagctcttctttgtacatctggtagaattcagctatgaatccatcaggtcttggtctttttttttagttggtaggctatttattactgattcaatttcagaactcattattggtctgtgcagggaatcaatttcttcctggttcaagtcttgggaggatgtatgtgtccaggaatttacccatctcttctaggttttgtactttgtgtgtagagatgtttgcagtagtttctgatggctgattttatttctgtgggatctgtagtaacattccctttgtcatttccaattgtgttagtttgaatattctctctttgcttcataagtctagctagtggcctatgtattttattaattttttcaaaaaccaactcctggattctttgatcttttgaatgtttgttcgtgtcttgatttcctgcagtttagctccgatttttgctatttttcatcttctactagttttggggttgatttatccttgattctctaatttttcaagttgtgaagttaggttgttaatttgagatttttccaaatttttttttaattttattttaagttctgggacacatttgcagaacatgctagtttgtcacatagataaaagtgtgccatgttggcttgctgcacctatctactcatcaactaggtattaagcctcacatgcattagctatttttcctgatgctctccttccccctgggccccaaacaggccccagtgtgtgttgttcccctccctgtgtccatgtgttctcatttttcagctcccacttatgagtgagaacatgcagtgtttggttttctgttcctgtgttagtttgctgaggatgatggcttccagctccatccatgcacccgcaaaggacataatctcattcctttttatgactgcatagtattccatagtgtatatataatacattttctttatccagtccatcattgatggttatttgggttgattccatgtctttgctattgtgaatagtgctgcaataaagatatgtgtggatgtatctttataatagaattatttgtattcctttggatatatatcccagtaatgggattgctggatcaattggtattcctggttctagatcattaaggaatcgccacactgtcttccacaatggttgaactaatttatattcccaccaacagcataaaagtgttcctatttctccacagtcttgccagcatctgttgtttcttgactttttaataatcactattctgactggcataagatggtatcttattgtggttttgatttgcatttttctaatgatcagtgatgttgagctttttttcatttgtttattggccatataaatgtcttcttttgagaattctcggttcatgtcctttgcccactttttgatggggttgttttttcttgtaaatttgtttaagttccttgtaaattctggatattagacctttgtcaggcgggtagatcaaaaaaattttctcccactctctaggttacctgttcactctgatgaaaatttcttttggtgtgcagaagctctttagtttaattagatcccaattgtcaattttttcttttgttgaaattgcttttggtgatttcatcataaaatctttgcccaagcctatgtccagaatgttattgcctagattttcccccagggtttttacggttttgggttttacatttaagtctttaatccatcttgagttaatttttgtataaggtgtaaggaagggatccagtttcaattttctgtatatggttggccagttttcccagcaccatttattaaatagggaattctttcccccttgcctgtttttgtcaggtttgtcaaagatcagatggttgtagatatgtggtattattctgagatctctattctgttccgttgatctatgtgtctcctttagtcccagtactatgctgttttggttactgtagccttgtagtgtggtttgaaggcaggcagtgtgatgcctccagctttgctctttttgcttagaattgtcttggctgtacgggctctcttttttgttcaatatgaagtttaaagtagttttttctaattctgtgaagaatgtcaatggtagtttgatgggaatagcattgaatctataaattactttgggcagtatgcctgttttcatgacattgattcttcccaaccatgaggatggaatgtatttctgtttgtttgtgtcctctcttattttcttgagcagtggtttgtagttctcctaaagaggtccttcacattccctgttagctgtattcccaggtattttattctttttgtagcaagtgtgaatgggaattactcatgatttggctctgtgcttgtctattgttggtgtataggaatacttgtgatttttgcacattgattttgtatcctgagactttgctgaagttcctttcagcttaaggagatttgggctgagacaatgtggttttctagatataggatcatattgtctgcaaacagagacaatctgacttcctctcttcctagttgaataccctttatttccttctcttacctgattgccttggccagaacttcaaatactatgttgaaaaggagtggtgagagagggcatcctcatcttatgccagtttttaaggagaatgcttccagctttttcccactcagtatgatattagctgcaggtatgccataaatggctcttattattttgagatatgttccatcaatacctagtttattgagggtttttaacatgagggatgttgaattttatcgaaggccttttctgtgtttattgaaataataatatagttttttcattagttctgattatgtgatgaattacacttaatgttttgcgtatgttgaaccagccctgaatcccagggatgaagccgacatgaccgttgtggataagctttttgatgtgctggttttggtttgccaatattttattgaggatttttgcatctatgttcatcagggatattggcctgaagtttttttgttttgttttgtctctgacaggttttggtatcaggatgatgctggcctcataaaattagttaaggagaagccccaccttttcagttgtttggaattgttttagaagaaatggtaacagctcctctttgtacctctagtagaatttgtctgtgaattcatctgatactgggcgttttttggttgataggctatttattactgcctcaatttcagaatttgttattggtctattcaaggattcgacttcttcctactgtagtatggtgtggtgtatgtgtccaggaattcatccatttcttctagattttctagtttatttgcatagaggtgtttatagtattatctaatcattgttatatttctgtgggttcaatggtgatatcctttttatcactttttattgtgtccacttgattcttctcttttttcctctttattatgctagctacattaactttgcccagaagttaatgaagtttcttcatagtttcaataattttttcaaaaacccagctcctggattcatcgattttggaataatttttcgcatctccatctccttcagttccaatctgatcttagttatttcttgtcttctgctagcttttggatttgtttgctcttgcttctctagttgctttatttgtaatgttagggtgttgatttgagatctttctagctttctgatgtgggcacttagtgctagaagtttccctcttaacactgctttagctgctttccagagcttcttgtacattgtctctttgttttcattggtttcaatgaacttcttgatttctgccttaatttcattatttacccaggaatcatacatgagcaggatgttcaacttccatgtagtgcggtttttaatgagtttcctaatcctgagttctaatttgattgctctgtggtctgagagactgtttagtatgatttctgttcttttgcatttgctgaggagtgttttacttccaattatgtgatcgattttagagtaagttctgtgtggcactgagaagaatgtctattctgttgttttggggtggagagttctgtagatacgtatcagttacactagatccagagctgagcacaagtcctgactatccttgttaattttctgtcttgatgatctgtctaatgtttacagtgaggtgttaaaatctcccactattattgtatgggactctaagtctcttcgtaggtctctaagaacttgctttatgaatctgggtgctcctgtattgggtgcatatatatttaggatagttaattcttcttattaaattcatccctttaccgttatgtaatgcccctctttgtctttttacctttgttggctttaaagtctgtttcgtcagagactaggattgcaacccctgcttttttctgtttaccatttgcttggtaaattttcctccacccctttatttttagcctaagtgtgtctttctgcatgagatgtgtctcttgaatacagcacactgatgatttgggacactatccaatttgcgggtctgtgctttttaactggggcatttagcctatttacatttgaggttaacattgttatgttattaaattcgatcctgtcatcatgatgctagctggttattttgcccacaaattaatgcggtttcttcattgtttcattggtctttgtgctttaatgtgtttttagagtggctggtaccagttttacctttccttattcagtgcttccttcaggagatcttgcaaggcaggcctggtggtaatgaattccctcagcatttgcttgtctgaaaatgattttatttctccttcacttataaggcttagtttggccagatatgaaattctgggctgaaaattcttttctttaagaatgttgaacattggcccccactctcttctggcttgcagtgtttctgctgagagcttcactgttagtctaatgggcttccctttgtaggtgacctggcctttatatctggctgcccttaacattttgtttttcatttcaaccttagagaatctgatgattatgtgtcttggggttgatctactcatggagtatgttattggggttctctggattcctgaatttaaaagttggcctgtcttgctaagttggggaatttctcctggatgatatcctgaactgtgtttttcaacttggttcattctccctttctctttcaagtactccaatcagtcataggttcagtattttttcatagtcccaaggttcttgggggttttgtttgttccttttaattcttttttctctaaacttgtctgcctgccttatttcagcaagacagtcttcaagttctgatattctttcttctgcttgatcgattcagctattgatatttgtgtttgcattataaagttcttgtggtgtgtttctcagctccatcaggccatttatgttcctctctaaactggttattctagctagcagctcctgttaccttttatcatggttctcagcttctttgcattgggttagaacatgctcctttacctcagcaaagtatgttattatccacctttctaaaggctacttctgtaattcatctatctcatcctctgtccagttctgtgcccttgctgaagaggtgttgtgatcatttcgaggagaagaagcactctgtccttttgaatttttgcggttttttgttaattctttctcatcttcgtgagtttgtctagtgtcaatctttcaggctgctgacctttggatgaggtttttgtaggaacttttttgttgatgctgttattgttgctttctgtttgtttgttttcctttgaatagtcaggtcactcttctgtagggctgctgtggtttgctgagggttcacttaaggctctattcatctgggtccctcctgcacatggagatgtcacctgaggaggctgaagaacagcaaagatgggtgcctgctctttcctctgggatctctgacctcgaggggcaccaacctaatgtcagtaggaacactcctgtatatggtgtctgctgacccctgttgggggctgctgcacaactggggtgggcgcaggaaccaagacccatttaacgaagccctttggctgtcgcttggttgagggggtgtactgcacttggggcaaacccactcatctgggctgctagattcctcagagctagcaggaaggaagacgtagtctgcaggtccacagagaccatggccaccccttcccctagggattcagactgaaggaaatcagagttctgtccctaagcccccggctggagttgctggagttcctgcagggaggcctcacccagagagcagggatgggtcaggatctggcctacgaaggcagcctggccatgatctgccacagctggtatgctgcgctgtggggaatatctcctggaaccaagtagtccagtctccctggcaccagcaggaaaaaaacagctgcctggagctatagcgatggctgctgcccagcacccccaagagtccggtgtcttaagctgccagcagccacagtgatagctgtcatccctcccctgggaagctgagctgtcttaggcagccggcagctgcagtgataatggctatccctccctcggggagctcagttgtcttaggcagtcagtagccacagtgactaagtcagaaggcttagacagcaggcagccacagtgacgatggccacccacccctgcaggaactcttagccagattccagccaattgactgttgagaatctgaacagctctgtggttgtgacctaaggccctggtggtgtgggctcacaagtgggatcttctgatctgtgggttgcacagatctgtggaaaaagcagagcttcccaggctggatggcacgctcactcactgcctcccttggctggtgctggaggtgccccttaccccatgtggctctcaggtgggccgacacaccaccctgcttttcattgctctccattggtcatgcgaaccacctggtcagtcctgatgagagaacctggataccttggttgccagtataggattcacatgctgttttggttcttctcagtgggagcctctgaccaccactgcttctagtaggccatcttgggtctgcccctccttttcaactttttgatgtggaaattcagtactatgaattttcctcttaacactgccttagctgtatctcagagttctggtatgtgttatctttgttctcattatgttcaaataacttcttgatttctgccttaatttcattatttacccaaaagtcattcagaagcatgttgtttaatttccatataattgcatgattttgagtgatttttttatagtcttgacatctatttttgtcacactgtggtccaaggatgcgtttggtatgatttcagttctcttacatttgttgaagattgttttatgtccaatgatgtggtcaatttcagagtatgtgccatgtggcaataagaggagtatatattctcttgtttgggggtggagagttctgaaaaggtctatcagatccatggtccaatgttgcatttaactcctgaatatctttgttaattttctgactcaatgatctgtctaataccgtcagtggggtgttgaagtcttattgtgtgggagtctgtgtctctttgtaggtctctaagaatgtgctttataaatctgagttctctttgttgggtgcatatatatttagaatagctaggtcttcttgttgaattgaaacctttaccattatgtaatgcccttctttgtcatttctgatctttgctggtgtgaaatctgttttgtctgaaattaagattgcaacccctgctttttttctgttttccatttgcttgacagattttcctccatccctttattttgagcctatgagagtcattacatgtaagatgggtcacttgaaaacagcatacaattgggtcttgcttttttatccagcttgtctttctgtgccttttaactgggacatttagtccatttacattcaaagttagtattgatatgaatggatttgatcctggcattgtgctgttagctggttattatgttggcttgttcatgtggttattttacagtcacactggtcctgtgtgtttaaatgtgtttcatattagctggtagtggtgtttcctttctatacatggagcttctttcaagatctcttgtaaggcaggtctggtggtaatgaactccctcaacatctacctatctgaaaaggaccttatttctccttcacttaggaatcttaacttagctggatataaaattcttggttgaagattttttctttaagaaagttgaatataggcccccagtctcttggtttatagggtttcagctgagagtcggctgttagcctcatagagatccctttgtaggtaacctgctctttctctctaggtgactttaacattctttctttcatttcaaccttggaaaatctgaggtttctgtgtctcagggatgatcttcttgtgtagcatcttgcagaagttatctgtattttctgaatttgactgttggcctctctagcaaaattgggaaagtagtcatggattatatccttaaatatgttttccaagttgtttgcttttttcccttccctttcagggatgccagtgattcacagacttggcctcttaaaataatcccatacttcttggaggttttgttcattcctttttgttcttttttctctggttttgtctgactgtcttatttcagagaaccagtctccaaattctaagattctttacacagcttggtttcttctgctattaatacttgcaattccattgtgaaattcttgtattgtgttattcagctctgttagacctgttaggttcttttttataccagctatttcatccttcagctcctgtatcactttattgtgattttaaaataaaccaattttaaagcaggatttatattatcattattattccctacagagccaagtagtgtggccatacacaagtaacaaattttatgtcatcaaactcctgcctcttgaagaatatgtcatacatgagctaaaatgacttcttcattaattattttcactttactttgtctaggaaatgctcggttcatattcatctttgtctttatgtcaccattcttttgtttcctttttttatttcactggagcaactccacatatgaagacatagagttactaaactttatgaactattgcatgtcagaaaattattttcttgattcatttaattgaaactttaggtagagggagaactctatatccaaaatcatttcccctgagaaatttaagaaaatattacttcaccatctcctagccttgaaatgcggctaatgttgctaagctagtacctgacataagttatatttctcatccctttgtgggttacccagcgactttactctgtggaagcttcaaggatatttgctttagttaggatcttctgaaaatgaaaaaaaaagtgaaaaggacataggtatttttatatttatcctccttggcattctgttaagctcctcaaatcagtaacttatgtttttattcagcttgaaacaactttctgttttctatatcaaataattattgtctcaacattctgcttctagaatgctcagtaaacagatgttttgtttatgttcatcctccatttgtcacattttctttctatttataatcatctaatgcttatgtcatggtttttttaaaagaataaaaaatatttccctgggatgttgtaaaagaaataagtctttgatatgaaaccagaagtctggaagggagctatattttttatgcaaagatacaactgggaaaattaagctatcaaatcatcttttaagactgcagcatatccataagtaaaatacctgggaggtaaattttatttttatttaaagtaaataataaaattaattccattactttatacatttgagatattatttcaattttattttgagatcaataatttggatttttcattacatacacattatacacccacctgtttgaagtgtattgtcatttgcaaaagagatttaaaaaccaagctttctatgtgactaaactattctgcttcttgggtaaccagagtcccactgaataattttaattgcaaatgtttcatgtcagaaaagagaacactaaaaagaagttttcagatctaaagagggacaaagttaaaagaaaaatatgtaaattaagtcaaaaatattggtgaagcaacttgtcttcctttagagcagatgtgcaccatcttttttcactacaaagtttaacatatatatgtatagatacgttttaaatatatatatgtgtgtatatatatatatatttaaaacgtatctatacatatatatacacatactgccttcctatggatgctttcagaaatttccattgttttttcctactacctgtgatattatgatagaaataactttgaatccattcaatgactcctaagcataaaagcattatattagtaataaattagtcatggcatacttcacaatggatcctgaggtgtgtacaacaatgactcacttgaaaaatacagttgaactctaaaattcctcaagatgaagaaataatccattaaaacagcactattagttaaaaattactcagaatctactacatgtaaagaatattgctagatgattttaaactgtcttttgaatttataattacaaaaatctcatagaatagaacctgatgctgattttgactacatctcagattccaataatgcctcagaaaaaaaaataataagtccactcctgaatagctttcaccaaattaatctaattgctattatttccaagacattcagagttatattaactagcattgcatttgtcattcccttaaattagttcatcatgatcttgtaccagttattttacaatcaaaaatattacaaatcaactgttggcattatctcacgtagcagaattttatttcagcaagttatactctgttttcattgattagctacattttaaaccttgtttaataatcctgttttgaaatttgttattaacaatatcttctcaagatagtccaatttctacaaaaatgtattttaataacaccttgttcacaaaaggctacactgtaacatttgtctttctctgtttggagtgctataacaaaataccataaactgggtagcttgtaaatgaaatttatttctcacaggtctgcaggctggaaagttcaacaccaaggcacaagcagactcagtatctggagaggccctgcttcctcatagacagtatcttctctgagtcctcatggtaaaaggggcaaacgagcctgcctgggcctattttataagagtactaatcctatttatgaggtctccaccctcatgacataatcacctcccagaaagtgccacctcctaataccatcaccttgggagttaggatttcaacatatgaattttaagaggatacaaacatttagactctagcaacattatcactgggtccaactttttaactctaaattttactttgatatatttgtaaattcaatctgaattgctcaactactaattttttaatttaatctgcttcactgttttcaatttactcactactaggtatttattttaaaaaatggaaattcagaaaaatttatagccataccatttaacatacaggtcaacaggagtaaaaataaatcactcgggagtcttagatttcaagacgaattccattgaaaagagaaaacatttgcactatgagtaaaatgagttgaacctagtaaatcttttgctccatatacaacacagcaagttcagctttcatatatgtcctaagaatgaatgttctctgaccctacaagggatgttgcatgtaataatctctcatatagcaattctggactttggcatagcttgaagaattttgttgaactttaaaaatataaaagtatcggtctagccaaggaggttacagcacgctaccagttacctcactcaggtcctaatataatgtttatgttatgcagcctcctccatgatttctagataatgaaaatatttgattgtaggagtattcttaccatatctggtactttcatagttcttttggctcttgacaagaaagcagcatatttgttagtcaagttaggtaattcatcagaaattcccacaccctgtgaatgccaaaattcctgttgaaagaaggggttaaaaagagtacatcatttatttttatcaatacaagaggcactataaataataagtttgcaatgaagttcatcagtattatctggcattaaataaagacacatattcataaacaaataaaattttcaaaatatgacacagaaagaaaaagctgtaagtcaatgagatattaaaatggaaaaagaattgattatatgaacctctaggtaagtataatggatctgcacacattacttaaacatattagctatgttctatttcataaccagcaagttctgtctcaataatatattagtataagatacttagccaattatatagtattatttaacaatttattattaataaaaatatatttacatttaaccatttaattttgtggcaattctgggttaatatattttctaagcaaaatgatccactcactctcttaaatatcataattctttatatgcattgaagatttaaattaataggctagaggaatctagtaatgtaatatttcaatgagcaattaatccttgtgatactttctattttgtcatacaatttatttgtattcatttaattaaatagaataaacagcagcaacatcctttgtatatgcaaaaggggtaagaatctattttcccatttttttacacattttactgtttttgtttcagaatttgatattcatagttaatatttcagaatttgacacatagtagctaatagacatatttctttcttggcccattttttggtaacattaatttactaaaacatccattacccacctaatgtatctgtgacatgatctgcctctacccaaaatgctgaagatggcacttctccacttttttccacatgatattattccaacctatccactccagataatataggtagcttctatcactttcaaaaatagaacaatcacagtcacatcttttaaaaatgtgaaagcctttgaatatagaacatctaagccagcattattatttttgtgtagtttttaaattgtttgaagctgaaaaataacttatttttataataatttttatttcgatagcttttggggtacaagtggtttttccttacatggatgtatagtacagtggtgaattcttagattttagtgcacccatcacccacgtagtgtacattgtacccaataagtagttttttatccccctattctcctcccaccctcccctttctaagtctccaaagtccattatatcactctgtgtgtctttgcgtacccatggcttagctctcacttatcagtgaaaccatacagtatttggtttttcattcctgagctagttcacttagaataatggcctccagctccatccaagttgctgcagaagatattatgttattcttttttatggctgagtagtattccatggtgtatatataccacattttttctatccactcattggtcaatgggcactaagattggttccttatctttgcaattgtgaatttggctacaataaacatacacatgcaggtgtctttttaatgtattgacttattttccattgggtaaatacccagtagtgggattactagatcaaatcgtagatctatttttagttatctaagaaatctccacactgttttccacagagattgtactaacttacactcctaccattaatttataagcattctcttttcaagaccccaacatctattgtttttttgggtttgtttattggtttttgttcgttactttttaacactggccattcttggatgggtacagtggctcacacctgtaatcccaccactttgggaggccaaattaggcagatcacttgagcccaagagttcatgatcagcctgagcaatatggtgaaaccctatctctacaaaaaacacaaaaattagctgagtgtggtggcatatacctgtggtccctgctattggagaggctgaggtaagaggatccctggagcctgggagatcaaggctgcagtgagccataatcacactactgcactccagcctgggtaaggcagtgagaccctgtctcaaaaaaataataatagaaataaaggccattcttgcaggagtgaggtggtatctcattgcggttttaatttgcatttccctgatgactagtgatgttgaatattttttcatatatttgctggccatttgtatatcttcttttaataaatatctattcatgtcagttgcccactttttcatgaaactgttttattttcttgctggtttgtttgagttccttgtagattctgcatattagtcctttgcccaatgcatagtttgcaatattttctcccattctgtgggttgtctgtttactctggtggttatttcttttgctatacagaagctctgtagtttaattaggtctaatttgtttatttttgttttagttccatttgctttgggagacttagtcatgaattctttgcctaagccaatgtccagaagagtttttcttacgttatcttctagaatttttatggtttcaggtattagatttgtctttaatccatcttgagttgctttttatataaaatgagatgtagggattcagtttcattcttctaaatgtagctattcagttttcccaggaccatttattgaatagggtgtccattccccaatttatgctgttctatgctttgtcaaagatcagttggttgtaaatatttggctttatttctgcattctctattctgatccattgatctatatgtctacttttatataagtactgtgtattttggtaactacagccttgtagtacaatctgaagtccagtaatgtgctgcctccagatttgttcttttagctttgtattgctttggctaagcaggctcttttttgattccatatgaattgtaggattgtttcttttaattctgtgaaaaatgatgctggtattttgataggaattgcattgaatctgtcgattgctttgggcagtatggtcattttcataatattgattcttgcaatccgtgagaatgggatgtgtttccatttgtttgtgtcacctatgatttctttcggcagtgttttgtagttctccttgtagagatctttcaccttggttagtatattccaggatattttatcttttttgcagctaaaggagattgagtttatttcattctcagtttggtcattgttggtgtatatcagtgttactgatttgcgtacattgattttgtaacctgagacattactgaatttgattatcaaatctaatcttatctctaggcttatccagtcaacacttttgagaaatctctagggttttctatgatatataatcatatcattggtgaacagcaatagttttacttccttttttgcaatctaaatgcactgtatttccttctgttgcctgattggtctggctaggacttctggtattttgctgaatggaaagtggtgaaagtggggatcttcatcttgttccagttctcagtgggaatgatttcaacttttcctcattcaatataatgttggctgtgggtttgtcatagatggtgtctattaatttgaactaagtcccttttatacctagtttattgagggtttttaatcataaaaagatgctagattttatcaaatgcttttctgcagctattgagataaccatatggtttttgtttttaattgtttatgtgatgaatcatatttactgacatgcttatgttaaaccatccctgcatcccttgaatgaagcccacttgttcatgatgtattatctttctgatgtgctgatagattcagctatctagtattttgttgagagtttttgcatctacattcatcagggatattggtctgtagttttctttttttgttatgttctttcctggttctggtatcagggtaacactggcttaacagaatgagttagggaggattccttctttctcaatcttttgtaatagtttcaccagtaggattggtaccaattctttgaatgcctggtagaattcagctgtgaacccatctgatcctgggcttttttctttgttgtcaatttttaattactgatttaatattgctgcttgttattggtctggtctgggttgctatttcttcccaatttaatctaaaaaagttgtaggtttccaggaatttatccatttcctctagatttcctaggttgtgtgcatagtttgtgtttctagtttgtgttcatggctatctcaaatgatcttttgtgtttctgtggtgtaggttgtaatgtctccaattttatttctaattgaccttatttgaatctcctctcttcttttcttggttaatctagctaaagttatatcaattttatttgccttttcaaggaaccaactttttgtttcattgatattttgtattgattttttgttcaaatacatgtagttctactctaatctttgttacttcttttcttctagatttgggcttagtttgttcttgtttctcttattctttgaggtgttacattaggttgtcagtttgtggtctttcaggctctgatgtaggcatttagtgctacaaacattcctcttagcactgcatttgctgtatcccagaagttttgatgactcatgtcactattattcatttcaaagaactgtttaatttccaacttgatttcatttttaacacaaaaatcattcaggaacagattgtttaatttctatgtataggtatagttttgagggtttcttctggagttgatttctatttgtattctgctgtgatctgagaagatacttgctacagtttttattttttcacatttattgagacttgttttgtggtgtgtcatataggtctatcatggaaaatgttccatgtgctgatgagaagaatgtatattctgaaattcttaggtagaatgttctgtaaatatctgttaagtccatgtgttctagagtgtttaagaccattgtttctttgttgaatttctgtctcagtcatctgtatactgctgtcaatggggtgttgaagtcccccactataattgtgttgctttctatctcctctcttaagtcaagtagtaattgttttaaaaatctgagagctccagggataagtgcttatacatttaaaattataatatcttctcgttgaattgatccttttatcatcatataatgatcttctttgtcattttttactgctgttgctttaaagtttgttgttgttttatctaatataagaatagctactcctggtcactttgggtttccatttgcatggattaacttttaccacccttttaccttgagtttatataaatccctcaatgttaggtgagtctcttgaagaccaaagatatctagtttgtgatttttcttatctaatctgccaatctgtatattttaagtggaccattacgccatttacgttcaacataatatcaagatactgttccaatcaacatgtgaattgttacttacttttttttcttcattgtattattgttttataggccgtgtgagttttatgcttgcaagaggttctattctggtgcataatgggcttttgtttcaagatttagactccttttagcatttcttgtagggctggtctggtagtaaaaagttttctcagcacttatttgtctgaaaatgacgtagttttgctggatacaaaatttttggccgatggttatcctatttaaagaggctaaagataggaccccagtcccttctggtttgtaagtgttctgctgagaagtctgctgttagtctgaaaggttttcccttacaggttacctgatgcttttgcctcatggctcttagaattatttcattcacattgactttaaatagctagatgactatatgcctttgtgttttgttttttgttttttgttttgttttttgtttttgcaatgaatctcacatgagttctttgactttcttgtatttggatatctaaatcaccagcaaggccagggaagttttcctcaatttcctcaaaaaattattctacttattttaatctattgttaaaacctccactgcattttgtagttccctaaatgtgtctttcatttccagaagttctgatttgtttctttttaaaatatttatctctttagaaattttttcattcatatcctgaaatttttttaatttctttatgttaattttcacctttctctagtatctcaaataaattttccaaacattatactttctcttattcctcaaaacaccaattattattaggtttggccattttacataatctattatttcctggaaactttgttcatttctgttctttattctttatttttctctgactgggttagcttaaaagccttgtcttcaagcactgaaactctttcttctacttgttctagcctattgttaaaacctctaccacattttgtaattccctaaatgtgtctttcatttccagaagttctgatttttttctctttaaaatatgtatctcttcattcatatgctgattttttcaaaatttctttatgttggttttcacctttttctggtatctccttgaataccttagtaattaatcttttgaattcgttttctggtatttccaagatttcatcttggtttggatctattgctagagagctagtgaaactgccattgcaaaattataactgagaaaattatttcagtgaaagaccaacttcatctttcttctgacctccacgctgtccatgttcattgctgggcataagctgaactaactttgggaaaacttagtttatagtttaactttgaaacaaagacaataacagcccttttccaaaacaaacacccttcctgtttggagactagattgcctttgtaggactaacaaattagccacaagattagaaattatggtttaggagtcatgcagctggactcctctcatgctacctctacacaattctgaccctccccaaattgctcctggggacaatatcactattgtaaaacctaaggtcagtgtttgagatatttacagaccctgcacttgatgaatcagctggcaccatccagatcaactaactggtttatctggtcttgtggcccccacccagggactgactcagcacaagaagacagctttgactccctatgatttcatctctgacccaaccaatcaacactcctgactcactgtcccctacccaccaaattgtccttaaaatccccaatttccaagttttgggggagactcatttgagtaataataaaactctggtctctcatacagacagctctgcattaataacattttctctattgcagttcccctgtcttgataaattggctctctccaggcagcaggcaaggagaacccattgggtggttacactagtgtgacctttgggtgtattgcagaaccttgttttgtcatattatcagaattatttttctggttccttctcatttgggtatactatttcttctaattattcttgaaattatgttttatttgactgtgtttttttttatttctttttccccccttaagactgtgactttaaagcttatagtttaatgtagcctaattcagtaattggtgcattcaggagtgaagaccctgtgtgagagctttagttatagagactctttgcatgataaccttctcagatgcttctcggtagcaacatgctcagtgtgtgagcaagttcactatatcctacggagttggaatagcagaggtctcttgaagcctacttcattcccccatgatgtgtgcttttaattaatttatttattcaccagtattttatttactgggttgaacaactcaggcttcaggctagtaggataggcgtcccagggaagaaactggttgtgattaaagcaggtgggtaaatgcaatatgtaatggtaggcagaggtcccagccttgacagagctggctggaggttgggagaagctctcagagaagtacactgaggtcttatcaggggaaagggtgggagctacctccgcccctgtgtcagggcagcagaaaagcaatccacattccagacacactcatgacccattgttccagtattcctgctattccatcagacaggcacctattttcatcttcaggaatgttgatgttccaagtatagaggagttctgactctacctctcaaccacacctgaacctgaaaggtgcatcctccaggatgcagtcaccctgaaatgtttgaaaaaggttgtctaggtgcacccatgctgaacacctgtaagagaagacccagttgtgtcttgcagtggtggatgggaggaaaaagaattccccttctccaagacccttcatgagcaccagagctgcctgactgttggggtacagctgcagactttccctgctgaacccagtactgcaactgtgcctctgaagaaagaaacttcccaacagcaaaaagatctgggactcaaggcctgccagctggattcttttgtcccatggagcgtccccttaatgtggcatactttcctttcgcctaggaccaggagtccctgagagccaggccactatgaatgctgctgttcctctgggtctagtaacccagtggagttgccacactccaggttggtgctgggaaagtctgcaagggatccactgatgtaacagttcctcaagtctcccagcatcaggtaccagcaccatctctgatggggatggcaggggagggtcatagactctatgagattccttcgttataaatagccttagtgtgttggttttctcaaatgctggtggtggtagtaatgaactggtcacatggacagactcaggacctctggttagccaggttggtagccagaatgatacagacaatagtgatagcagaggtcatgcacaagttttctcctttctgggcacattgttgttctacttggagatactgtaatgcattgtgtcagtcagcctccagccaggaggtggtgcttgcaaaagagtctcagttgtggtagtagtggtgggatttgtacttgccttatgttacccaggggagatactgtggtttctcaggtgacgggcagagctatagagctcccaaacatttctgtcctttgtgttaagctattagggcaaacggaggagcaaagccaggtgggggctccatcaggtagctccacgctctgactctacccatgcagggcagcagtggccccagtgagcatcagaggaattcgttggccactagagtaatgttctatggaggagcatatctgcctctgatgtacaaatgagtttgtacagggagtcaggagtagcaggtggcagtaaaccccgtccagctcccatgcacttggcaaagcaaaactcacacctgctagcaacagctgtctaagttctaggcacttaatgctcagaactcaaaatgccccaggccataagccttccccacagagactgcaaccacagctttcaggccatgcttctcccagtctgcctgtaaagctagggtgtgcagctcctgcacttgtggctgcagcacacttcccaccttctccctgcctgagttaactagaagatttttgtgagatccccccatgacacagaatcaggaatggcttcccttggttcacactggagaccaaaaatgcctgcaaggctcttcccacactgctcctactttcatattccccattgctccttaaatcagttctagcactgggtagagttaaggtgttcccccatgggcagattgccaggttccccagttggggtgtgtatcctggaggcattctctctgcctttcacactctgaggaagaagtttttcacatggctcacagtgtgggctgccagcctgccacttctttcaaagggtctgtgatttatttcagttttcctgttaagttcctgcattgcttctcagaaaaaaagttcacagtgagaattgctatacactattttgtctttccaaatagaataggcattgtaacacttgcctccaatctgccatcttggaaaaaagaaactacaataattttattactgtcatatatatggtactagaaattattacgttaaaaatttccaaaacattttgcagtttttagtacttaggaggtaaaagttaccaactttgaatgaaattaccaagaaattaattacttattggatggctttggctctagaggaaatgagtagtttacaaaagaccacatttctacatgaataattaaaaagaaattcaggcaaaatgtaacaagatcctatttttaaagacctcattgagttgtagaagtaccatagaccagaagcctacgattctgatgagggtagacctctgagaggtgagctactggtgtgcaggtgcactctccctcagggcattttctgataaaggcaacagagtaaaaatttgagattagcctggcagagaaatgctgctaagcaactgtgtcttcttgggccagaatgacaaaattgcacatttgaggagcctcaaagcacatggcctatttcttgatcaaggtatttgtaaggagtaaaggcagtgtgaagctaaaaatctaagccaaaaaactgaaatacagaggcatcaaagagtaaagttaagaacctgatagaaggaccctcaaaaacatcaggctcatgtttgatatccccatagtactacacttaagaaaatgaaacaaccaagaggtaaattaagtaatggcaaaaatgtaatcagcacagttcataattgggttaatgtaattttatcttcacctgtatctaccttgcagaggaaagtgtgaaatttcactagtagaaaataacatcatttagaatctttacaatgttttatatgcagtatctggcaagctattaaaaattatagggcatgccaaaaaacagaaggcatggtcaaaaatcaagagaaaaaaaacataaaataacagactaatggatgatccagatattagagttagcagacaagaacttttttaaaactatgattaatgtgttcaataaaacagatgaaaaaatagaaaagaaatagttgaaatcgtaaataatttgtcctgagaaatgaattatttaagaaagaattaaacaggcattctagaaataaaaaaatacaatatctgaaattaagaactcaatagattgatttaatggtagttgaaatagatgaaaaaaagtagtgaattaaattataactcagtaggaaatatctaaactgtagcatgaaagcaaaaaaagttgtaatacagaagaatttttttttttttttttttgagacagcatctcactctgtcgcccaggctggagtgcagtggcacgatctcggctcacggcttgctccaccttatgggttcacgccattctcctgcctcagcctcctgagcagctgaaactacaggtgtctgccaccatgcctggctaatttttttgtatttttagtagagacggggtttcactgtgttagccaaaatggtctcgatctcctgacctcgtgatccacccatctcggcctcccaaagggctgggattacaggtgtgagccaccgcacccggcctaatacagaagaattctaagagtgttcgaggcatggtgaatagttctaacacatatatttatgagagtctcagaaagacagcaagaaaaaatatgacaaaatacataaaagataatagccaagaattatttaaaaccgataaaggacataaacccacagattcaaaggttctgcaaacctcaggctaatgtattaaaaagaaaacaacacttcagacacatcaaaggttaaaaaccaaagacaatatctctggaaggagaaacaataagctggacagcttacttctcaatggaaaagatggaaagtctaaaaaaacaaaatattattaaagtgctgaaaataatcaccagcctaaaaatctatactcaaaaataaatcattcaaaaataacaaaatacatttcagacaaacaaaaactgtaataattcagcagcagacctggaccagaagaaatgctaaaggaagtttttcagacagaagaaaaacgattccatttttcataaaaatgcaaatgcaaaaaggaatgaagcacaatagagaaataaataaaaaaagtaatccacacaacaaaataataatattcaaaaaacttaaaatatgtagatttaaaatgtttgacaataattaaacaaaatacaagataacaaaatggagttaaaatgttctgagtcagtcttattgagaaagtggtaaaggtcatccttcttattggattgcaatacatgaatgcttattgtaattttcatggcaaaaactaaaagaatagtaaaaaaactaaaaatgtaatattgatgaaatgaaataaaataaaatatttgattaatattttatttgattataatatttgattaatccacacagaaagagataagaaaaagtggataatgggaatcatggcagacaggaggcagaactagatggcatcccacttggaaggacagagcagtgtgtggagtctcagaccatgaacttttgctccagacctaccacagaaataaatcaagaaagctgagagaacacacagacccactgaaaaaagcagattgctcctgcaggagccaggagacaccccaaatattgtgctggtatccatggctgagagatccacatatggttcacatcacagaactctgcgcagacaacccccagtagcagcccagagcctaatagacctgatgggtggctggatccagaagagacataacaattactacagcttggctcacagaaagccacacccctaggaaaagggggagaataatacagcaaggggacaccccatgggacaaattaatcttgtttcccttgaaaacagccttgagtcctacacctttcctctgacagagcctacccaaatgagaaggaaccaaaatcccaactctggtaataagacaaaataaggttcattaacatcctcaaaaaatcacattagctcaccagcaatggatccaaaccaagaagaaatccctgatttgcctgaaaaagaattcagaggaaagttattaagctaatcaaaaaggcgtcagagaaagtcagagcccaatttaaggaaataaatatatatatatgtgaaatatacataggtgaaatatacatgtgaaatatacatgtgaaatatatatgaaatatacatgtgaaatatatatgaaatatatatgtgaaatatatatatgaaatgaaggaagaaatattcaatgaaataaacagtataaataaaaaacaatcaaaacttcagtaaacaatggacacactaatagaaatgcaaaatgctctggaaagtctcagcaatagaatgtaacaagcagaagaaggaacttgaagcttgaagacaatgttttttaattcacccaatcaaacaaagacaaagaaaaaaaataagaaaatatgaacaaagcttccaagaagtctaggattatgttaaacgaccaaacctaagaataattgagaaagaagggaaatctagaagtttggaaaacatacttggggaagtaagtgaggaaaacgttcccagccttgctaaagacctagacatccaaatacaagaagctgaaaaaacacctgggaaattcatcacaaaagatcactgcctagggaaaatgttatcaggttatctaaagttaagaggaaaaaaacaatcttaagagctgtgaggcagaagcaccaggtaacctataaaggaaaacctatcagattaaaagcagatttctcagcagaaaccctacaagctagaagagattggggccttatcttcagcctccttaaacaaaacaactataagccaaaacttttgtatccagtgaaactgagcttcaggaatgaaggaaacatacaaccttttcagacaaacaaatgctgagagaatttgccactaccaggccagtactacaagaactgctaaaaggagccctaaattttaaaacaaatcccagaagcacatcaaaacagaacctctttagaccataaatctcacaggacctacaaaacaaaaatacaactaaaaacaaaaaacaatggcccagtgcagtagctcacactggtaatcccagtactttgggaggcagaggggggacagatcacttgaggtcaggagtttgagcctagcctggccaacatggtaaaaccctgtctctactaaaaatacaaaaattagccaggtgtgatggtgagtgcctctaatcccagctacttgaaaggctgaggcacaagaattgcttgaacctgggaggtggacattgcagtgagccaagattgagccactgcactccagcctgagtgagagagtgaggatgtgtctcaaaaaaaaagaaaagtaaagaaaaaaaccaaggtatacaggcaacaaatagcatgataaatggaatagtacctcatatctcaatactaacattgaatgtacattgcctaaatgctccatttaaaaaatacagaattgcagaaggaataagaatttaccaactagcagtctctgctccattcaggagactcacctgacacataagaactcatataaacttaaggtaaaggggtggaaaaagacactccatgcaaatgaacaccaaaagccaggagaagtagctcttcttatatcagacaaaacaaactttaaagcaacagcagtttaaaaagacaaagaaggccttgtccaacaggaaaatatcacaatcctaaatatatatgcatctaatactggagctcccaaatttataaaacaattactactagacgtaagaaatgagatagacagcaacacaataacagtgggggacttcagtacttcacgcacagcactagacaggtcatcaagacagaaagtcaacaaagaaacaatggatttaaactatgccctatgacaaatggacttaacagatctttacagaacattttacccaacaattgcagactatacattctattcatcagcacatgcaatgttctccaagatagaccatatgataggccatgaaacaagcctcaataaatttaagaaaactgaaattattacaagcactctttcagaccacagtagaataaaacacgaaatcaactctaaaaggaaccttcaaaatcatgcaaatagagggaaattaaataatatgctcctgaatgatcactgggtcaacaatgaaatcaagatggaaattaaaagattactcaaacagaacaatagtaacacaatctaacaatacctttgggatacagcaaaggtagtgctaagaggaaagttcatagccctaaatgcctacaccaaaaagtctaaaagagcacaaacagacaatctaaggtcacacctcaaagaactagagaaacaagaaaaaaccaaacttaaccccagtaaaagaaaggaaataaccaagatcagagtagaataaatgaaattgaaactatacaaaagataaatgaaacaaaaagaaaaaagataaataaaattgataggccattagcaagattaaccaagaaaagaagagagaaaatccaaataagctcaattagaaacaaaatgggacatattacaactgacaccacagaaatacaaaagatcattcaaggctactatgaacatctttatacataaaaactagaaaacctagaggagatggataaattcctggaaagatacaaccaacctagcttaaatcaggaagaagcagataccctgaacaaaccaatagtgatattgaaatggtaataaaaacttaccaagaaaaaaaaaagtccaggaccagaaggattcaaagctgaattctaccagacattcaaagaagaattggtaccaatccttttgacactattcaaaacgatagagaaagagggaaacctctctaaatcattctataaagccagtatcaccctaataccaaaacatggaaaggacataacaaaaaaagaaaactacaaatggatatccctgatgaacatagatgtaaaaatccttaacaaaatactagctcactgaatccaaagacacatcaaaaagataatctaccatgatcaagtaggtttcacaccagggatgcagggaaggtttaatatatgcaagtcaataattgtgatacatcacataaacagaattaaaaagaaaattcacatgatcatctcaatagatgcagaaaaagcatttgacaaaatccagcatcactttatgattaaaattctcatcaaaatcagcatagaagggacaaatctcaatgtaataaaagccatctatgacaaaccacaaccaacataatactgaatggggaaaagttgaaagcattccccctctgagaactggaacaagacaaagatgcctactctcaccacttctattcaacatagtactggaagtactagccagagcaatcagacaacagaaagaaataaagggcatgcaaattggtaaagagaaaataaaactgtcactgtttgctgatgatatgattgtatacctagaaaaccctaaagactcctccaaaaagctcctagaactggtaaaagaattcagcaaagtttccagatacaaaattaatgtacacaaatcagtagctcttctatataccaacagtgacaagctaagaatcaaatcaagaactcaaactttttacaatagcttcaagaaaaataaaatacttaggaatatacctaaccaaggaggtgaaagacctctacaaggaaaactacaaaacactgctgaaagaaatcatagaccacaaaaaacaaatagaaacacatcccatactcatggatgggtagaatcaatattgtgaaaatgaccatattgccaaaagcaatctataaattcaatgcaattcccatcaaaataccatcatcaccctcacagaactagaaaaaatatcctaaaattgatatagaatcaaagaaaagcccacatagccaaggcaagaccaagcaaaaagaacaaatgtggaggcatcacattacctgaattcaaactacactacaaggccatagtcactaaaacagcatggtactggtataaacataggtgcatagatcaatggaacagaatagagaactcggaaataaacctaaatacttacagtcaactggtcttcaacaaagcaaacaaaaacataaaatggaaaaaaaaaaacaccctattcaacaaacgtgctgggaaaattggcgagccaaatgtaggagaatgaaactgaatcctcatttctcaccttatacagaaatcaactcaagatgggtcaagaacttaaatctaagatctgaaactataaaaattctagaagataacaccagcaaaaaccttctagacattggcttaggcaaagatttcatgaccaaggagaacccaaaaacaaatgcaaatgcaataaaagcaaagataaatagctgggacttaattaaactgaagagcttttgtatggcaaaaggaacagtcagcagagtaaacagacaacccatagagtgggagaaaatcatcataatctatacatctgacaaaggactaatatccagaatctacaacaaactcaaccaaattagcaagaaaacaaacaatcccatccaaaagtgggctgaggacatgaatagacaattctcaaatgaagatatacaaatagccaacaaacatatgaaaatgatgctcagcatcattaatgatcaggtaaatgcaaatcaaaactacaatgtgataccaccttactcctgcaagaatggccataatcaaaaaatcaaaaaataatagatgttagtgtggatgcagtgaacagggaacacttttatactgatggtcagaacgtaaactagtacaaccactatggaaaacattatcgagatttcattaaaaacttaaagtagaactaccatttgatccagcaatcccactactggttatctacccataggaaaagtagtcattatatgaaaaagatacttgcacacgcacgtttatagcagcataattcgcaattgtaaaaatgtggaaccaacccaaatgcccatcaatcaatgagtggataaagaaactgtggtacatgtctacaatgaaatactactcagcaataaaaaggaatgaattaatggcattcacagaaacctggttgagactggagactattattcttagcgaagtaactcaggaatggaaaaccaaacatcttatgttctcattcatatgtgagacctaagctacgaggaagcaaaggcataagaatgacacaatgaactttgaagactcagggggaatgggtggaagggaaagaggaataaaggactacaaattgggtgcagtgtatattgctgggatgatggatgcaccaaatctcacaaatcaccactaaagaatttattcatgtgaccaaacactacctagtccccaatagcctgtggaaatttaaaaaaaaattaagtggcaaaacaaatggaccaatacaatacataaaatagtgtaatacgtatacacacaaacatgttgataatcaaattaaacataaatcaattgatactgcaattaaacacaaggtttaccagactgaatttttaaaaatcagacatgtttagggtttatatttcactcttgattttagattttgtcaaatattctataaactgagtcttagttacacctgtagatagttttaaattgtcaacaagaatagcaaatttactgagtccttactgtgttccagaagatattcaaagtgttttttgattcacttagtattgcaacaacacttttaggtatgtactattatgatcttcattttactaagtacaaagagtttaaataacttgcacgagatcagtggcagagcaaaaaagtatattcaaacactctgagtccagagatcatgctaataatcactgtgctaggcttctcaatatctacagtgaagaataaatactataattctggctgggtgtggtggctcacgcctataatcccagcactttgggaagctgaggcaggtggatcatgaggtcaggagttcgagatcagcctgaccaacatggtgaaaccccatctctactaaaaatacaaaaattagccaggcatggtggcacacacctgtaatcccagctactcaggaggctgaggaaggagaaatgcttgaacccgggaggcagagattgcagtgagcagacatcgcaccattgtactccagcctgggcaacagagcaacactccatctcaaaaacaaacaaacaaacaaacaaacaaaaaaacaataattatttttatctaaatgtcaggttactaagaataatgaactgttagtacattttaaacaaaatatagcagaaatgttccaaaaactattaacattcatgatggatttaaaatatacttatatcagcacttaaaatagttaataaatttaatattatgttttttaccacaaaaatatatactgggcgtggtggctcacccctgtaaccccactgctttgggaggcagaggcagggggactcgtgccaggagttcaagatcatcctgggcagcaaagtgagaccttgtctctatgaaaaatttttttaaaatagccaggtgtaacggcccatgcctgtggtcccagctacacagaagactgaagcaggaggatcacttgaacccaggagggcaagggtgcagtgagccatacctgcaccattgcactccagcctgggcaagagtgagaccctatttgaaatacatatatatataaatacatatatatgtatttgaaatatatatacacacatatatatgtatttgaaatatacatacacacatatatatttatttatacttatatcggactaaatgaacaatagaaattaaagacaaatatcaaaggttgatgacagatagaaactcaaactgaaagtctagaaatctagcaatctaaaaaaattaatttagagtacatgtaggtatgttaaacttgttcttatatttaatgttcttaaatttaatgaaaaataaattaaattggcagaaactagagagctattttgaggaggctatcagatgcaccactgggacctgtgggagcaaaatataataaaagaaaaatgtctgtaagttaatgatatgtgaataggaaggactatgatgggtctgaaattttgccctacttcaagttacaaaggtgacctgccacagtttcacagaaaaatgcaaaactcctgagtcagagacaaaggactttattcctcatggcataacaaacagcatgagaacagcacacttgcatcagtcctccttgccctaaagtcttactggggacaaggcagatggggcaaaataaacactagcacacaaaatgggagaaaaactgtgagttctgggaacgtggatcttttataatgagcagtaagcacaccctttgctgaggagggagacattgtatctttgaaggcaatcatccttaaaaaggatgtacaatcatccttaaaaaggaggtgcaagcaaaggtgtgtagaaacacaaaacacacagagaattgtctcttaatgataaaaaaagaataaaaatagatgtttgcacagaatatagacttatttgagcacacttacatagaaaaccctcagaaaaataagttttaatgaacattaaaaacctgaaaaaactaatatctaaattataagaatcccacaaatataataaaataaataacaattcatgtatcagcaattaagggcaacagatttcaaagtagttatataacaattcttacctttaaattgttacacatattttttctggtttgcttttcattgttccttctgttgttgtcttaaaatcacactatacatcttaaaactgtactacacaaaattcagttattacttgtactgaattgaaatatgaatctctgcagttttcacctattggtcttgacagaatcccatatgtagtgccattccaagatggccgaataggaacagctctggtctgcagctcccagtgtgattgaggcagaaggcaggtgacttctgcatttccaactgaggcacctggttcatctcactgggacttgttggacagtgggtgcagcccacagagggcaagccgaagtaggacagggcatcacctcacccaggaagcgcaagaggttgagggatttccctttcctagccaagggaagccgtgacagactgtacctggaaaattgtttcactccagcccaaatactgtgcttttcccatagtcttagcaaccgacagaccaggagattatctcctgtgcctggctcgatgggtcccatgcccacagagccttgctcactgctagtgcagaaatctgagatctacctgccaggctgcagccagccagggggaggggtgtctgccattgctgaggcttgagtaggtaaacaaagcagctgcgaagctcaaactgggcagagaccactgcagctcagcaaggcctactgcctctatagactccactttggtgggcagggcatagtgaaacaaaaggcagcagacagcttctgcagacttaaatgtccctgtctgacaactctgaagagagcagtggttctcccagcatggcatttgaactctgagaacagacagactgcctccacaaatggggccctgacccccacgtagacgaactaggagacacttcccagaacgggctaacagacagctcatacaggctggtgcccctctgggacgaagcttccagaaaaaggataaggcagcaatatttgttattctgcaacatttgctgttctgcagtctccgctggtgataacctggcaaacggggtctggagtagacctccagcaaactccaacagacctgcagctgagggacctgattgttaaaaggaaaactaacaaacaaaaaggaatagcatcaacatcaacaaagaggacatctatgccaaaaccctatctgtaggtcaccaacatcaaagaccaaaggtagataaaaccacaaagatggggagaaaccaaagcagaaaagctgaaaattctaaaaaccagagtgcctcttctcctctaaaggattgcagatcctcaacagcaacaaaacaaagctgggtggagaatgactttcaccagttgacagaagtaggcttcagaagatcagtaaaaagaatcagtaatgagcttctccgagctaaaggagcatgtttgagcccatcacaagcaagctagctaaaaaccttgaaaaaaggttagacgaatggctaactagaataaacagtgtagagaagaccttacgtgacctgacagagctgaaaaccatggcacaagaacttcatgatgcatgcacaagcttcaatagctgattcaatcaaaagggtatcagtggttgaagaacaaattaatgaaataaagtgagaagacaagtttagagaaaaaagagtaaaaggaaccaacaaaacctctaagaaatatgggactatgtgaaaagaataaatctacctttgattgttgtaccagaaagtgatgaggagaatggaaccaagctggaaaacactcttcacaatattatccaggagaacttcctgaacttagcaaggcaggccaacattcaaattcaggaaatacagagaacacaacaaatatacttcttgagaatagcaaccccaagacacataattgtcagattcaccaaggctgaaatgaagaaaaaatgttaagggcagccagagagaaaggtcgggttacccacaaagagaagcccatcagactaacagcggatctctcagcagaaaccctacaagccagaagagactgggggacaatattcaatattctgaaaaaggattttcaacccacaatttcatatccagccaaactaagcttcataagtaaaaaagaaataaaatccttaacagaaacgcaaaggctgagagattacaagagccttataagagctcctgaaggaagcactaaccatggaaacaaataaccagtaccagacactgcaataacatgccaaattgtaaagaccatcaatgctaggaagaaacagcatcaactaatgggcaaaataaccagctaacatcataatgacaggatcaaattcacacataaccatagtaaccttaaatgtaaatgggctgaatgccccaattaaaagacacagatgggcaaattggataaagggtcaagactaccagtgtactgtattcaggagatccatctcacatgcagagacacacacaggctcaaaataaagggatggaggaagatttaccaagcaaatggtaagcaaaaaaaaaaaaaaaaaagcagtgatggcaatcctagtctctgataaaacagactttaaacgaacaaagttcaaaagagacaaggccattacataatggtaaagggatcaattcaacaaaaagagctaactaccctaaatatatatgcacccaatacaggagcacccagattcataaagcaagtccttagagacctacattagactcctacacaataataatgggagacttgaacaccccactgtcaatagtagacatatcaatgagacagaaggttaacaaggatatccaggacttgaactcagctctgcaccaagcagacctaatagacatctacagaactctccaccccaaatcaacagaatatacattcttctcagcaccacactgcacctattccaaaattgaccacatagttggaagtaaaacactcctcagcaaatgcaaaagaacagaaatcacaaaaaaactgtctctcagatcacagtgcaatcaaattagaactcaggattaagaaactcactcaaaaccgcacaattacatggaaactgaacaacctgctcctgaatgactactgggtacataacaaaatgaaggcagaaataaagatgttctttgaaaccaatgataacaaagacacaacataccagaatctctgggacacatttaaagcagggtgtagagggaaatttatactactaaatgcccacaagagaaagcagaaaagatctaaaatcaacaccctaacatcacaatcagaagaactagagaagcaagagcaaacacattcaaaagctagcagaaggcaagaaataactaagatcagagcagaactgaaggagagagagaaacaaaaaaaccttcaaaaaatcaatgaatccaggagctggttttttgaaaagatcaacaaaattgagacaccattagcaagattaataaagaagaaaagagagaagactcaaatagatgcaataaaaaatgataaaagggatatcaccaccaaccccacagaaatacaaactaccatcagagaatactataaacacctctacacgaattttgaatcactgaatcgaccaataacaggttctgaaattgaggcaataattaatggcctaccaaccaaaaaatttccaggacaagatggattcacagccgaattctaccagaggtaaaaagaggagatggtaccattccttctgaaacttccaatcaatagaaaaagagggaatccttcctaactcattttatgaggccagcatcatcctgataccaaagcctggcagagacacaacaaaaaaagagaattttagaccaatatccctgatgaacatcaatgtaaaaatcctcagtaaaatactggcaaaccaaatccagcagcatatcaaaaagcttatccaccaagatcaagttggcttcatccctgagatgcaaggctggttcaacatatgcaaatcagtaaacataatccatcacataaacagaaccaatgacaaaaaccacatgattatctcatcagatgaagaaaaggcctttgacaaaattcaacagccttcatgtgtagggagaccccctgaaactattgctatggaataaaagatgaaatgcaactgattattgtaaatacaaaattgcatgcaggattgtgtaaagacaatgccaggctgggctgccagaatgagccaacagcgcgtgatgtgcttccccctgcagagagcctatgaacggatgtgcagtcagggaggtttcacatcaccaagattcctatcccaaaaaagcaaaggttcatagctctgggaatggaatgcaacccttgtggagagcctataaacagacgcatgaagggcgcctgttcatatggataagatagggctataaacaccctcatcttgccacggctcttctaggtctttttagggttaagacatactcccttctgagaatttctggtctaaccagttgtctagtttcaggtcctgtatctatggattgtttgtaaacagcttttgctgcaactgttactgctgattaatatcgtgctaatcataggttatggaaagacagtgtttctgttttaaggctgttaggaattgctgatgcacacactatgtcgtaaattcttatttctgtatgctgtacttctgcacagatgttatgtcaaagaattacttcatccccatgtgaccatctcacctcataatcaaatgaccgtaaatctctcactaacctacccctgccctcactaaacttaataacaaatgctggcatatccagtgcattggcagcatcacaggaccaaaaggcagtgacccccctggacccagctttcactattttctgtgtttcttttatttcttgacctgccgatccacctgggaacaaagagacagccccgttgcattgcgggctgctggccagatcccgcaatattcatgttaaaaactctcaataaactaggtattgatggcacgtatctcaaaataataaaagctatctatgacaaacccacagccagtatcatactgaatgggaaaaaactggaagcattccctttgaaaactggcacaagacagggatgccctctctcaccactcctattcaacatagtgttggaagttctggccagggcaatcaggcaggagaaatcaataaagggtattcaatcaggaaaggaggaagtcaaattgcccctgtttgcagatgacatgcttgtatatttagaaaactccatcgtctcagcccaaaatcttaagctgataagcaacttcagcaaagtctctggatacaaaatcaatgtacaaaaatcacaagcattcttatacaccaataacagacaaacagagagcccaatcatgagtgaactcccattcacaattgcttcaaagagaataaaatacctaggaatccaacttacagggatgtgaagaacctcttcaaggagaactacaaaccactgctcaacgaaataaaagagaacacaaatgaatggaagaatattccatgctcatgggtaggaagaatcaatattgtgaaaatggccatactgaccaaggtaatttatagattcaatgccatccccatcaagctaacaatgactttcttcacagaattggaaaaaaactattttaaagctcatatggaaccaaaaaagagcctgcattgccaagacaatcctaagcaaaaagaataaagctggaggcatcatgctacctgacttcaaactatactacaaggctacagcaaccaaaacagtgtgctactggtaccaaaacagaaatacagaccaatggaacagaacagagccctcagaaataacaccacacatctacaaccatctgatctttgacaaacctgagaaaaacaagaaatggggaaaggattccctatttaataaatgatgttgggaaaactggctagccatatgtagaaagctgaaactggatcccttccttacaccttctacaaaaattaattcaagatggattaaaggcttaaatgttagacctaaaaccataaaatccctagaagaaaacctaggcaataccattcaggacataggcatgggcaaggacttcatgtctaaaacaccaaaagcaatggcaacaaaagtcaaaattgacaaatgggatctaattaaactaaagagcttctgcatggcaaaagaaactatcatcagagtgcacaggcaacctacagaatgggagaaaatttttgcaatctacccatctgacaaagggctaatatccagaatctataaagaacctaaacgaatttacaagaaaaaaacaaccccagcaaaaagtgggcaaaggatgtgaacagacacttctcaaaagaagacagtaatgcagccaacagacacaaaaattgctcatcatcactggtcatcagagaaatgcaaatcaaaacacaatgagataccatctcacaccagttagaatggtgatcattaaaaagtcagaaaacagcagatgctggagaggacgtggagaaataggaatgcttttacactgttggtgggagtgtaaattagttaatcattgtggaagacagtgtggcaattcctcaaggatctagaactagaaataccatttgacccagcaatcccattattgggtatatacccaagggattataaatcatgctactataaagacacatgcacacatatgtttattgcagcactattcacaatagcaaagacttggaaccaatccaaatgtctatcaatgatagactagtttaagaaaatgtggcacatatacaccatggaatactatgcagccataaaaaaggatgagttcatgtcctttatatggatatgaagctgaaaaccatcattctcagcaaactaacacaaggaaagacgaccacacaccgcaggttctcactcatagatgggaattaaacaatgagaacacttggacacagggcagggaacatcacacactgtagtctgtcgtggggtggcgggctgggggagggataacattaggagaaatacctaatgtaactgatgagttgatgggtgcaggaaaccaacatggaacatgtacacctatgtaacaaacctgcacgttctgcacatgtaccccagaacttaaagtataatgaaaaaaaataaacaaaataaaataaaatcataatttaaaaaaatagaatcccgtatgtcacacagaactttctccatattagaaagctttccattttaaaaccaattgtctggtttattctccctaagtctttacttctctatattaagcatcttcatttttttcaaatgttctttgtgctacgtggtttaaacttatgtgccttcacctttctgatcaccttcccatgaacaaatccccagagcatattttttcaaacgctatatttttcatctctagaaattcaatttgtgttttttatttctgccatttctctattatgtaatatgttcaatatttctcctactttccttaacatatggaacatggttataataactatttgacatccttttctattaattataacatgtaatttcaagagaaccctaagagcttgatattcaacataaagaatattatttttgtatgaatgtattacctgataatcagcaggtccaggggtagcacaagcttctttctgaaccgagaagaaagtccgaggaacagaagaaccaaatgcacttttcttctgtttctttgagcagatatttctaacactggcaattatagtattgttcaagacattataaaatccaggacctaaaattattagaagtatcatatataagaataagcatgcttttatatgcaccttttgaactgagtaatttttaattaagggtttttttctaaataaaaaaccctcacatatttctggcataaatgtaaaatggcatagtcgcattttaaaatttggtcaaatttttatacagttaacatatacttgctgatatggttttgctgtgtccccacccaaatctcagcttgaattgtaattcccacaattccatgggaggaactgtcataggaggaacccagtgggaggtaattgaatcatgggggtggatctttcccatgctgttcttttgatagtgaataagtatcacgagatctgatggttttaaaaataggagtttccctgtacaacctctcttctcttgtctgctgccatgtgagacatgcctttcaccttctgccatgattgtgaggccttcccaaccatgtggaaccataagtccattaaacctctcttttgcaaattgcccactcttgggtatgtcttttttagcagaatgaaaacagactaatacagtaaatcggtaccagtaaagttgggcactgctgtagatacctgaaaatgttgaagcaactttggaactgggtaacaggcatgggttggaacagtttagaaggctcagaagaagacagaaaaatatgggaaagtttggaacttcttagagacttgttgaatggctttgaccaaaatgctgacagtgatatgcacaataaagtccaggctgaggtggcctcagatggagatgaggaacttgttgggaactggagcaaaggtgacttttgttatgttttggcaaaaagactggtggcattttgcccctgtcttagagatttgtggaactttgaactggagagacatgatttagggtatctggcagaagaaatttctaagcagcaaagcattcaagatgtgacttgggtgctgttaaaggcattcagttttataaggaaagcagagcataaaagttcgtaaaatttgacaatgatagaaaaacaaaaacccattttctgaggagaaattcaagctggctgcagaaatttgcataagtaatgaggagttgaatgttaatccccaagacaatgggaaaaatgtctccaggtatgtcagaggtcttcatggcagcccctcccatcacaggcctggaggcctaggaggaaaaagtgattttgtgggccagacccaggctcctggtgctatgtgcatcgtaacgacttggtgccttgcatcccagccactccagccattgctgaaaggagccaacgtagagctcaggccgtggtttcagagggtgcaagcccaagccttggcagctacgtatggaaattcctggatgttcaggcagaagtttgctgcaggggtggggcctttatggagaacctctgctaggggattgtagaaggaaaatgtgcagttagagccaccacacagagtcccttttggggcaccacctagtggagctatgagaagagggccaccatattccaaaccccagaattgtagatccactgacagcttgcaccatgtgcctggaaaagctacagacaaaacaccagcccatgaaagcatccgggagggaggctgtatcctgcaaagcctcagggatggagatgcccaagactgtgggaacctacctcttgcatcagcatgacctggatgtgagacacggagtcaaaggagactattttggagctttaagatttgactgccccactggatttcagacttgcatagggcctgtagcccctttgtttcagtcaatttctcccacttggaatgggtgtgtttacccaaggcctgtacccccattgtatctaggaagtaactaacttgcttttgattttactggctcataggtggaaaggacttgccttgtcttaaatgatactttggactgtggacttctgaactaatgctgaatgagttaagacttttggggactgttgggaaggcatgatttgtttagaaatgtgaggacgtgagatttgggaggggcccagggtagaatgatatggtttggctctgtccccacccaaatttcatcttgaactgtagctcccacaattcttatgtgtcttgggaggaacctggtgggaggtaattgaatcacgggggtgggtctttcccgtgttgttctcatgatagtgagtaagtctcacaagatctaatggttttaaaaactggagtttccctgcacaagctccctcctcttgtctgctgccatgtgagatgtgccttttatcttccaccatgattgtgaggcatccccagccatgtggaactgtaagtccattaaacctctttcttttgtaaattgcccagtctcgggaacgtctttatcagcagcatgaacatgggctaatacacttgccatatgaccagaaattctatttctaggtattttcccaaaagaaatgaaaagaactcaagtgtccatcagctgatgaataagtaaacaaaatgtgctacacccaaaccatggcatactactcagcaataaaaaagaaagacaaacacaacaatataaatgtttctctagaatatcataagtaaaaaaaggcagactcaaaagcttgaataatgtataattccatttatatgtaaatttagaaaagataaaatcatagcagcagaaacagttcctagggccagaagtgggaatagagattaactgcaaaggaacatgaagaaactttttaggaatgattaaagtgctccaaaacattactgtaattctgattgcctgactacatacatctaccaaaattcatcaaattgtacatttaaatgaataatatttattatgtataggtatacctcaatagagcagaaataaataaataaatctcaacactaaaaagttttcaaataatacagcagcaataaaatacatttcacaaaaaaattaatatatcctatcatttgacctccctgtcacaaaagttattttaatttttgtcttttatttttctgtgcatattcataacctggaatattttccacagtggtagttctgagtgaatttaggttcatatatttttcatttaaaataatacaactttctatgctgttcaaaagtttttatcaagacagtcaaatacttaaacatttgagtatgttgtttaaaaaatcaattctagtgagcagcaatatccatcagactcaatatgatatacttaaagaacacttaacttggttgtactcatgttatctgcattctacttaattagtcctgccactaaatagatatgaaacttcacttaaatctcatttgtttttctgggcttcaagttccttatctaaaaataataggaatcgattagatcagtgtttgtccaagaacaatctacaagataaggggtttacaactaaatgtaaattgactatttcactaagcattttgtaactagtccttctgaatgaagagagggttgtgctgatttatgttctggtagaatctcttttctcatcataggcaagaaacagttgacaaaagagtgtcactgggtagtactaggttagacgttactttggttcactccagatctaaaagtgattaaatctttctgcatagaaatatccttcatacttctgacacatataagatttctctctaactgtaaacaaactcttcccaatttttcaaatattccagttctagtctattccctaaaaatatctacaaaaattctgttgtgccaactctcagaaaacctaagtgctaatatatattattcccgctgctgttcaacattcttacagtggtaatgtttaggaaaaagataaacacaaagtataatgaaaactatttgagccaccacttaagatatataaataacaagtaactatgtcaaatctatctcccttctggctcaagagcataacatagcactttgcaggtgagcttaagtacttaatatatcatcctcagggctagggacctcagacatacacatctcaggtactaccttaatctgacttgcaaagccattctgatcatatggttcactcacattagaactttcttatatttatcttagagtcattaagtatagaaatgcccaggaaccccagatcagatctgctatgggagagttaaaaggtttaggggtgccttatagtagtaacttgcaaacattttggagctccacagtaggtggtcaaatctgctctatgactgctttacaagtccaattctttactctaatctaataattacatgaaaagaaatcaaatttccatgatggccattcttactaatccttaaaatatgtaagattctagattacgttttagaggtcattcttaatttaacttgccctttataaataaactaactttgaaggatgtataatattttatttgtaatatactagaccatcagactgacggtaagacccaatcttagagtaactgggccactcaataagttaatacttagaaataatttggatttcagattcatgatatataaataagcaactcaaaatcaaagctgttggaactttaaattattttgagccttaaaggattgtgcttatgcaacctgaatcacatgacaggcagctgtaacttttgttcctctgattatagattgaccttttctttatccacgttgttttctaaaatactgtaaaagactaaaaagtgccagagaagaccccttgcctctccactattgatcttcattatagcttaacttcccttttacttctctgacacaaagatcgcatgactatcacattgtctaagatggaatattaaatgcactcttttaaattggaaaaggaaaacagctatagctaaactgctataactaatcaaattgctataactcataaaccagctttttaaaaaaatgttataatcctattaaatttctttattttctgactataagagcaagaccttttcacctttggagcactgaccccattcctttggagtctgtgttacttgaatagctattctagcctttgcacctgaataaactctcttaaactggattctgacccttttgattatttcaagtttacaataataaatactactgagctagcctcaaatggcattcttaaagtagtcatacttcaacataggggctcagggctccaagaccaactgtttcaagaggcccagatcaatctgtaaagcaaatggttttatctgagaagtgctagaatatcacttccactccatgcattggtcaagaaagcaccagggctagtcaagactgaaggggagaagagtgagactcaatctctccatggaatgagtagcaaacaattatacgaagtgtattactataaccaaactctaaaatctgtggcagcgactttggaatcagacaatcggtcagaaactagagcgacctgatgagttagaataaaggccttgaggagactgctggtgatgacttgaaagacagcggggaaaacgttattagagcatggagaaatgataactggtattatgcaatggcagaaattttagcaacactaatacttgaggtaatgaagaaaatacctaatgaactgctagattctaactaaggaaatttccaggctgaatttcaaagtgccaatagttcctttcatccatgtgtgagaaggtatagatagatagaaggaaaagagtttataaagtgttcagttttctggaactaccatttgacccagcaattccattactgggtatatacccaaaggaatataaactgttctattacaaagacacaagcatgtgtatgttcattgagacactattcacaacagcaaagacatggaatcagcctaaatgcctatcaatggtagactggataaagaacatatacaccatgaaatactatgcagcaataaaaaagaatgagatcaagtcctttgcagaaacatggatggagctacaggccattatccttagcaaactaacacagaaacataaaaccaaataccacatgtttgcacttataagtgggagcaaaataatgagaacaaatggacacatagagaggaaccacagacaatggggcctaccagtggtggagggtgggaggagggagagagtcaggaaaaataactaatgggtactaggattaatatctggtgatgaaacagcctgtacaagaaacccccacgacacaaatttacctatatgacaatcccacacatgtgcccctgaacttaaaataaaagttaaaaataaataaaaagtaatacagtgtataacttttcaaggagaatgtataggaaataaaaaggaactagaatttcctagatttgaaaataaactgtttttcatccccagtctatccagataacaaaaatctctcaaagtaagaaggggcttaaaggaaaagatgtaaagcaggatttggctgtaagacctttagaaatatttatggtaatccctcatagaacttctcaaaaaggggccttaagaatcttaaggtctttatcctgggccttttcacttagacaatggtgccctaacaacttaagggtgttaaaaacataatagcctcaaaggtgatacaaaatagacaaaggtgacacaaaacatgtaacagcctcacaggtgatttaaaacagtttttctaagaaaatgtaactgtggcttttgtctagtggatttgattataaattaaaacaataagaaactcaaaggttttataagaatcgtatcatcttgggataaaagggacaatgagagtaaaaaggaaaagaagctgatagaagcaggctgagaaagctacagcggcaaacacagcctatttcatagagaaaaaaggatgactcagcagaaccaagagcctaaaaggcagaacaaacaaccacagaaaatcattccccccagagagccttactggatcctcatcaaggaaatgctaacatgtgcccagctgattttcagaattgctatggtactgtgactgttgtgggcctccagttttccctcttcctgaacaggagtgtctgatctgattatcctatatctctcccaccactgtatgatggatgaaacaatcctctctttggttcacagctctgcttatagagaaggagctgtatcttaagaaccacaaataagaatcctcatctgcacttatacctgacttagatgacaagacccggggctgggagttgtggcttacgcttgtaatcccaatactttgagagccgaggtggaaagatcatttaaggttaggagttaaagaccagcctgggcaacgaaatgaggcctcatttccacaatttctttttttttttttttgagacggagtcttgctctgttgccaggctggagtgcagtggcactatctcggctcactgcaacctccgcctcccaggttcaagcaattcccctgcctcagcctccccaatagctgggactacagatgcgcaccaccacacccgactaattttttgtattttagtatagatggagtttcaccatgttggccaggatggtctcgatcccctgacctcatgatccacccgcctcagcctccccaagttatgggattaaaggtgtgagccaccgtgccaggcgaaaatttttttaaaatagccaggcattgtagcacacacctgtagtcccagctactcagaaggctgaagcaggaggatcctttgagccaggagttggaggctgcagtgaactatgatcatgccactgaactccagcctggatgacagagagagagagatcatgcctcaaaaatttttttaaaaaatgatcctggagtttgaaattatgacataattacatgaaacttttgggtccttgagaaggagtaggtgcatgtaggaacaatgtaaatatttttgtagccagggaattgatcatacagtagattaaagttggccatcaattctttgctactcttctcactgagagataaagtttcatgtcctttcaatcaatatgtgctactctgagtgacttaattaactaatagaatgcagaagacatgatatcctgggagttctgtggctgggtcataaaaaatcttgcagcatctggtcaggtctcatggaaccctgggccaccatgttaaatgttaggctgccctcaggcagccatgctggagctaagtacatcctttgaataacagacccatctgagccttgccttctagccatcccacaaaataatgatatataatagaaaagcctgttgttttaagcgactaagattgttgaacagcaatagatgcccagaactgtatgtcagcaattttataatttattttggttctatattcttagctctgaacactaaaatatccactgagaataccagaatacatgattgaaaacctctgaaataaaaaagtttaacaaaactgaacatcataaattatattactaatggtgaccacatagttgatatattatgttgttcatctgccaagaaaaaaatcagaaaatttaccaaataaagaaaaacaacagaaaattataattaggatgtgcagaatgttaaactgaaatcttactaaaactgtatattattttgatttatctgtgtttaatgtatagtgaatgctttaaaaaatgttgacttaaaatgacaccaaccataggacaaaaaagaaaacatactctctggtgtatccatcttgttaagaacattaagtttctttataaagccaaagagtagacatatatagataaattgctaacctggcatttcctctgtcctgatgtcctgtgtgaatcgaacagcactttgaccaaatggaatatttttcagtcctgatgttttcttcaaagacttgagagcagttcgaggttcattatatgtgccaggagccggggtgattgatttcataggtaaaaatctctagtgaagaacaggaaaatatgccaataagaaagtatagtacattttgatacttcatgagttaaaacctgccttttgagtaatataacatctggagttaatttatttcttaatggagtgaagaaaatgtagatgaactaagatcttgtacccatcaaaacataaaatatatagcttttagtaaaatcacctgtatactaatatagtaatgtattatgtgccttactaaggcagacagacttttagaagaaaataatctcaacatgagactctagatgatagtgtagggataatgatcatacttaaaatattctgccagttaatataaataaaaaactatatgatctaacacgttattttatgtgatcaaattatatttattgaaaaagttcctcaacatgtatattcaattaactcaacagtatcattagatatctcaaaaaaaatcttagattcagtggtttatcaattcagtttaacttttaaacttattaacattatatatataaaatgtttatatatatatatatatatataactataaattcatgagatatagcactgtataatctttttttttttttgagacggagtctcgctctgttgcccaggctggagtgcagtggcgcgatctcggctcactgcaagctccacctcccgggttcacaccattttcccgcctcagtctcccacgcagctgggaccacaggcacccgccaccatgcccagctatttttttgtatttttagtagaaacggggtttcaccgtgttagccaggatggtctcaatttcctgaccttgtgatttgcccgtctcagcctcccaaagtgctgggattacagatgtgagctagcattgtataatctttttaacttttcatttgaaaagaatttcaaatttacagagaagatgcatgaataaaaataatacagaaaatatgtgtataacctttacccagattcctctattatcatgttacctcatttgcctttttttctttgccaactctatctctgttttgtctgtttgtctttctcttcctctgtctctcttactctacacacacacacacacacacacacacacacacacagattttgaaagttgcatatttcatggctctttacccacaaatacttcagtatgtatttacaaaaaaaatgcagatattttcttacatatccacagtacagttatcaacttcagtaaatgtatcaatgatctaatgctttcatgtaatctaggattcgtattccaaattcgtcggctgatctaataaggcctctactgcatttttccccttcagtacataatctagtttagagtcacatattgctttagtcatcatgtctcttttatgtcctttaatgtaggaacatttctacagccttcctttgtgttttgtgattttaacattttgggagaatcacccttttgtataatagaaccttacttacttgaggcttacctgatatttcctcataattatatccaggttatacatttctggacatactactaggtgggtgatgtgtggctttcccaggatatcatatctggagatgtgatgtctgctggtcttcactggtaattttaattttgatcaaattcaacactgcctctatatttataataagtacttagcattctactgtaagcaagtgctctcccttctccttcaattatttatttcattagctatctacttacctatctatagtcgacccttgaacaacacgggtttgaacaatgtggttccacttatacacaaattttcttcagtctctgccacccttgagatagaaagaccaacccttcctcttcttcctcctcctagtctattgaatgtaatgacaagagctttatagtaatttacttccatttaataaatagtaaatatattttctcttccttgtgattttttaataacatttccttttttctagcttactttattgtaagtatacagtacataacacatataacatacaaaatatgtgttatttgactatgttattggtaaggcttccagttaacaatagccaatttgtagctaagtttgggaggagtcaaaagccacatgcagattttcaaatgcttggagggttggcatccctaatctctacattgttcagaggtcaactgtacttagttatctatttattatccacattgactcatgaatgccaatgttaacgatttataattcattactgagcaggtggggggcccttcatattgtttcctatgtccctgtgatatgctctcatcattatctcgtttagaacttactttctgaaataaaatgttacactgtcctcttccacctaccctggaatcagttatttctctgaggaatcctttttctttcagtaggaatagaattagagaccaagatctgggcacttgatgtgtcccttgctactggggtatctttgcttcttagttcatttagcagacagagctaggacatacacacattcacagagaatgagagggagaaacacacacatacatatatacactcatacatagacatgtgaacatatatacatttacatgtgcacatatatatgcatatattcatacatataaatatatattaaaaatcatgagttcacataaaagccttcaattcaaatccatcccacaaggtcctctttcacctcctccaatccatatttgtatgcaccttccttaacaatgaaaaccatacctcagattatcaacttttttgctcaaacttgtgatattctaagatagttttataattgctttacccataccatcccaataaaccaacctactaaaaataattaagaatttgtttccaattcttctttttttctttttttctgagacagagtctcattccatcacacaggcgcaatctcgactcactggaacctccacctcttgggttcagaggattctcgtgcctcagccttctgagtagctggaattacaagcacatgccacaatgcccagctaatctttgtatttttagtagagactggattttgccatgttggccaggctcgtctcaaactgctgacctcaagtaacccacccgcctcagcctcccaaagtcttgggattacaggcatgaaccaccgcacccgccctgtttccaattcttacattcactacccactcaccctccaattccagcccccatcgaagactgatatagtcaaatactatggttacctggattattacttctttttttcccttcagtgtagttaagggcattcatttgaaataaaactgctcatttgtttccatttgttttcagtttagtttttaacttttcccattcttactgatttatttttattttttaatatatgaaacattgaaatctttccaaaagataaatacgtattttttgaagtgtagtcaaagaagtgttacgccccctgttggggatgctgcgctacttgggacagaaaagtctcaatttgcaacatttgctgattacccgcaacagtggctaatttcacactaccaacataatgtcagccagcttgcaaaactcctggaaacttaacaattgggtcttgcaagccagtacaaataaacagcagcataccagtgcttgcactttacctcctcaccatcccttgtagataactaacatcattgttttctggtttatcttcatcgtgtttatatagccaagtagttatgtgtatgttttcctattttcctatcttttttaaacaaaaatatagtacaacatatatgttcttttgagttgtgtaaagtaggtaaatattaacactactaaaataataatttattattggaagtactaaaaggactctgaaatttattatcctaaatactatcttattattttagatgctaagtataatgtttataaaatgatagttttcaaccatggctgcttattagaattacttgaggaattaaaatatatatattactgtttaggccctattctgaaccaactgaatcaatttctggaaggaagagcaaagggcatgttggcacttgggtatcagaatgtatttaaattcctcagatgtttttaatatgcatccaggggtaagggccattgccataaaggaaatattgtgtatttaaaattaataattgaagacataaggcaattcaatgcatttagataaaatgcccgacaactcctaaatcaatgactaaaataagcatctcagaaatgtatctgtctttattcctacaaaccagaaattctgtgttctaagtctactttgttaattgtgttatttctttttctatcttaatcacttatatgtatctattcatattcaaataaacattaacattacccctagcaggttatcctgtttaaactcttccatatcttttactgcagaaccattattcttttccccatcatccccttaaaccaaattgatatcatattcttttctatttctaaaaatatattttaaaatatgattattgtcaagtgatgtaaggttagggctatatatcagattaacagaaatagtatgaaacctgagattttatttgtaaaaatcatatttttaaaaaatcaagggtacacatacacgcacatgcatgcacaggcacatgcgcaagcgcacgtgagcgcacacaaacacacacacacacacacacatacacacacacagaaaatatcctgtcttccccacatccatctcttgtagtaccttaagcatcattaagttgcttgatgcagaaatctagtattcattcttgattcctctcagtcccttataacatcatctagcccattaaaaatcatgttaattttatctccaaatatacttgcaatctatctacttgtctccaaggaggtgtctcttaagtacaataaaatcaaagtagtcgtctatagtcacctgaaggttaatattcttcccaagttaaataagataatcagagccatacataccacaggtggataaatatcacaatcactttggtctggaggctgccacataataaaggtttgctagtattataattgtcttgccttacaaatatgttagataccttcagttcctcttagtatattcctgggagtatgtgaaatggttactgcaaaatatactctatgactgttgtatcactagtgaaggtcccagtggcagctgtagaaatgacctatggccaggctccacagaatgccttcagaaccttttcagaaagagatgcaagcctatatagcttacatgttaacactccacacattcattggcaaagtatattttaaaacagactaaagaagacatttcttataaactgaactgaacattcatatatgcaaatttgcttaatagaaaatgtttaatagatggttctattcaaatattcatctgtgtatttctaattttatttcacttcattttacccatatgttttggcaatatatttttcctagaccatgtctatttccaatttgcttaaatatcacttttcttcttataacctttaaacatcattgaatgtgttgctggcctcacactatgcctattagactctatatatgaaaatggctgtagaccattacctgggattgagaaagaaaagcaggagatgcatcatttgcatttggtgtcatactttctatcttctgaaattgacttttaatgtcatattttccaggccctggtactccctaaatcacaaaaagaaatacatgttctcattaagaaagtatctatagcacctaagggaagagttggctaaatatctgaaccacagccacagagtttttaagtgaattcctacataatattaccaaagcacttcattaaaaggcaagctggaacaaacttaagagcagcaaaaaaaatttccttagcaaagcagcccttgaacctgaaaacacactacctgaaactttgctgccctctactgataaagctcagaaaaaattatccagctcttcacatgattaaatactaaaatgaagaaagaaaaatgaaaaatgacttctctagttcttccatttaaaagtatacagctagcttgtctctaaaaaattttgtactgtctttttaaatgtatgtaaatcaacgtgttttttccatcaaataggctttaggaaatagtttaactacatatgttaattgtaagaaattaagcttttaactagatactttataacagataagaattaattcagtaagttctgaggttgagttttttatattcttagtcatataaataaatattaagaagtactattttttcatcatcaaatattttaattacattgataagtaccttttatacttatcaattcaaatcgtctgcttcatacatacctaaactatttttctttgtctgaaagaattactccttgagttactaattgaataattggcttataaattagatgtataatgaaattctatcattatatcctgtcatttctatctttataatatttccaaatccaaccacttctctccacctccacaactaccactctgatcaaagccactaccatctcttacctgaattattttaaaagtcccctaactgtcccctgctcccatccttgtccatcttcagtctactgacatagcagccagtgaagcagctgttccacaatccgagtcagattgtatcactccgcttctcaaacccacccagtggttgccaatctcagaacataagtcaaatccttaatatggtctgaatgtcacacacacacacacacacacacacacacacacacacacatattacctctctaacctcatctcctactaccatctcccctcattcactttgctacatatcttcctcaaacagatcaggcatatatctgcttcacgaccttggcatttggcagtctgtctgcttcaaatgttctcttcagatttctccttcattataatcaggtcactatacaatgtcaccttctcaatgagtcatttccaggccacctaatctaaaatttcattaccacctccaaacaatttatgtccccttctctgctttttttaaccttattatttattgctatccaaaataaaattttctgctatattctaagctccagaaaggtcaagtcattttctttttctgtttggctcactgctatatctctagagtataaaacagtacctgaaacacagtagggttcagttaatatttgcaagaagaatggatgggtacatgaattgaatcctacattttcactgactacattatgaatttgatgatgggttcctattgaaaataatgtggctccaaataagtgcattagccatttctaattcttatattttgttttttgatatgggctctcactctgttacccaggctggagtgcagtggcccaatctcatctcactgcaacctccgcctcccgtgctcaagcagtcctccaacccagcctcctgagtagctggaaccacaggcatgcgccaccaggcccggctaacttttgtatttttggtagagatgggtttttgccatgttgatcttgggttccccagactggtcttgaaccgagctcaagcgatctgcccgccttggcctcccaaagttctgggattacaggcgtgagccactgcgcctggccagccatttctaattatgataaaatatgtaaatcctatgtatttttttaaactgataataatttgaaaaaaaattaggagaaactaaaaatttacgagaaactaatacagaagtatcttttattttaaataggttagattctaaaaagttatccaaaagtgcatgacaccttggcttaaatgagcagattcttgccattatttgctggctggtagaaaagaggcacttcagcaatgatatgtaagattttttttatctatcaacttgtagtaagttaagttcagaagaaaagaaacttctacacaattctgtggctatataaacctgcaaaatatgcaataaatatagaaatatggggagcataaattcaaatacatagcgttagcctattttctgaagctatacagatatgccgtattcttcttctccctatacagtactccttccttatccagaagggataggttccaagtctcccagtgaatgcctgaaactgaggatagtatgaaaccctatatacactatgtttttttctatacatatatatctatgataaagtttaacatattttagacacagaaagattaataacaataattaataaaatagaacaattataataaatgttgttcacaatttcacagatagaagattcatacttactgcagatcttagcaacctcaacatataatttttttctttccttattgtcaataactttcacctttccaaaggaagcactttacaacttctctttggcatatccaacttgctagcatcactattcttgcactttggagccattattagttaaaataagggttctttgaacacaagaactgggataccccaacagtcaatctgataaccaaaacagctaagtgactaatgggcttcacctaccaggtgggacaaagcaagaagttgagagatttcatcacactacacagaatggcatgcaattttaaaccaaattgtttacttctggaattttccatttaatattttcagactgtggttcatcacaagtaactaaaaccacaggaggtgaaggtgcagataaagggagagtgctatataggccaacatgatcaaaacaatcacctactaacaaaccagaattacttttctactattttcaacagttgtgtaagtggtcactactagaggtcatagggaaaagattacatgtgaattataaatgaatatacttcaacttaagaagaattttttgcataaatggacaaatgaaatcttgaatccttcaagaaatacttcctttttcttttcttctgcttttttgtaaagatcctaatgttattgaactttccttcactaaaataacatagaacaatcaaatgaggtccttgcttctaaaaagctaggtttcagatttaataagccacttagaaataagctccaaaataagtctgtgacaactgaccactaaagggcaggtttccacttatgacattataaagaaggaaaaaacactttgaggagaccaaccctcaaagttgaaaatgctgtgatgttcatcctgttttccaaattgtgaccaaaagacaacctgcattaatatcaacctattaaatacatagccccccagttctcatcttagacctaatgaatcagaatcttgttgagtatgggaatctactttttaataagccccacatatgattctcaagcacagtaaagaaccacagactggcacaaaatgaatcactaccatagcatcttttagtaatcacatctattctaaggaaaaagacccagaccttgaaagtatactgccgtggaaacaaagcttaaaatttattgaaacaggttatttatggcatcttttcatctgtaacctaacaaaaaatgattttctttctttaaaaactgaagtataatcttccatttgatcacattatgtgcagggattggaaaactggggaaaaaacatacagtttaaactttattcctataccataatcagtaatgattattactaccatttttttcttccaataggtttttgggaaacagatgttatttggttacatgagtaaattctttagtggtgatttctgagattttggagcacccatcacccaggcagtgtacactgtacccaaagtgtattcttttatccctcacctccatcccaccctttccctcgagtccccgaagcccattgtatcattcttatgcctttgagtcctcataccttagctcccacttatgagtgagactgggtttccattcctgggttacttcacttagattaatggtctccaattgcacccaggttgctgtgaatgccattatttcattcctttttatggctgagtagtattccatggtgtatatatacacacacatatatacatatatacgcacacacacacatatatatacacacatacacatatatatatgtgtgtatatatgtgtgtgtggtgtatatatatatgtatatatatgtgtatatatatgtgtatatatatacaccatggaatactactcagtgtgtgtgtgtgtgtgtgtgtgtgtgtgtatatatatatatgtatatataccacattttctttatccactcattgatgggcatttgggctccttccatacttttgcaattgcaaattgtgctgctataaacatgtgtgtgcaagtatctttttcgtacaatgactgattttcctctgggtagatacccagtagtgggattgctggatcaaatggtagatctacttttagttttttaaggactttccacactgttttccatagtggttttaatagtttatattcccaccaaacagtggaaaactgttcccttttcaccacatccatgccaacatctaatttttttaaatttttttattatgaccattcttgcaggagaaaggtggtgtcacattgtgatttttatttgcatttccctaacaattattgatgttcagcattttttcatatgtttgttggccctttgtatatcttcttttgagaattgtctattcatgtcctttgcccactttttatgaaattgttttctttcttgctgattagagtttcttataaattctgaatattagtcctttctcagatgtatagattgtgaagactttctcccactctatgggttatctgtttaccctgctgattattacttttcccgtgcagaagctttttagtttaattaaatcccatccatttatctttgtttctgttgcgtttgctattgggttcttggtcatgaagtctttgcctaggctaacgtctagaagggtttttccaatgttatcttctagaatttttagggtttcaagtattagatttaagtctttgatgaatcttgagcagatttttgtatacaatgagagatgaggatccagtttcattcattcacatgtggcttgccaattatcccagcaccatttgttgaatagggtgtcctttcgccactttatgtttttgtttgctttgtcaaagatcagttgactgtaagtttttgggtttatttctaggttctctattctgttccattggtctgtgtgcctatttctgtatcagtaccatgctgttttggtgactatagccttgtagtatagtttcaagtcgagtaatgtaatgccttcagatttgttctttttgcttagtctttctttggctatgtgggtcttttttggttccgtatgaattttaggattgtttttcctagttctgtgaagaattatggtggtattttaatgagaattgcattgaatctgtagattgctttggcaatatggtcatttttacaagattgattctacccatccaagagcatgggatgtgtttccatttatttgtgccatctatgatttctttcagcagtgtagttttcctttgagaggtctttcacctccttagttaagtatatacctaagtattttttaagctattgtaaaagggttgagtcttgatttgattctcagcttaatcactgttggtataagcagagctactgatttgtgtacagtaattttgtatcctgaaactttgctgaattcatttaccaattctaggagctttttggatgaatctttcaggtcttcaggtatatgataatgtcatcagcaaatagcaatagtttgacaacttcctctttaccaatttggataccctttatttctttctcttgtctgattgctctggctaggatttccagtactatgttgagtagaagtgatgaaagtgggcatcctggtcttgctccagttctcaggaagaatgctttcaacttttttctgtttactataatgttgcctgtgggtttatcatagatgacttttattaccttaaggtgtgtcccttctatgccgattttgctgagggtttaatcctaaaggaatgctggattttgtcaaatgctttttctgtgtctattgagatgatcaagtgatttttaattctatttatgtagtatatcacatttattgacttgcagatgtcaaaccatccctgcatccctggtatgaaacccacttgatcatagtggattatcttttgtatatgctgttggattctgttagctggtattttgttgaggatttttgcatctgtgttcatcagggatattggtctttagttttcttttctattttttttttttgttatgtcctttcctggttttagcattagggtgatactggcttcatagaataattgttggaggattccctctctatcttgtgggatagtatcaataggattggtaccaattcttctttgaatgtctgacagaactcagctgtgaatccatctggtcttggactttttattgttggtagctttttaattaccatttcaatcttgctgcttgttattggtctgttcagagtttctctttcttcctggtttaatctaaaagggttgcctatttccaggaatttatccatctcctctaggtcttctagtttatgtgcgtaaaggtgttcaaaatagccttgaatgatcttttgtatttctgtggtatcagttttaatagttcctgtttcatttctaattaagcttatttggatcttctctcttcatttcttcattaatctcactaatgatctattaattttatttatcttttcaaataaccagttttttgtttcatttatcttttgtattgttttgttgttgttgttgttgtttcaattcatttagttctgccctgatttttgttacttcttttcttctacttctatattacacaggtttgagaggttgtatcattcttaccattcagttcaaagaattttttaatttccaactttatttcattgttaacccaacgttcattcaggagcaggttatttaatttccatgtatttgcatggttttgagggatccctttggaattgatttccaattttattccactgtggtctgagagaatacttgcaatattttcattttgttttaatttgttgagactttttttgtggcctatcatatggcctaccttggagaatgtttcatgcattgatgaacagaacgtatattctgcagttgttgggtagaatgctctgtaaatatctgttaagtccattcgttgtagggtatagtttaactctattgcctcccctatcccctagggatgtggcttcctgagacctgagctgcagtgattattgtttctcttccagatctagccacccggcagagatactgaactccaggctggtacaggggagtatgtgcaaagcgatgtgacccatcttcaggtctctcagccatgaataccagcacctactctggtggaggtagcaggggagtgaagtggactctgtgagggtccttgattgtatttttgttaagtgtactggttttgtgttggtcggccccaagctaggaggtggcactttcaagagcacatcagctgcagttgcatagggaggatcaggcagtggatgcagccatagagctcccaagagattatgtcctttgtcttcagctacaagggcaggtagagaaagatcatcaggttggggcagagttaggcgtgtctgagctcagcctctccttgggtaggacttgctgtggctgctgtgagataatagggatgtggttcccaggccaatggagttatgttcccagagggattatggttgtctttgctgcgtcacacaggtcaccaggaaagtggtagaaagccagcatccacaggtctcaccctactcccccatgctgcctgcaccccgaaaggccagtctcactcccaccattgccccctcacccccccaccccctgcaatagcactgagtttatttccaggaagccagtgaacagggatgagaacttgcccaaggctacaagcctcccagctgagaaagcaagctgactcacagttccttggctgtcccacaaagcctgcagtggcaatcacctccttcaatgtgtctgtgaattctcatggctttcccggtatgtttctgtgatagttcttggaggaaaagtatacaatgtgggtctctccacacggctctgtctgtccaagtggaagctgcaagttagtcctgcctcctatccaccattttccttttgggttgtcttttttaagtcagattacattttaaaaagataaattgataggaaactaagatggctgactagacacagccaagaggaacatctgccactgagaaaccaggatattgggaaaagactagcacaccctgagtagatgttcaaagggaaggcactaaaaatgaacagatagagaatacagatgttgagctaaagtgggaggaagctgggaaccctgcatggggttaccacacaccaggactcatttctggtccccagtgactcctagaaaacagaaatgaggccagtcaactgaacccaccagacatggttttgctgtgtccccacccaaatctcatgttgaattgtaaaccccacatgttgaaggaaggcatggtgggaggtaactggataatggaggcagatttctttctctacaatgagaactacaaaaccctgctgaaacaaatcagagatgacacaaacagacaaaaaaaattccatgctctgagatagtaagaatcaatattgttaaaatagccatactgcccaaagcaatttatagattcagtactattcctattaaactaccaatgacattcttcatagaattagaaaaaagaaagctattttaaaatttatattgaaccaaaaaagagactgaattgtcagagtaattctaagcaaaaagaacaaagctggagacatcacactacctgacttcaaactatactacaaggctacagtaaccaaaacagcatggtactggtacagaagcagacacatagaccaatagagcagaatagagagcccagaaagaatgctacacacctactaccatcttaaccatctgatcttcaacaaagtcaacacaaacaagcaatggtgaaagaactcctcgtttaatagatgattctaggataactagccacatgcagaggattgaaactggatcccttccttaaactggatccctttcttacaccaaatcaactcaagatggattaaagacttaactgtgaaatctaaaactataaaattcctgaaagataactcaggaaatacccttttggacataggacttggcaaagatttcatgacaaagatgccaaaaccaattgcaacaaaaacaaagagctctgtgcagcaaaagaaactattaacagagtaaacagacaacctatagaatgagagaaaaatttggaaactatgtatctgacaaagatctaatatccagaatctataaggaaactacctaaacaaattaacaagcaaagaacaaacagcccccttttgcctactttaaaaaataggcaatgaacagacattttgcaaaagaaaacatgcaacacagccaacaagcatatgaaaaaaatgctcaacatcactaatcattagagaaatgcaaataaaaatgacaatcaggtaccatttcacactggtcaggatggctattactaaaaagtcaaaaaataacagatgcaggcaaggtggcagagaaaaaggaatgcttatacactgctggtgggaatgtaaattagttcagccattgctggaaagcagtttggcaatttctcaaagaacttaaaacagaattatcatttgaccaagcaatcccattattgggtatctattcaaaggaatataaatcattctactatgaagacacatgcatgcatatgatcactgcagcactatacacaatagcaaaggcatggaatcaatctgaatgcccatcagtagtggactggatgtattagttcattctcacattgctataatgaaattcttgagtaatttataagaaaagagatttaattggctcacagttctgcaggctatacaggaagcatagcaccagcatctgcttttaaggaggactctggaagcctacaattatggcagaaggcaaagggggagtaggcactttacatggcaaaagaaaggagcaaaagagcaatggggaaggtgttacttttaaatggccagatctcacgagaactcacccactatcatgaggacagtaccaagggggtggtgctaaactattcacgagaaatccttccttatgattcaatcacctcccaccaagtcccactttccaacattggaaattacatttcaatatgagatttgggtgataatgcatatcgaaactatgtcactggacaaagaaaatgtggtacatatacaccatggaatactatgcagccatacaatacaagaataagatcatgtcctctgcagcaacatagatggagctggaggtcattatcctaaatgaactaacacaggaacagaaaaccaaatactacatgttctcacttgtaagtgagaggtaaacattgaatacatacggacacaaaaaagggaacaaaagacactggggtctacttgcatcagatccctgtgaaacgcaatttacctatataacaaacctgcccaggtaccccgaacctaaaatgaaaaatttttttaaaagataaatccgactgcctatgaagaagatattaaagaacggagtgcgaaaagaagcggagacaccagtaaaaaggctatttcaaaaatgcggtcaagagacaatatcttctttgactagaaaatagttcggtgatgataaaataataattagaacaataatgagtcatgatagattgtctacaaaggtggtcaccaaaaatgcctcttatccctgtaatcccatgcttccattagaagatggaatccatttccctcaccttgaatctgactggcacagtgaaaattatgtagcaccaattctgagcctaggccttaacatgcatatgttccacatttgcactctcagagcccagagcgtccttacaagtagtctaactacctagacaaaaaatgaggcccagccaactcccagttattacagccaacccctctgaggtgtcatacatgtaaatatcttggatattccagccccagcaccaaatgaatgcagccaaatgagtcaccccagctgatacgacatggactagaaatactacatgcatcagaaaaactacctaagcccagtgaacccagagaagcattctactgagaaggttaactccagtaagtttggaatcagcatgagccattttgctaaagtacctaaaaggcactgatccctggtcaaaatacgaaactactaattaatattattgttttgtaagtatgggtcctatgagttttggagtggtttgcatcagcttgtgagcactgctaatcaataacagtgaaagtgattatttgtacctggtgtcagtgagacccatggagggctctactgttggtgctagttaggtaataatatacctaaatgtccagcagagtgtaaaaaaccctggcaagactccattttgtgctccctgattctgtggtgttccatgcacatgtcagtggttcctgatccaagacagaaagcatgtcctgttatggccttagagaggggagaaaaagttcacgctggcctctctgaaaccctacggtctttgactataaagaatattcttaactttaatgctctttctatttgtatttttttttctgtaataaactatagatttaagcattgtcattttgctttagtaatcgaaccctgtctgacattattggggcaatcatggaaaataacaatttgttttaaggcactacattttggagtgactggctatgcagaaacaaataactgaaacaatatttaccaagaacatagtatttgccaggcacatttcaattcacagatttttaaaaactgtgccacaaagaaattatttcaaaaacaacatagcttgcaagtggttgggacagatagtattggtttctagcacaatcctagttaccaacttcccttttcctagccatctttcacatagaggtgactatgacacactcctggctaatgaatgtaagcaattatcagatagagaaaagagaaaccagggcaaggccaggcgcagtggctcatgcctgtaatcccagcagtttgggaggccgaggtgggcagatcatttgaggtcaggaattggagaccagcctagccaacatggcaaaaccccatctctactaaaaatacaaaaattagccgtggtggcatgggcttgtaattccagttactcgggaggctgaggcatgagaatcgcttgaacccaggaggcagaggtggcagtgagctgagatcatgccactactctccagcctaagtgacggagtgagactctgtctcaaaaaacaaaaaagaaaccagggcaaggttgggagaaaaactaatttaattttgaaatgttagttttgtagttcctgtaaaccaaggggcaggtgtcatatagacaataattcatggaggtctggagctcagtggagaggtcagggctgtaaatacacattggaagtgatctgtatatttggaagtgattattgtatatacatggcatctgaggccatgaaattaaatgtggtgtccagagaatttctgtggagaaaaaagtgaaaacggctaataatattatgtaatatttatgtggttctcagtattatatccattttaatactatattgttaatatcactaatctctttataatggcccatatgaacctgtggatcattctactctttagactctactctaatataatcttgatatcatttactatattttccagctaacatctagattgaatattttcatcagactgataactattccattttccagagctaatgaaaatatatcaattttaattcctaaaaacaagataatattcagcatcctctttctgttatgtcatcttataataaggaaaaacaaacttataagcaacttaaaatgaaagtttgaaacttacaatattttcaggctacttctatcaacctaatttttgctatatgattatacttgacactatcttcttaacaaaagaaaatagttcttttattttaaatggactatattttaaaagtatgtgctaaatacagttaactctttaagtgatctaacctcatgattgattgaatacagaaatatataaatttgacttgaaactgtagaaaagaacatatatctattacaattgtttgcataattgcaacgtaaattttggttaatttagaaagtataatgcattctttgtttctgttctcagtaaacaaacatgctctatgtggttccttttaaactgattaaatttaaacaaaatcacataaacatggtaaggaaaactctaagtaaaaataaataatttgaaaattaactttgtattaatcaataataccattgcaagtgtcactgggtctcagatgcagcacttagggtatatgccattcaaatgagaaaaatttaattggtgacagggcatgttttgcaggataaatcatatactagttagctgactatatgttcagtaacagaaatggaaaccaaaagtagcttttccatataaatttaggcaagtaaatcaagaaaggcagaatttaaatgtaagctgctaggttttactgtatattagtattgctttggagttgatggttgtcttatgcagttttaaccaaacatgaaattgagtaaaactgatgaaaagccactttgattccgtattacatctgctgagtaacaatttgtgtcaccactggtattagtaattcagctgagtcaaaaatttaatatcgtaaatctgaagctacactcccaagttctgaagtaaagtaaatatgagtaaatgtggccatcctgaaaatctcaccacaataatcaagaattatataaggcttttgtactcaaaattttttcaccaagaggaaatctatacaaatagcttgtataggtttcctgtaattactataccctatgtggtacactatctagtagcagtcaagatttataatgtctattttggtaaaatggtgctatgtaaatgttcggagttcattaacatttattactatgcaatgcaacgtgaacttccacagagttccttaatgtcagtatagtcttcctgctctttacaagtccaaattcctctttttaaaaggaaaagaaacattatcacttaatgaataatacacagacaattaaacacatccaaatgaaataatgttaagggttataaatctcaaatgaagctaaagtacccatataagattaattattattacacttgcaaagacagagaattcaaatgcctgctaggacaaggcaggcaaataagtgctaaatggaaaacggcgtacaggaaatcactcatgcttatcctcaggagcagcatttaatcagccccaactggctattattaaattcttttgttcacttttaagtcaaactggaagtctggatttgtatgtgaaatttcacaagttacaaacattggcaactaactcaatttttagcaactatgaaataactataaaaatacacctgtggattaaattcagcccataagccaccagattccccacttagctctttaatatcttagagtataagtatatttaaaaatattcttctacgtggatgacataagggctgacaaaaaaatatatattactccatatacataactccagatctagtgaaatcaaagtctaaaagaggtttgatcaatgagttggcattttctaagcctagttatagtattatcatgatgaaattataatgtccatgtttataagtagtagcagggtttcatgatctttacacacactaatagctctgaaactaggattgcattggtctgaagaaatctctgaagtgctgtataggaaaagggcccaattactcatatttatttaagtaaattattatgtggtaataagaatactgagtgacatcaaataatacctgatagcgtaaaaagactgattttgtctttgcaattctcattgttataaaacataatacctaacttcctattatattcacaagttagtgaacataataaattagaatttcccatatcttctgctcaaagaagtatacggaggatgggcaatggcaatcagaaaaagaagtaggaaagtagctcagctggccagatgtatagacccctcaagcagatgaataaggtcatcttattcatcttattaaaatgaagatgaggtcatcaagtaataaaagtaccagaataagaactttctctgactctgtgtgctggaatgtcaatatggatttcatatggatgtagggtcaagaaaatgatggagaaattctcattccctaaattgagactacttgtaattacctaagaacattaagacaaacaacaaggcaattaacactgaagatgaaggaaattctttgcttatgtctttaataacagcgttttttaaagttttttaaagtgcacactcattaatgggtaattagtgcacatgaagatcatcaatttaagtactttttaaaaaatgtttcttaattttggtaataaaaaccagccatacatttttaaattagcataaaaataagttttatttcaatgagaaggataatattgtttgcagtctttcaccaaggcagctatatgcaactcaatggtgggcagcttaatttataatttaggttatatttgcagttcatttctcttgctagcttctacttaattagaaaattctgaattcacaatcattgatcactacaaatagtgccaacagtttaatggctgtctgataagtctggatattcatattaaacataaatggcccagaaattatggagtgctggctcaaagactactgtcagcactctaacagatgaaaagttgtaatattttacaggcagaagctggaaggttgggtgtttcaacttggaagacaacactgactacatttctaatccactcttaagtggttttcagtcctggaaattagttgctcatgctctgttggaacatttggaattggcttacaaattagctaaataatacatcatcagttttttttttctccaaagacgaaaaaaacacattgagctgggaaaaagtccaaattccagactcaagctatttgtattagagtttgattgttttaaaaaatcctgagaaactattctcaacattaaaagcacaatattttggcttggaggtaatgagttcaggccactcaggataataatatatgccacttaaaaagactacatgaaatcataatcttcttactggcattagatttatatttcatttcaaaagctcatatgatcgtgtgttttctggacaacatgcttacttcaatgtggtcaaatggttgtatcaattattcatttattcattatccatactttaaaaccccaacatactgaatgcaatctgaatgtattcatacttttcactttttgtttcaaattcaatttttaaaatcagaaggcatataggtttggagtttttattattttttctatctttattgaagtataatagacaaattttaaattctatacatttaagatgtacaatgtgatgttttgatgtatgaaaacattgtgaaatgattataataatcaagctaattaacatgtacatcacctcacataactacgtgtgtgtgtgtatgtgtgtgtgtggtgagaacaattaagagctactcttttagcaactttcaagtgtaaactgaattaatagagttactatactataacattagatcttcagaacttattcatcttgcatacctgtaatgttgtatcctttgacccatattctccacctcccagcccctaacaaccactattctactctctgcttcttgaactttttaatatttcacgtaagtgagatcatgcatctttctgtgtctgtcttatttcacttagcataatgtcctccatgttcatccatgttatcacaaataataggatttccttcttttttaagtctgaataatattcctctgtgtgtgtatgtgtgtcacactttctttatccagtcatccattgatgaacattaggttgattccatatcttgactattgtgaatcatattgcaatgaacatgggagtacagatatgtcttcaacatactgatttcatctcctttgtctatatactcagaagtgggatttccagatcatatggtagttcgatttttatattttaaaaaacttccatactgtttcccataacggctgtaccaatttatgttcctaacaacaacatataagcattctcttttttcaacatccttcccaacacctgctgtcatttgactttttgataatagcttttctaagaggtgggagatgatatctcattttgcttttgatttccatgtcactgatgattagtgatgttaagcattttttcatataactgttggccatttgtatttcttcttttgagaaaagtctattcaggttatttgcccattttaaaaatcaggttatttgttttgttgccatcaatttgagttctttctatattttggatattaagcccttatcagatgtatggtttaaaaatatttttcctattttgtaggttgtcccttcactctgttgactattttctttgctgttaaaaaaaaaaaaagctttttagtttattgcaatcccatttgcttatttttagttttgtttgctcctgtttaggggataatagctaaaaaaaaattattgcccagaccaaggtcaataacctgaagaactttcagtctgacgttcaagggcaggaagcgtccagcacatgagaaagaagaaggccagaagactcagcaagtcaaatctttccaacttcttctgcctccttttttctagccacactggcagctgattagatgatgcccacccagattaggggtgggtctgcctctcctagtccagtgactcaaatgttaatctcctttggcaacaccctcacagacacacctaggaacaatactttgcatccttcaatccaatcaagttgacacttagtattaatcatcacatgctctaaagaacaaacagctctgaataggacttccagtactacattaaatagaagtcatgataatgaatatccttgtctagttctggatcttgaaaaaacgttttcagcttttcactattgactataatgttagctgtgagtttgtcatatatagcctttcttatgttgaagtacattccttctacacttaatttgctgagacttttgctgaattttgtccaacactttttatgcatctattgagatactgtggcttttttcctttattcttgtaatgtgatatatcctatttattaatttgaatatgttgaaccatccttgcatccaaaataaatcccacttgttcattgtgaataattcatttggtgtgttatttaatttgacttgatagtatattgttgagaagttttatatctctgttcatcagaaatgttagcctgtaatattcttttttatagtgtccttgtctggctttgctatcaggataattctgggctaacaaaatgagttgaaaatggttccctctttttccattttttgaaagagtttaagaaggattggtgttaactctttaaatgtttactatcattcaccaattaaaccatcaggtcctgtgcttttctttgttgagaggtttttaatcaattattcaatttccttactcaatattgtttttcttccaagatggcagattagaaggttctccagcatgcttcacccacctggtagtgtagtgattcacactgtgaaactttattcatgaaggatcatgggaattcaaccaaaaagtaaaggacactttacatcacggggaagagaagttggtcagacagcctgcacaacaggatatggctgagaactgtgagtaaagttccaaagaggaaagaggaagagagtgtccctctgtgattcacccttccactggggaacagtgcaacccaggccacaggaaagcacattgtctctcccaatacctaaagctaacatgaggagaggctgtgagaagtaaaggctgtgagagactgtgagaagtgaaggcactaggaggttccctatgcatgttctcagatctggaaactgataggaggaaatcattctcaatccagcctcatatcaagctgggaagaatttagcaacctagcagcagcaactgccactggcattagagtctcaggctggagattggagtgttgggtctggagcaggggagaggactccacactcagaactgagagatgagtatggattccagctgtgacactgtaattggactctaccacttcacaggacaagaacaggaagagatttgctgacaagctctgattttacctaggtagcaagatttgaggccaaggatagctttgtgatctaaagccagactgtgtatgactctactgagcttcccaactcactcccttggtcaggactgggaactgagcccaatcagttccgaagtgtgagaaaaaggtgggtcccacacctgttcacatggaccatgcatttgggccatccttcccttcctgtgcaaagaaattggtgcagaagcagtttctccagtcctcacctaggcttatctccaggcatctggcaactgccccccagatccctgtcagagccaattccctcagctgccactggggaactcgagtatggatttgcctggtccagctctgtacagcttcaccccctgctccaaggctgaatgtaaaacccaaacactgagtgttccacagccaagcctatgcctgggacaccagagtgctttttctgataaacaaagatcaaacataaaacctattgcaccactgcagccagatcttacctgcaagtgtgacctactgtcctagaggtcagtctacacaatccagtgacctctgccactccagcttctcaggaagctgtgagcctgctcacccgcctggtacaccaccactacaaccaatatttgagaaagccatcacactaagtctacctataatcaaaaaattcatagattcttcaccaccaaacatacccagaagcaaagccaaacacccctactcagcatacattataatcacaccctaaaggaaacaaagtcctgtcacaatggaagtgaattcaaaaataagaagtgactgcttctctagaggagaagtataagcataaaaatactggaatatgaaaaagcagagtgttatgacacaccccaaaggattacactaactctctagcaatggatcctaactgaaataaaatttgtgaaatgcaagataaagaattcaaagtattgatgttaatgaaactcaatgagatccaagagtaatcttaaaatcaatacaaagaaatcagaagatcaattcagaatatgaatgagaaatttaccaaacagatagatatcctttaaggaaaaaaaaataaaacttctggaaataaaaaatgcattaaaaaattataaaatatagttgaaaacttccataataggctaaatcaagcagaagagaatttcagaacttgaagacaggtcttttgaattaatccagtcagacaaaaataaaaacaataaacaaagcctttgagaagtataggactaaataaagtgtctaaacttaagaatccttggtattcccaagggagaaataaagcaaaatatttggaaaatctatttaaagaaataattgatgaaacttccctagacttccaagatatgtaaacatccagatagaagaggcccaaagaacaccagtaattaaattacaagatgaacttcatcatgccatacagttatcaggctgtcattgtggagaaaaaatccctaaaatcagcaagagaaaagcatctagtcacatatgaaggaaagcccatcaaactaacagcagacttctcagcagaaaccttacaagctagaagagattgggaacttattttcagaattctgaaattaaaaaaaaaagctatcaagcataaattttacagcctgtcagaataaccttcacaaatgaaggagaaaaaagtccttcccagagaagcaaatgttgagggaactggtccccactagattggtcctacaagaaatgctcaaaggagttctaaacatgaaaacaaaaagtcaatactcaccatcataaaaacaaacagaagtataaaaactcacaggttttataaatagttttataaaaactcacaggttttataaatagttttataaaaactcacaggttttataaaacactagacaaaggagaaagataaagaaataaaattataacatgacagaactcctccaaaccacaaagataaacaagaaaaaaaaaagactccacaaaacaactaggtaacaacattatgagaggaataaagcctcacatatcaattttaaccttgaatataaatgtaccaaattctccacttaaattggtggagtgaattaaaaaagcatgaaccaactgtgtgctgcttactcattattggtctgttcaattacctatttcttcattattcagtcttggtaagttgtatattccaggaagctatcaatctgttctaggttatccaatttgttggtatacaactgttcacaatagtgtcttgtaatcctttgaatttctatggtatcagttatagtgtatcctctttcatttataattttatttgagtacattctgtttctcagtgtagcccaggtttgtcaattttgtttatctttttttaaaaacccaactcttattttcatttatcctttctattaattttctagtctctatttcagtgttctgttctgatctttactttccctttctttgttaactttgggcttgtttatttcagatcattcttttttgatgtaggcgtttattgctataaactttcctcttagaattgcattcactgcatcttataaattttgatatgttagtttttttcatttttttatctcaagatatctttttatttcccttttaatttcttctttggcctgttagttgttcagaagtgtgtcattcaattttcatatatctgtgaattttccagttttcctccagtcattgatgtctactttcatatcattatgattcaaaaagatacttaatatagtttcactctttaattttttaagtcttgttttgtagtccaacatatgatcaattctggaaaattattcatgtgtgcttgtgacaaatatgtagtctgctgctgttgaacggaatgttctgtatatgtctgttaggtccatttggcctaaagtacagttcaaatccaatgtttccttactgaatttctgactgaatgataatgatatatccattgttgaaagtgtggtattgaagtcccttactattactgtattgctgcctatttctcccttgatatctgttaatatcaaattatgtgctccaatgttgagtgcagataattttactattatcacatccttttgatgagttggcccctttatcattcatagttcaatctcagggttgtatgtgtgcaggaatttatccatttcttctaggtttttcagtttgttggcatatagttattcataataacctctaatgattctttggatttctgtggtctcagttgttatgtctttttcatttctgattatatttatttgagtctcctatcattttttcttagttagtctggctaaatgtgtgttgattttatcttttcaaaaatccaacttttcatttcatttcattgatcttctgcattttcttagtcatgatttcatttatttgccctctgatctccataatttctttcctactaacttttggtttttttcttaattttctagatccccgagcttcatttttaagttatttaagtcgttctactattttgatgtaggtatttattgatataaaattccctcttgacactgctttcactgtatcccatagattttagtatgctgtatttccattttcatttgtttcaagaaacgttttaattgccttcttaatttcttcattgacctggcccttttatcattatataatgaccttctttgtctcttgtgacagttttttacttaatgtctgttttgcctgatataaagagaggcactcttgctctactttgtttagtatttgcatggattatactttccaacgcttcccattcaatgtatgtgtgtccttaaacctaaagtgtgcctctagtaggcagcatatacttggatcttggtttgtggttttttgtttcaatcattcagccactatatgtgttttggttgaagaatttaatactcttacatttaaagtaatcattgataggtaagaatatactattgctattttgctgatttttttctggttgttttgtagaatccattgtttctttctctcttgctgtctttctttttgatttgatgattttttgcagtgctatgcttcgaatccttttgctttatattgtgtacatctgtttacctttgtagttatcatgaggcttacataaaatgtctgaagttataacagtttattttaagctaataagaacataacttcaactgcatataaaaattcaatattttaagttatcctacccccacattttatattattgatgttatataactttgtaatttttttatttgactttaagttctgggatacatgtgcagaacgtgcaggtttgatacatgccttagtggtttgctgcactgatcaacccatcatctagttttaaagccccacatgcattagctatttgtcctgattctctccctccccctgtgctctatccccagacaggccccagtgtgtgtttttcccctccctatgtccatgagttctcattgttcaactcctgtttatgagtgagaacatgaggtgttttgttttctgttcctgtgttagtttaatgaagatgatggctaccagcttcatccaagacccggcaaaggtcatgttctcattccttttcaaggctgcatagtattccatggtgtatatgtgccacattttttttatccagtctataattgattggcatttgggttggttccatgtctttgctattgtaaatactgctgcagtaaatatatgtgtgcatatgtctttataataggatgatttatatgcctttcgatatataatcagtaatgggattgttgggtcaaatagtatttctggttctagatccttgaggaattgccacactgtctcccacaatggttaaactaatttactttcccaccaacagcgtaaaagcattcctacttttccacagcctcaccaccatctgttgtttcttgactttttaataatcaccattctgactggcataagatggtatctcattgtagttttgattttcatttctctaatgatcagtgatgttgagcttttttcatatgtttgttggctgcataaatgtcttcttttgagaagtgtctgttcataccctttgcccactttttgatgggattgtttgtttttcttgtaaatttgtttaagttccttgtagattctggatattagacctttgtcagatgggtagattacaacatttttctcctattctgtaggtcgcctgttcactctgatgatagtttattttgctgtgcagaagctctttagtttaaatagatcccatttgtccggcttttgtttcaattgcttttggcattttcgtcatgaaatctttgtccatgccaaggtcctgaatgatattgtctaggttttcttctatggcttttatggtttgaagttttacatttaagtgtctaatccatcttgagttaatttttgtataatgcataaggggtccagtttcagttttctgcatatggctagccagttttcccagcaccacttattaaatagggaatcctttccccattgcttgtttttgtcaggtttgtcaaagatgagatggttgtagatgtgtggtgtgatttctgaggtctctgttctgttccattagtctatatgtctgttttggtaccagtaccatggtgttttggtttctgtagccttgcagtatagtgtgaagtcaagtagcatgatgcctccagctttgttctttttgcttaggattgtcttggctataccagctcttttttagatccacatggagtttaaagtagttttttctaaatctgtgaagaatgtcaatggtagcttgatggggatagcactgaatctataaattactttgggcagtatggccattttcatgatattgattcttcctatccatgaggatgggatgtttttccatttgtttgtgtcctctcttatttccttgagtgatggtttgtagttctcattaaagaggtccctcacatcccttgttaactgtattcctaggtattttattctctttgtagcaattgtgaatgggagttcattcatgatttggctctctgcctatctattgttggtgtatagaaatgcttgtgatttttgcacactgattttgtatcctgagactttgctgaggttgcttatcagcttaaggagttttggggttgagatgatagggttttctaaatatacaagcatgtcatcttcaaaaagagacaatttgactttctctcttcctatctgaatactctttaattctttctcttgcctgatggccctggccagaacttccaataccacattgaataggagtgatgtgagagggcatttttgtctcatgctggtttttaaagggaatgcctccaacttttgcccattcagtatgatactggctgttggtttgttataaatggctcttatcattttgagatatgttccatcaatacctagtttattgagagtttttaacatgaagggatattggattttattgaatgtcttttctgcatctattgagataatcgtgtggtttttgtcattgcttctgtttatgtgatggattacatttattcatttgcatatgttaaagcagccttgcatcccagggatggaacctacttgtggtggataagctttttgatgtgctgctggattcagtttgccagcattttattgagggttttcgcatgaatgttcttcaaggacattggcctgaagttttcttttttgttgtgtctccaccaggttttggtatcagggtgatgctagcctcataaaacaagttagggaggagtccctccttttcaactgtttggaatagtttcagaaggaatagtaccagctcctctttgtacctctggtagaattcggctgtgaatccatctggtcctgggctttttttttttttttttttttttttttttggttagtaggctattaattactgcctcaatttcagaacttgttattggtctattcagggatatgatttcttcattgtttagtcttgggagggtatatgtgtccaggaatttatccattttttctagattttctagtttatttgcacagaggtatttatagtattctctgatgattgtttgtatttctgtggggtcagtggtgatatcccctttattatttttattgtgtctatttcattcttctctcttttcttctttattaatgtagctagtggtctatctattttgttaattttttcaaaacaaacagctcctggattcactgatttttttgaagagtttttcatgtctctatctctttcagttctgctctgatcttagttatttcttgtcttctgctagcttttggatttgtttgctcttgcttctctaggtgctttagttgtgatgtgagggtgtcgatttgagatccttctatctttcccttgtgggcatttagtgctataaatttccctcttaatactgctttagctgtgtcccagagattctggtacattgtctctttgttctcattagtttcaaagaacttcttgatttctgccttaacttcattatttacccatgagtcattcaggagcaggttgttcaatttccatgtagttgtgtggttctgagtgagtttcttaatcctgagttctaatttgactacactgtggtctgagagactattattatcagtcctgagtcagtggctctcaggtgggctgcggcaacacactgctcttccttcctcttcatgggtcatgccagctgcctagtcagtcctgatgacagaacctggatacctcggttgccagtgcaaaattcacctgctgttttggtttttttggatgggagcctcccatcaccgctgctgcttctagtcagccatcttggccctgtgcacataactgtttatattatgtatcattaacaaattgttgtagctattgttaaatacttttaacctctatattattagagttacaagtgatgtatgcactatcattataatattcaagtattctaactttgactatattccttatagtcaatgttatactttcatgtgttgtcatatttttagttattgctttcatttctctttgatgaaatccctctagtgtttcttgtaagtcaggtatagtggtgatgaactcccataatttttgctcacctgggaaattatttacctttcctttatttctgaaagacagctttggaaggtataatattcttcgttgacattttttttctttcagcatttaaaatatatcatcccactgtctcctggcctgcaaagtttctgatgaaaaatccactgaccatgttatgattgttccctagtatgcaatcagttgtttttatcttactactttcaaattctctttgttgtttacgtttaggaatttgattatacaagacttaaaggtaagacctaaaagcataaaaacccaagaagaaaacctaagcaataccattcaggacataggcattggcaaagacttcatgattaaaacaccaaaagtaatggcaacaaaacccaaaatagacaaatgggatctaattaaactaaagagcttctgcacagaaaaagaaattatcatcagagtgaacaggcagcctacagaatgggagaaaatttttgcaatatatccatctgaaaaagggctaatatccagaatctacaaagaatttaaacaaatttacaagaaaaaaacaaacaactccatcaaaaagtgggcaaatgatatgaatagacacttctcaaaagaagacatttatgcggccaacaaacataggaaaaaaagttcattatcagtggtcattacagaaatgcaaatcaaaaccacaatgagataccatctcatgccagttggaatggcaatcattaaagagtcaggaaacaacagatgctggagaggatgtggagaaataggaacattttacactgctggtgggagtgtaaattagttcaaccattgtggaagacagtgtggcaattcctcaaagatctagaaccagaaatactatatgacccagcaattccattactgggtatatactcaaaggattataaatcattctactataaagacacatgcacacatatgtttattgcggcattgttcacaatagcaaagacttggaaccaacccaaatgtccatcaatgacaaactggataaagaaaatgtggcacatatacaccatggaatactatgcagccataaagaaggatgagttcatgtcctttgcagggacatggatgaagctggaaaccattattctcagcaaactaacacaaggacagaaaaccaaacatcgcatgttttcactcagaagtgggagatgaacaatgagaacacatggacacagggaggggaacatcacactccagggcctgtgtgggggtggaaggctaggggagggatagcattaggagaaatacttaatgtagatgaggggttgatgggtgcagcaaaccaccatggctcatgtatacctctgtaacaaacctgcacgctctgcacatgtatcccagaacttaaagtacaactaaaaacagaaagaatttgattataatgtttttggtgactatccatttgtgtttaatctattttaggctatttgagcttcatggatctggatgtttgtgttcctttccaaattcaggaattcttctgtagttatgtttttaagtagttttctgtcccattctttttctatgctcctctggaacttcattattcatatattgttctgtttgattgtatcccacaggctttctttactctttttcattttttctttttgtttctctaactgggtaatttcaaataacctgtctttgagttcactgatttttgtctcctgctagatcaagtctgccattagagttctctgtggaattttttagttcagtcattgtgtccttcagctccacaatttctgtttggttttattttatacattctatcttcttgttgaacttctcattttcttcatgtattgttttcctgattttgtttacttgcccatctgtgttctcttgtagctcactaagcttctttaacacaatggttctttgtcaggctattcatagatctccatttcattagggttagttcctgaagctttattttattcttttagtggtatgactttttcctgatttttcataattgctgtctttcattggtgtctgtgcatttgaaggaacaggctcttattctactctttacaaacaagcttcagcagggaacatccatcattactcagcccaccaagatattcagttggtaggcaaactggtgaggtccacaggtcaggtaggcttactgctgaatccttggtcaggttggccaggttcctgagtcagtgggcaggtaggcctgttgcctgtgtccacaggtgctagcctgaagcctgagtctgcaggggctggcctagcactttgttggacctggagcctgaatctgcaagggccagactggtacctcagtctactgaggatggcttggtgttaggacaggcctagagcgtggatctgcaagtaccggctttttgcctgggtcttcagtggccatactagagtctgtagccatcactgctacagacagtgctacagacaaaagttacttgcctgtaagggcagtactggagcctgtacccactgatgttggcctgaagcctggatctgccagggtgacctggtgctatgacaagcttgaagtgtaggtttgttgggtacatcctggcactggggtttactgggttgggcctggtgacatgactatgaggcaaagtgaggtccttacttcatcttcctttcccaacacatttctctgcactatcctgctcaggttggggtgaggggttatgccagtaatgtgaaactgtccttcctaccctctttaatgcatcttttcttatttatgtgctccatgtagatactgtaaactcttatctggaaaccttagcgcttgtgaacatatttttatgcacagatggttgtttcaactgatgtttctgtgaaggtgatatggtttggctctgtccctacccaaatctcatctcaaattgtaattctcacatgttgagggaggacctggtgggaggagactggatcatggtggtggtttcccccatgctattctcatgatagtgagggagttctcatgatatctgatggttttaaaagtggcagtttagcctgcattcattcattctctctctctctctcctgctaccttgtgaagaaaatacttgcttctcttccaccttctgccatgattgtaagtttcctgaggcctccctagccatgtgggactgtgagtcagttaaacttcttttctttttcttttttattttattttattattattatactttaagttttagggtacatgtgcacaatgtgcaggtttgttacatatgtatacatgtgccatgttggtgtactcacccaataactcatcatttagcattaggtatatttcctaatgctatccctccccccatccccaccccacaacagtccccagagtgtgatgttccccttcctgtgtccatgtgttctcattattcaattcccacctatgagggagaacatgcggtgtttggttttttgtccttgtgatagtttgctgagaatgatgatttccagtttcatccatgtccctacaaaggacatgaactcatcattttttatggctgcatagtattccatggtgtatatgtgccagattttcttaatccagtctatcattgttggacatttgggttggttccaagtctttgcgattgtgagtagtgccacaataaacatacgtgtgcatgtgtctttatagcagcatgatttataatcctttgggtacatacccagtaatgggatggctgggtcaaatggtatttctagatctagatccctgaggaatcaccacactgacttccacaatggttgaactagtttatagtcccaccaacagtgtaaaagtgttcctatttctccacatcctctccagcacctattgtttcctgacttttgaatgactgccattctaaatggtgtgagatggtatctcattgtggttttgatttgcatttccctgatggccagtgatgatgagcattttttcatgtgttttttggctgcataaatgtcttcttttgagaagtgtcttttcatatcctttgcccactttttgatggggttgtttgttttttttttgtaaatttgtttgagttcattgtagattctgcatattagccctttgtcagatgagtaggttgcgaaaattttctcccaatttctaggttgcctgttcactctgatggtagtttcttttgctgtgcagaagctctttagtttaatgatatcccatttgtcaattttggcttttgttgccattgcttttggtgttttagacatgaagtccttgcccatgccgatgtcctgaatggtattgcctaggttttcttctagactttttatggttttaggtctaacatgtaagtctttaatccatcttgaattaatttttgtataaggtgtaaggaagggatccagtttcagctttctacatatggctagccaggtgccagcaccatttattaaatagggaatccctttcccattgcttgtttttgtcaggtttgtcaaagatcaggtagttgtagatacgcagcattatttctgagggctctgttctgttccattgatctatatctctgttttgttaccagtaccatgatgttttggttactgtaaccttgtagtatagtttgaagtcaggtagcatgatgcctccgggtttattcttttggcttaggattgacttggcgatgcgggctcttttttggttccatatgaactttaaagtagttttttccaattctgtgaagaaaggcattggtagcttgatggggatggcattgaatgtataaattaccttgggcagtacggccattttcacaatattgattcttccaaccaatgagcacggaatattcttccatttgtttgtatcctcttttatttcattgagcagtggtttgtagttctccttgaagaggtccttcacgtccctcgtaaggtggattcctaggtattttattctctttgaagcaattgtgaatgggagttcactcatgatttggctctctgtttgtctgttgttggtgtataagaatgtttgtgatttttttacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacagtatgttgaataggagtggtgagagagggcatccctgtcttgtgccagttttcaaagggaatgcttccagtttttgcccattcagtatgagattggctgtgggtttgtcatagatagctcttattattttgagatatgtcccatcaatacctaatttattgagagtttttagcatgaagggttgttgaattttgtcaaaggccttttctgcatctattgagataatcatgtggtttttgtctttggttctgttcatatgctggattacatttattgatttgcatatattgaaccagccttgcatcccagggatgaagcccacttgatcatggtggataagctttttgatgtgctgctggattcggtttgccagtattttattgaggatttttgcctcaatgttcatcaaggatattggtctaaaattctcttttttggttgtatctctgcccggctttggtatcaggatgatactggcctgataaaatgagttagcgaggattccctctttttctattgataggaatagtttcagaaggaatggtaccagctcctccttgtacctctggtagaactcggctgtgaatccatctggtcctggactctttttggttggtaagctactgattattcccacaatttcagatcctgttattggtctattcagagattcaacttcttcctggtttagtcttaggaaggtgtatgtgtccaggaatttatccatttcttcaagattttctagtttatttgtgtagaggtgtttgtagtattctctgatggtagtttgtatttctgtgggattggtggtgatatcccctttatcattttttattgcgtctatttgattcttctctcttttcttctttattagtcttgctagcagtctatcagttttgttgatcttttcaaaaaaccagctcctggattcattaattctttgaagggttttttgtgtctttgtttaattcagttctgctctgattttagttatttcttgccttctgctagcttttgaatgtgcttgctcttgcttttctagttcttttaattatgatgttagggtgtcaattttagatctttcctgctttctcttgtgggcatttagtgctataaatttccctctacacactgctttgaatgtgtctcagagattctggtatgttgtgtctttgttctcattgatttcaaagaacatcttcatttctgccttcattttgttatttacccagtagtcattcaggagcaggttgttcagtttccatgtagttgagcggttttgagtgagtttcttaatcctgagttctagtttgattgcactgtggtctgagagacagttcgttataatttctgttcttttacatttgctgaggagtgctttacttccaactatgtggtcaattttggaataggtgtggtgtgatgctgaaaaatgtatattctgttgatttggggtggagagttctgtagatgtctattaggtctgcttggtgcagagctgagtttaattcctgggtatccttgttaactttctgtctcattgatcggtctaatgttgacagtggggtcttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctcttttatcagagactaggattgcaacccctgcctttttttgttttccatttgcttggtagatcttcctccatccctttattctgagcctatgtgtgtctctgcacctgagatgggtttcctgaatacaacacactgatgggtcttgactctttatccaatttgccagtctgtgtcttttaattggagcatatagcccatttacatttaaagttaatattgttatgtgtgaatttgatcctgtcattatgatgttagctggttattttgcttgttagttgatgcagtttcttcctagccttgatggtctttacaatttggcatgtttttgcagtggctggtactggttgttcctttccatgtttagtgcttccttcaggggctcttttagggcaggtctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccaagagatccactgttagtctgatgggcttccctttgtgggtaacgtgacctttctctctggctgcccctaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattttccccatcactttcaggtacatcaatcagacgtagatttggtcttttcacatagtcccatatttcttggagactttgtccgtttctttttattcttttttctctaaacttcccttcttgcttcatttcattcatttcatcttccatcactgataccctttcttccagttgatcgcatcggctcctgaggcttctgcattcttcacgtagttctcgagcgttggctttcagctccatcagctcctttaagcacttctctgcattgggtattctagttatacattcatctaatttttttccaagtttttaacttctttgccattggtttgaatttcctcctgtagctcggagtagtttgatcttctgaagccttcttctctcaactcatcaaagtcactctccatccagctttgttctgttactggtgaggaactgcattcctttggaggaggagaggagctctgcttttttgagtttccagtttttctgctctgttttttcgccatctttgtggtttcatctacttttggtctttgatgatggtgaagtacagatgtgtttttggggtggatgtcctttctgtttgttagttttccttctaacagacaggaccctcagctgcaggtctgttggagtttgctggaggtccactccagaccctgtttgcctgggtatcagcagcggtggctgcagaacagcgatgactgtagaacagcggattttcgtgaaccgcaaatgttgctgcctgatcagtcctctggaagttttgtctcagaggagtacttggccgtgtgaggtgtcaatctgcccctactgggggtgcctcccagttaggctgctcaggggtcagggaaccacttgaggagacagtctgcccgttctcagatctccagctgcgtgctgggggaaccactattctctttaaagctgtcagacggggacatttaagtctgcagaggttactgctgtctttttgtttgtctgtgccctgcccccagaggtggagcctacagaggcaggcaggcctccttgagctgtggtgggctccacccagttcgagctttctggctgctttgtttacctaagcaagcctgggcaatggcgggcacccctcccccagccttgctgccaccttgcagtttgatctcagactgctgtgctagcaatcagtgagactccatggttgtaggaccctccgagccatgtgcaggatataatctcctggtgtgccgttttttaagcccgttggaaaagcgcagtattagggtgggagtgaccagattttccaggtgccgtctgtcacccctttctttgactagcaaagggaactccctgaccccttgtgcttcccgagtgaggcaatgcctcaccctgcttcggcctgcgcacagttcgctgcacccactgtcctgcacccactgtctggcactccctagtgagatgaacctggtacctcagatggaaatgcagaaatcacctgtcttctgtgtcactcacgctgggagctgtagaccggagctgttcctattcagccatcttggctccttaccaacttctttcctttataaattacctagtttcatgtagtatctttatagcactgtgaaaacagactaatacagaggagtgtgcattggaaactcctattctcccatcatgctatcatcattcctcttgtctagtagtttcactgctgattatcaaatgttttccatgaacaaatcagagtgtggatagctacccaactggaacacctattatttacataacacccttccataacattaataggtcactgctgatctcaatgaaagttttcaaatccatatgtcctataaaattaaatcaacgaaacaccatttctcccattgcttgtgttttcaatgataaatataaccaaatgttgccaaagtcatctccacatatatatgtagcacacataagcaagggttaatttatactctgaattagtattttaatacaagaataaaccaaagtatctacacatttttgtacagatatttgacatatttgtaaatgctattgtaaacatatgccactgatattatataacatttgatagcatcatttcatgacagaattttactttcactgtgctttctctcaatataattactttcactggcttttcagtttgttttacaagaatatccagaagaaatgcatttggccacaaatatcaacaaacccaatactgtttttaaaaataaagttttatttgtattataaagcaagaagtccagaaataggctatgtaaatattaattcaagactcaacaatgtcaaaactcaggtctttaggattctcttgaacatcttttctttttgctatatcatggtcataaaatgactactgcaaatgtaattacccccatctgtattccaaaaggtataagaataaaaatggggaggatagcaaaaaggctctcctttattatcaaggattactttagtttactctttaagagtattcacttgcagttcaagtgaatttaaggattaattaatacagctggcaagtaatttatacaacaactactggaaatgtatatctcctcgtaaggaaagtatcaaaccttttttacttgtataaagaatagctttgctttgttaggtggaaacagagttgtttcgttgttgtgtaaaaggaaacagaagctgactaataaaaggagtgtattggctgtggccctttccaccccctagtgctgctgggcctgcaggcctttgttccacagtttgttaaagttgttaagaataaggcctgctttaagagataccaagtgaaatttagaagacgaggaaagggtaaaactgaataccatgcttggaaacacttagtgatacaggataaaaataaatataaaacacccaaatacaggatgatagttcgtgtaacaaacagagatatcatttgtcagattgcttatgcccatatagacagggatataatagtctgtgcagcatatgcacacgaactgccaaaatatggtatgaaggatggcctaacaaattatgttgcagcgtattgtactggcctcctgctggcctgcaggctactcaataggtttggcatggacaagatctatgaaggccaagtggaggtgactggcgatgaatacaatgtggaaagcattgatggtccgccgggtgcctttacctgctatttggatgcaggccttgccagaactaccactggcaataaagtttttggcaccctgaagggagctgtggatggaggcttgtctatccctcacagtaccaaatgattccctggttatgattctgaaagcaaggaatttatgtagaactacacaggaagcacattgtgggccagaatgttgcagaatgttgcagattacatgtaagatgaagataattacaagaaacagttctctcaatacataaagaacagagtaactccagacatgatggagatgtataggaaagctcatgctgctatacgagagaatccagtctatgaaaagaagcccaagaaagaagttaaaaagaggtggaatcgtcccaaaatgtcccttgctcagaagaaagatcgggtagctcaaaagaaagcaagccccctcaagagctcaggagtgggctgctgagagctaaaccaaacaattttctatgaagattttcagataaagacaataaaagtatggacagaaaaaaaaatggagtgtaccgtgttagttaccgatttattcctctgcctcgacatttatcctctttggcctaggttttactggatctggaccctgtacaaatttcttttgccagcttgtctaatattagttggcaagagagggcaccagatggacattgtatgtcatggtaaaggaaggggtttcacttcctaattctagtgtattttcttccttctgtggtgtgcctgctagtgacatgctggaggcccattgagtttctcaggaaccctcaaggacagcttcctgtagacaagccccaatctgccattacttcagttgataactacatacagataaactccggtccactgactccagtgaacttctttgccacccagtgaaccatagctatgccctctccagtgagatctcaatcttaggagcgggaggtgattcttccaagttcttagtgtatttcttgcccttctctctctctctttctcattctctttacccaatcccactaaagacagtacatttgtagaggcttcctacataagctgttttagtatagagtctagttttccattataagtagttgaccatttttaactaatttttaaatattaaattatcaacattcacattattggtgtgctttctatctcttgcctgaatcttatcagatacacaaggaacattcaccaggttgtgccctctggaccacatgagtctgtcaaacttatcaggcagattctcagactggtaagatgcagacggctcttcctttgaaaatggccaatgttcccaggggaaaggcaattccaaagacaagaggtatttgtttctattactcttctaataaataccacaaatttagtagcttaaaataacatacatttattaacttaatcacattggaaagtctcttttaccatgtcaaataacatatgcacaagttccagggattaggatatgaacatcgttagggggatataattctaccacagtaagcagtctagcccacaaagattcattcatctcacattcaatgcattcatcccatcctaatattcccaagagtcttaactcattacaacagcagctcaaagtctgaaatctaatctaaatctcatcagctcaaagaacccaaattcacatcatctgaaaaataaaaatcagatatggatgaaattctggatatgatccatctagggcaaaattcatctccatctgtagacttgcaaaactagaaaacaagttaacagctgtcaaaatacaagatggaataagtgtagaacaccagacaaacatttccattcaaaaaagaaaaatgggaagaaaaaagaaatcagccatctcaagcaatctcaaaaccctgtaaggaaaactccattgagtttcaaggcctaggaataacctgtgtggttcacagcttcaccctcagagaataggatggctctgactttggagtcaatcttcctttttcatgaagaatagcattgctttcagcataagtagttttatcagcctgcttcctgcctttagaattccagagtctcaatagtcttccttcatgtatccttctttctgtccctttcagtccaagctggcagtgctgctattgatataaaatctcatgaacattttgagtctcctacatctgtcatgggaattcactccacacaacagctcctctacaggtctttcctagataatgcaggtctatttttggcctcttcagagatggctgaagggatccatgagtcatacacctgatttcttcaaagagcttctgtgtgactgaatactctggctctagatccttccaaggcactagcaaaagataattcaaccacaacctcagttttctccccagaactcgctttcctgaaagtgaatcttcgaatttgagtgtctttttcaaattggataggttggaaatttcccgcatcatcaagtcctggtttcttttggcttaacagttcttccttcaatttgtgcttttcctgtcacattttactataagcagaaagaagaaacctcagcacaccttcaacacttggcagtctccttatccaaatccaaggacattccttacaaagtctagtttccacataattatgtaggacacaatttagctacactttctaccactctataacaagaatcccctttccaatagtttcaaataatgtcttcctcattttcttctgatccttcactagcagtaagtatctttaacgtccatatttctaccaacagtctgtttaggataattttctttttagagatatgaataaattagttttattttcttatagtagatgttttgaacctcatttaatagttccttgtttcgttgtggagaacagagctacagaattttatttcacctacttccactcagttatctctcttcctctttggagtttagtttctcttttttattttctatttcctaagtgtgaaagctgagtacattgattttacatctttcttcttttctaatataagcattaattctatatattacccactaaatacaagattttatcctacaaatgtcaatatgctatgttttcattttcacatagcttgaaatattttctgattttcctcataatttcctctttcacctatggtttatttggaagtatgttgctcaatttccaaattataataattttccagacatttttctgtgatttattttttgtaaacatttttgtgatcagagagcatattttctattatttcaatactttaaatatattaaaacttgttttattaataaaaatgttctatcttggtaaatgttctatgtgcatgtagaaatatgcgtattatgcatatttaaacatattgggtggcatgttctataagtgcttattaggtcacacttggctaatagtcctgttcaatcttctataacctcactgaggtctcactctatcaattattgagaccagagtagtgaaatagctacccataattgttaattctttatttctccattctattctgtcagttgttccctcaagcattctgaatctctatacatgcatatacctttaggattaccgtgtcttctcgatgatctctttctttttcattatgaaatatccctctttatctctagtaatactctttattcttatatgtattttatctgatactaatatagccactacagcatttttattgatgcttgcacaatatatcacttttcatgcttttacttttagcccatgggtatctacacattcaaagtatattaattagaaatagcacagttgtatcatgcttttatattttatattagttatctgcagaagaggacatagaagtattacaaaatcctagggttgcgtgctcttattctcatattggtactttccagaggctttctaaagcaccccagtttgcaacgaacacttcaagtattatttgatctgctgaatcataaggcctgaatgaaaaagtagcttgcaatgcagcctgaacgtactatagagctttgtcttcttctggttcccactcaaaactgcacacttatcagtatctcagtagaaaggccaaagtaacacacccaaatgcaatatatattatctctaaaacccagaaagacctaccaagagttgtaactctttttcatggtagatggtggaaggaatggcaacttgtctttcaccttggaggggatattttgacattatccaggccactggaccccagaaacttcactgcagtaagaggcccctgaaatttcatggggttaatcttccattatccggtttgcaagattcttcctacttacagctattcaaatctaatcagcataatgccatcaatataccagactatgttgttttgcaccagtaaaaatgctgtatctgagaaagcagctgcagtctctatcaccaccatctgattaagtctataatgacccacagtcacctcccaaaattaatctggcttctgcacagctcacataggcaaattacatagagatgtgataactatctctactcctgagtcttccaagtctctgatggtggcaataatctatgcaattccccagaaattcagtattgtatctggctttatacattatcaagggagaaatttccacaatgttgttaaaatggccatactgcccaaataaatttatagactcaatgctatttctattaaagtaccattgacattcttcagagaactagggaaaactaaaattcagatggaaccagaaaagagcctgaaaagccaaggcaatcttaagcaaaaagaaaaaagctagaggcagtatgctacccaacttcaaattagagtccaggcctacagtaaccaaaacagcatgatactggtacaaaaaaatagtcacatagaccaacagatcagaaaagaatacccagaaataagaccacacacctacaactatctgatcttcaacaatcttgacaaaaacaagcaatggggaaaggattttctattcattaaacggtgctgagataactggctagtcatatgcagaagactgaaactgggccccttctttacacaatgtacaaaaattaactcaagatagattaaagacttaaattttaaaattcatatggaaccaaaaaagagcctgcatagccaaagcaagactaagcaaaaagaacaaacgtggaggcatcacactacctgatttcaaactatactttaaggccagagtcaccaaaacagcatggtactggtataaaaacaggcacatagaccaatggaacagaatagagaacccagaaataaacccaaatacttaaagccaactgatattcaacaaacaaaaacataaagtggtgaaaggacacccttttcaacaaatgatgctaggataattgcctagccatatgtagagaatgaaattggatccaatctctaactttatataaaaatcaactcaagattgattaaggacttaaatttaagacctgaaactaaaaattctagaagataacattggaggaacccttctagatattggcttaggcaaggattttataaccaagaacccaaaagcaaatgcaattttaaaaaaagtaaatgggccaggcatggtggctcacacctgtaatcccagcactttgggaggctgagatgggcggatcacaaggtcaagagatggagactatcctggccaacatggtgaaaccccatctctactaaaaatacaaaaaattagctgggcgtggtggcctgtagtcccagcctatagtcccagctactcaggaggctgaggcagcagaatcgcttgaaaccggaaggcggaggttgcagtgagccgagatcatgccaccgcactccagcctgggcaaaaagaacaaaactctgtctcaaaaaaaataaaaaataaaaaaaagtaaataactgggacttgaactaaagagcttttgtgtggcaaaaggaacagtaagcagagtaaacagacaacccagagagtgggagaaaatcttcatactctatacaattgacagaggactaatatgcagaatctacaaagaaaacaaacaagtcagtaagcaaaaaacaaacaatcccatcaaaaagtgggctaaggacatgaatagaaaattatcaaaagaagatatacaaatggccaacaaacatgaaaaaatgctcaacatcactaatgatcagagaaatgcaaatcaaaaccacaatgtggtaccactttactcctgcaataatggccataatcaaaaaatcaaaaaataatagatgttagcatggatgtggtgaacagggaatacttctacactgctggtgggaatgtaaactggtacaactactatgaaacacagtgtggagattccttaaagaactaaaagtagttccaccatttgatccagcaatcccattattggtatctacccagaggaaaagaagtcactatacaaaaaagatacttgcacatgcatgtttatagcagtacaattcacaactgcaaaaccatggaaccaacccaaatgcctatgaatcaacgagtggaaaaagaaactctggtatatataaacttactcatgtaaccaaacaccacctgtaacccaataacttatgaaaaaataaaaaattttaaaaatcacgagataccatctaacacaagtcataatggaagacacagagactcccacacaataatagtgggaaactttaacacccgactgtcaacattagacagatcaatgagacagaaaattaacaacaatatccaggacttaaactcacttccggaccaagcagacctaatggacatctacagaactctccaccccaaatcaacagaatatacatttttctcagcaccacatcgtgcttattctaaaattgaccacataattggaagtaaaacactcctcagcaaatgcaaaagaacggaaatcataacaaactgtctctcagaccacggtgcaatcaaattagaacctaggattaagaaactcactcaaacccacacaactacatggaaactgaacaacctgctcctgaatgactactgggtaaataacaaaatgaaggcagaataaagatgttatttgaaaccaatgagaacaaagacgcatgtcccagatctctgggacacatttaaagcagtgtgtagagggaaatttatagcactaaatgctcacaagagaaagcaggaacgaactaaaatcaacaccctaacatcacaattaaaagaactagagaaacaagagcaaacaaattcaaaagctagcagaagacaagaaataattaagattagagcagaactgaagaagatagaaacacacacacacacaaaaaaaacccttcaaaaaaatcaatgaatccaggagctagttttttgaaaagatcaacaaaatagatagactgctagccagattaataaaaaagaaaagagagaagaatcaaatagatgcaataaaaaataataaaggggatatcaccaccaatcccacagaaatacaaactaacatcagataatactataaacaactctacgcaaataaactagaaaatctagaagaaatggataaatttccggacacatacaacccccaagaccaaaccaggaagaagttgaatccctaagtagaccaataacaagttctgaaattgaggcagtaattaatagcctaccaaccaaaaaatgtccaggaccagatggattcacagccaaattctaccaaaggtacaaagtagagctggtaccattccttctaaaactactccgaatgatagaaaaagagggaatccttcctaactcattttatgaggccagcataatcctcataccaaaacctggcagagacaacaaaaaaagaaaattttaggccaatatccctgatgaacatcgatgcgaaaatcctcaataaaatactggcaaaccgaatccagtagcacatcaaaaagcttatccaccacgatcaagtcagcttcatccctgggatgcaaagctgattcaacataggcaaatcaataaatgtaatccatcacataaacagaaccaacaacaaaaaccacatgattatctcaatagatgcagaaaaggcctttgacaaaattcaacaccccttaatgctaaaaactctcagtaaactaggtatcgatggaacgcatctcaaaataataagagctatttatgacaaacccacagccaatatcaaactgaatgggcaaaagctggaagcattccctttgaaaaccggcataagataaaaatgccctctcacaccactcctattcaacatagtattgaaagttctggccagggcaatttggcaagagaaaaaaataaacggtattcaattaggaaaagaggaactcaaattgtctctgtttgcagatgacatgattgtatatttagacaaccccatcgtctcagcccaaaatctcctcaagctgataagcaacttcagcaaagtctcaggatacaaaatcaaggtgcaaaaatcacaagcattcctatacatcaataacagacagagagccaaatcaggagtgaactcccattcacaactgctactaagagaataaaatacctaggaatacaacttacaagacatgtgaagtacctcttcaaggagaactacaaaccatcactcaaggaaataagagaggacacaaacaaatggaagaacattccatgctcatggataggaagaatcaatattgtgaaaacagccatcctgcccaaagtaattcatagattcaatgctatccgcatcaagctaccattgacattcttcacagaactggaaaaaactactttaaatttcatatgaaaccaaaaaagagccctcatagacaagacaatcctaagcaaaaagaacaaagctggaggcatcacgctacctgactttaaactatactacaagcctacagtaaccaaaacagcatattaccgtaccaaaacagatatatagaccaatggaacagaacagatgcctcagaaataacaccacacatctacaaccatctgatctttgacaaacctgacaaaaacaagaaatggggaaaggattccctatttaataaataatgttgagaaaactggctagccatgtgcagaaagctgaaactggatcccttccttacaccttatacaaaaattaactcaagatggattaaagtcttaaatgtaagatctaaaaccataaaaactctagaagaaaacctaggcaataccattcaggacataggcatgggcaaagacttcttgattaaaacaccaaaagcaatggcaacaaaatccaaaatagacaaatgggatctaattaaactaaagagcttctgcacagaaaaagaaacgatcatcagagtgaacaggcaacctacagaatgggagaaaaattctgcaatctctccatctgaaaaagggctaagatccagaatctacaaagaacttaaacaaatttacaagaaaaaaacaaacaaccccatcaaaaagtgggcaaaggatatgaacagacacttctcaaaagaagacatttatgcggccaacaaacatagggaaaaaaagctcattatcactggtcattacagaaatgcaaatcaaaaccacaatgagataccatctcatgccagttagaaaggcgatcattaaaagtcaggaaacagatgctggagaggatgtggagaaataggaacgctcttccactgttggtgggaatgtaaatgagttcaaccattgtggaagacagtatggtgattcctcaaggatctagaactagaaataccatttgacccagcaatccagttactgggtatatacccaaaggattataaatcattctactataaagacacatgcacacatatgtttattgcggcattgttcacaatagcaaagacttggaaccaacccaaatgcccatcaatgacaaactggataaagaaaatgtggcacatatacaccatggaatactatgcagccataaaaaaggatgagttcatgtcctttgcagggacatggatgaagctggaaaccatcattctcagcaaactaacacaagaacagaaaatcaaacactgcatgttctcactcagaagtgggagatgaacaatgagaacacatggacacagggaggggaacatcacacaccagggcctgtcgaggggtgggggctaggggagggatagcattaggagaaatacctaatgtagatgatgggtttatgggtgcagcaaaccaccatggcacatgtatacctctgtaacaaacctacatgttctgcacatataccccagaacttaaagtataataaaaataaataaatttttaaaaacacaatactcaaaaaaagagaaaaaaagtcaaaaaaataacagatgctggtgaagttttcgagataaaggaacacttatacactgttggtgcgactgtaaattagttcagccattgtggaagaaagtatggtgattcctcaaagacttcaagacagaataccattcaacccagcaatcccattactgggtatatacacaaaggaatataaattattctattataaagatacatgcatgcatatgttcactgtaacaccattcacaatagcaaggacgtggaatcaacctaaatgaccatcaaagatagactagataaagaaaatgtggtacatgtataccatgaaatactatgcagcaataaaaaagaacaagatcatgtcctttgcagggacatggatggagcaggaggtcattattctcagcaaactaacacaagaacagaaaaccaaataccacgtattctgtcttataagtgggagctaaatgatgagaacacatggacaccgagaggaacaacacatactgaggtctttcagagggtggagggtgggaagagggagaggatgagaaaaaaataactaacgggtaccaggcttaatacctaggtgataaaatagtttgtacaacaaacccccttgacacaagtttacctatgtaacaaacctgcacttgtatcactgaacttaaaataaaagttaaaaaagaagacacaaagattaaaggtataaaaaattattttaagaataaaaaatcaacacaactaaaaatatagttttcttagtcataaaaattgtatgctttaagccacaaaatttttcaagttagcgaaaattgaccactttatgcaaactagaattagcaaaattaactttaaaaaatagtaaacctgaataaatcaatgtcgattaaataatctgaagtaatagacaaatatctctcccaagaagaaacacccaggcccaggtagttttataaacaatttctaataattcttcaaggaagaaaatttccctatttgtgctaacttttccaatgagtgaaaaaaagagggaacacttataaaatcttcataccaaaaccaaaaatggagaacacaagaaaagcatgtagcaatcccacttatgaacacatatgcaaacgtaccagtaaatttaaaaactactaatatataacaaatgcaagatgctttaatatcaagaaaaatgtattcacatactttatgacccaaacaaattaagggagacaagtcttataaacatcttaatgtatatacaaaattaataaatttcaacacacactaatgagtattttttaagccagcaaaattaaggctagaagataataaaagatatgtcccaaaaacccacagcatcatacctataagtaaaatttaataagcatttctatttatcaggaagacaaagatgtctatcactgatacgcaacatagtatgtcttagtggatgtaatgaaaggaaaaaaagaaagggaaagaggaaaggagtaagggagtgagaaagcaaagaggaagacaattcaaggaaaacacaaaagaattaaaaaagaatattcaaagttattattttaaggaactcttcctatagaaaaaccataagcaagttaaagagttgctggatcaaagaacaaaatacataaatcaacattgttcctacataccaacaataattcataagaaaatacagatttaaaaagatgtaatttgcaacagcaaataaaagcctacatggtgtctagaaataaatttaacaaatatgtacaagacctttgaggaaaaatttgtaaatatcatgaaagaagataaatatagatctaaacagagagatatagcatggtttagatgtgacgattgtataataaatgtgatccaaatgaagcttttgttttttgcttttgctttttatttttttaatttttcttttaagacagggtcttgctatggtgcccaggctagccttgaactcctgggctaaagctatcttcccacctcagcctcccaagtacctaggactacaggcacatgttactgcacctggcttgttttggttttttgactgagacaaacagattctaaaattaataacggaagatcatatgtctatgaaaagccaagaaatatatcatatggaagaattaaaggtgagggcagtataggggatcttagtccatttgatacaagatttgttaaactgtaaagttaaaaatagtgtggtattggtttgagattagaaacagatcagtagaaccaaatagaaatctcagaagtggaaacaatttttttttattttatttcatttactagtacaatgtatattacagaagcaccattacaaatcagtggagaaaagagtatgtaacgtaggcatattttggtaactgcttttaaacacaaataagagaatctcacatcccatgcacacaaaaaaaagtgttccacataaatgtcaaatctcagcaagaattcaaaagaaaatataaaatagccttatttcaacaaggtaggaaaaatatttctcaaaaaagataccaaaaaataaaacctgtgaataaaaaaattaataaatttgatcatactgaaaaaaatctgtagagaaagtccatgaacaaagtaaaacgaatagccaaggattagaaaatattaaacacatctaaaagacattaggactggtatccagaatacataacaactgcctaaaaatcaacaggcagagaatatgaacaggaattcatagaagaggaaatagaaacagcaaataaacataggaaacaatgtcaacttacatagtaaaaagagaaatagaacctaagagatacacatacccatcactctgaagtcagaaaatactaagtgttgatgaggattgctgagacaagaactctgcccaacgttaaaataataagtaagtataaccacattaggaaagaaattggtaatagctaataaagttgaaaatgcacataccttacaaaccagcaattgctgactggttatatacccttgtgtatcaaagacacaggcaaagacggttagtgcaacattatttgtaatagcaaaaaattagaatcaaactaaatgtatattagtatgtatatatataaatgaactgtactagtcatacaatagaattctacactggaggaaaactaattaaaacaatcctacttgtatgaatgtgaataaatcccccgtgggagaaaaaaagttttaaaaatatttaaaatatgaccatttatttaactttctaaatagatcatttgtgaataaatatctatcccaccctcccacttttgggagtgtccaatgtctgtgtacatatacatatttcttttgtgtatatatatatatacaagaaatacatatatatataccatatttcttttgtgtaaatatgtatacacaaaagtggagggtggaagagggatgagggatgggtgcaatgcacattatttgggtgacagttacactaaaagcccaatatttaccattgtgcagtatattcatgtaacaaaactgcctttgcaccccttaaaattacatatgtgatacatatatatatatatatctcacattttctttatccagtcatccactgatggacacttaggttgattccatgacttcactattgtgaagagtgctgtgataaatatatgtcaggaatcttttttatatatgatgtattttcctttgggtagatatctagtagtgggattgctggatgaaatggtaattctaattttatttctttaagaagattccatattattttccataaaggctgtactaatttacatttctaccaatagtgtataactgttcccttgtttctgcatccttgccaacatctgttattctttgactttttaataatagccattctgactggtgtaagaaaatatctcattgtagttttgatttgcatttctctgatgattagtgatattgaacattttttcatatctttgttggccacttgtatatcttcttttgaaaaatgtctctttatgccctttgcccactctttattggggcttttagggtttgtcgttcttgtttgagttacttgtagattatggatattagtcccttgtcagatgcatagtccgaaaatatcttccctcattctgcaagttgtctgttcactctgttgattatttattttgctatgcagaagctttttagtttaattaagtcccatttgcctatttgttttggttgcttgtgtttttaaggtcttagtcataaattctttgcctgggccaatgtccggaaaaatttttcctaggttttcttctaggatttttagagcttcaggtcttacatttaagtcttgaattcatcttgggttgatttttttatatggtgagagatatgggtccaatttcactcttttagtatggctagccaattttcccggcaccatttattgactaaggaccttttccctatatatgtttttgttgactttattaaagataagttggctgtaggtatgtgggtttatttctgggttctctattctgttccattgatctatgtgtctatttttataccagtaccatgctattttggttacttagccttgtattaagactataattcgaagtcagacaatgtgatgtctcctgctttgttccttttgcttaggattgccttggatagtcgagctcttttttgtttccatatgagtttttagaattattttttctacttctgtgaaaaacgacattggtattttgacaggaattgcattaaatctgtagactgctttaagaatcaacattgaatcaaaagaatcagtatttcaacaatattgattcttcccatttcacgagcatgggatacttactcatttgtctgtgtcatctacgatttctttcatcagtgtttcaccattttcctttcttttcacttccttggttaaatatattcctaggtattttattatttttgtagctattgtaaatgggattgatttcttgatttggttctcagcttatttttggtatatagaaatgctactgatttttgtacactgatttcatatctcgaaactttactgaattcatttatcaaatgttaagagtcttttggagaaggctctagggttttctacacacaatttcatatcagcaaccagagataatttgaaatcctcttttccaattcagatgtattctttctgtctcttgcctgattgctctggctagaactttccatactatgttgaataggagtggtaaaattgaacatcctgtcttgttccacttcttgtgggagaagaggatattttaacctttctccattctgtatgatgttggctgtgggtttgttgcctatggcttttatcattttgaggtatgtgttccttctatgcctagtttttgagggttcttatcatgaagtgatgctaaattttatcaaatgctgcttctgcatctattgagatgatcatatagttttttgtttttaattttgtttatgcaatgaatcacatttattgatatgtatatgttgaaccctccttgcatttctggaataaaacccacttgatcgtggtgtattacatttttgaggtgctcatggattcagtttgctagtattttgtgggagatttttgcatctgtgttcatcagagatattgttctgtagttttctttttgtgttatatccttgtctggctttgctatcagggtgacattgactttgtaaaatgagttagggaggatttcctcctcttcaacacatgggaataatttccgcagaattggtacaagttcttctttgtatgtttggtagaatttggctatgaatccatctggtcctaggctttcttttcttaggagattttttattactgattcaatctcactacttgttattgctctgtttagaatttctgtttcttcgtggttcaatctggaaataatatgtttccaggaatttatccatttcctctaggttttctaagtgtgtgggcatatcgtcattcatagcagtctctgataatcttttgtatttttatgagatcattcataagtgtgtcttttttcatttctgattctttatttggattttctctgttttttttggtaagtctagtgagtggtttatcaattttgtcttttcaaaaacacaacttttcatttcattgatttttttgtactttttttacttcaattttatatagttctactctgatctttgttctttctttccttttgctagctttgggtttggtttgctttggtttctctagactcataaggtgtaacagtaggttactaatttgtggtgtttctttttatgtttgcatttaacactataaacttccctcttaacactgtttttgctgtgtcccagatgttctggtatgttgtgtccccatttttattcatttcaaaaaaaatcaatttttatcttaattttgcattcttcaggagcctgttgtttaatctccatgtatttgtaaagtttcaagagcacctattgttattgacttctcttttaattcaatatgggttaagaaaatatgtattataattttgattttcaaaaatttattgaaacttcttctctgacctgaaaaaatctatcttggaagtgttccatgtgctgatgagaaaaaatgtatatattctgcagttattgagtagaatattctattaggtccatttggtctaaagtccaatttaagtccagtgtttctttgttgattttctgtgtcaatgatctgtctagtgttgtcagtggggtgttgaagtcccccactattatcaaattgtaagaagggtattgaagtgtcctactattattatattgctatcaatttatcatttcagatctgtcaatatttgctatatatatttaaggactcaaatgttgggtgcatatattacaatggttatatcttcctactgaattgaccctttcatcattgtgaagtaaccttttagtctctaaagatagtttttttactaaagcgtacttttctaacataactacagccattcctcttttatttcatttacaatttgcatggaatatccttttccatcttttcacttttagcatatgtgtatccttgaatctaaagtgagtttcttataacagcacgcagttggatgttgtttttaatctagtcatcactccattatctttttaattgtagagcttatttcatatacatctttaataattattaataaagatttactattgctattttcttagctatttattaactatttgtcttgtagttcttttgtccctctttttctcttgctgtcttttgtgtttttttgtattgacagtttggattactttatctgttgtgtaacttttataagtattttccttgtggttaccaaggggcttacataaaatattttataatagtctattttaggctgataacaatgtaacttcccttgcatccaagtactcttcaatttacctctcctcccgcatattatatgctattgatgtaaaatttacatgtatttatattacatatgcattaacatactttagttatcattgtctttaatactttcatcttttttctttaataaaaattacttaaaacaattaggattatttgtctaaattcttttatgaatttattttatttttattttttacttttaggtttgggagtacatgtgcaggtgtgtgatataggtaaactcatgtcatgggagtatgttgtacagattattttttgtcacccaggcactaagtctagtacccagtgattattttttctgctcctctccctcctccccacctccaccctcaagtaggccccagtgtctgttgttcccttctttgtgttcatgagttctcatcacttagctcccacttatatgtgaggacaaacagaatttggttttctgttcctgcattagtttgctaaggataatgacctccagctacaatttacctctcctcccctcacaatatatgctattgctgtcaaattttacatatatttgttatgtatatattagcataatttagttaccattgtctttaatactttttaacttttatagtagaattaaaagtgatttactcatcactattatagtaatatactactttcttttgatctatgtatttacctttaccaacaagtttcatactttcctacactcttgtgtttctgtttagcatcctttcatctcaactttaaaaattctctttagcaatttggtcacaacagtgacagaaattgctggataagcgaagtgccactgggttctttgccctcccttcacaccttgggataaatctgtatcaagatggttcttttctagattttctctacctttctgcacttacctttctgctctgagaagcacagctacctgccttcactgaaatatacctcaggctgagagatttggggtgggagagcaggtcagttcatcttctgcaggaaggtgcagcttttccatatcagctcaaccatgccgccagtccattcttaaggaactgctgaccaggactgatgatgatgcattttagctttgagtttttgggggttattctaccaataaacagtctattgggaagaaaacagtcccaggaattaacagatcagaatgttcacactggttaatctttttctaacaatgagcatgaaaggtagcagaagctggtatgtttccagatggttcttctaatcaaactaatttttcactgttgacaagtgaggcaagggttgcactggaccgaaggctgaggcttggccatctagcattccacacaaaattgtttcccataagcattccttttattctctattctatcctaggtctgcctcaccatgagacaggaaagcctccagtactagctgttgtagcagtgcccttcatccagggcagctaaaggagtcttggacccttgctttctctgggatccctgcccagcaccttcctacagagatgactttaaaaggaaaaaaaaaaaaggaaaaacaacaccccattccaaggagtctggcattcctgaatcctccttccctgctaggtgcctgtcacctgtcttcactgcctccttttccctgtcatgctcatcagcttatggcttctgtccaagcacctgaacagaggactagaacctccactgcacgctggttttaggtcttgatttatgtcagaatcttgcatagcactgctaatgtaaatttcagttttttccctctaagacaaacaccaaaatatccaactttttttggtgggaagagagattgtcctgtgatttctatccatttcctgaggcctgtggaaataaacttcatgtacttaaagttatacagaaaatagaataaacttaacaccaaacttgaaaaaacaattccctttggcatttcttgtaaaacaagtctagtggtgataaactcccttggcttttatttgcctgaaaaagtccttatctccccttcattttagtaggataggtttgctcatatagtatttgggggtgaccatttttttcttttagcactttgattatattaccctactcccttctgacctgcaagatttttgctaaaaaatatttatttatttatttatctattttaataaatctgctgattgtcttatggcgctcccatgtacacaagttgcttttctctagctgctttcaaaattctctagcatttgaccacttgtatatgttgtgcctctttgcattcattttatttggtgtcctttgggcttcctggagctggattactattttcttccctaggtttggaaatttttcagccattatttctttgaataagctttctatcccttcctctttctcttctctccttctttaattcaaataatgtatacattgttctgctgagtggtatccataagtcccttaagtgatcttcatagttttttcattcttttttttttttttggctcctttgattagaaaatttccaatgacctgtcttcaaattcactgatcatttcttctgttctctctagtctgctattgaacatctccactgaatttttcagatcagttgctggattcttcagctctatcacttctgtctgacttttttctatctctgttgaaattctcacattgttcatacaatgctctcctgatctcagtaaggatccttatggccattattttggattctttgttagataaattacttatctaaatttcatgagggccagtttctggagctttgttatttcatttggaacatatttccctatttcttcatcttccttgactctctttattgcttttggcatattagactataactctcccagtctcgtcagactggccatgtgtaggagatgaacctaaccaatcagcctggccagagattctgggtgcctctgaaaccagtgagcttgtccaaaatctcatctttgctcttaccgtcccccaggagattagggtgtgccaagcccattcagtgcccctagaaagtcagtatggaattaagtccttcaagatgcggccaaaaaagttgaggagttagacatgtgttccagttccttttctcctcagggagaaactggtagctaattttatctcactcactctgctctaagatggagagaggatcagtggcaaacatctccactctcattcagaccacacactctttaaacccactgctttgctttttgtcacccctggcttccatctgctctcagaaacaggtggaatagctggagtcttggttctatctcttgagtgaaccacaaggaggagctacagaaatttcccacacactcatttagtctcccagagaaatacaaatagcctgtttcatcagctgccagatgtgagctaattaaaggcccgacccacaggcagcagctggtaatgttaggacattaggtgtgtagtcaaaccccttccagggagaaattgggagctagctgttgtagccttcttgctctgcactagccagaaggagtagccactagaaatgttcacacatccatttaaacccacctcttcgttctatgtggtctcagggaactcccaaatgccaagaaccattcagccccagagctaggtgattcaagtagccagcccctcaagtaggagctttaaaagctgcatgcttatgtgtggataaactgacaaggagaagctggagacctgattttatcactgaagcaggacagggataaaaagcatgaggagcgcccatacacttatttaaacttccctagaggtctacctgtttcatcagctcccagatgcaggcaagttagaaacctgacccacaggcagcagcttggaaattgtgcaggcaaatcccttccagggagaaacggggatctaggagtttctgcctattcactctgcattaaattcatgggatagctgctggaagtgctcatgcgcctgtttaaatccacatctttattctctgtggtcctagaagactcacaagtgtagaggcctatcagttcccacagctagatgatttagaagccaatccctcatgtaggagctataaaagttggagcactcaatacgtgaacaaactcctttgaaagacaagctgaagacctggttttattgctagagccagccacaaggaaaaggtaggtcttgtatttttagaaataaccaaaggaaacttctgtatttaaatacaacaatttttataatattcttcatatttttctgcattgcaaacttttcaagaatttattctgagattttaaaatgttaataaagtatggattaaacacgagctaaaaaaataagtggatacgtgatacataaatgtagatgacaacatttttcctgataaaaagaaaactctcacagagattatagagaccggagacagtatttctcaactaaacgtagtattaaggtcaccagaagaactctaaaactatacaagtgactaccaaccctactgactcagatgctagggacaaaagtatggtttttttaagtgtaattctagtgcacataaatatcctggggaatgtacagaccaagggggcagaaggcataactctccagcttggaaaggatgaagcaatgtattataatcttccccagattctcttggctttctcttttaatctacaagataaaataagataaaataggaaaaagaatttacagaggaactccaggttttcaagaataataagacactatcctggattagagttcatataattagagaaagtagcaaagcaactaatcctatctgaagaacaaagtttatcttaaattagaaagagcagttaatgttatatgtaggctttttgatgcagaaaacaaaagaaagtacacataaaaaattttgagagatcttggtgggttccctgctgcagtgctcatcctgtgctctcttgttccctgggctgtctcctccgcttgctttctggctctaccatgccctgctctgaagagacacctgccatttccctcaagaagcaggccagccctgcggaggagagtggcatgcagccccactttgcctggctccctgagcacaccgcagactcaactcagggatccacagggaccacagactatgacctatacagtgcctattattatacaatactacctatggacaaagttcttgtgaaaacagacatccagatatgtcttgcatgtggatgttatggaatagttgctctatggtctggcttggctgcaaaacactttatagatgtaggagctggtgtcatataaagactacagaggaaattttggtgatataatgtttaattttggcaaagaaaagtttgaagtcaaaaaaatgattggattgcacagctcatttatgaatgaattttttatacataaagagatattcaagacttggatgatactgaagggggttcaggagattttggtttcactggaaaaaatcaaaatttatgccaagaatagtaaatgaaaaaattatacctttttcttaaaagtaaagagtttttgcttaaaaagaaaaacaaaaaaacttaattcctttttcctttaaagcagaatttgtcaaaattataattagttaaataatgctaaataagaattaaatttgtggggtagaagggtctctaatgaacactcgacttgaagttttagaataaaatgtagctgggtcagaatatcaagcccgttgtttactacctataaaactttggttgaattacttaacctgcatgagcttgagcttcctcagcttcagaataaaaataaacactaaggataacactaaacattttattataccagaaagcaaggaaggaatcaaagattgcttggtttatgtaaaaagaacccaggagctaaatccaaaggctcccaactatcaaaaacagaacatattgagcagcagtaagaatacttattgaaacacatatatttaactctatgaatccataatgatagtttttaaaaaataaatgatcaccattggaggatgctaagcaacaatttatcttttgaaaagcaataaattttaaaaatcaagcatgtatcttgccttttctatatgtactataccacagttccaacagtaaacagttttatttcaactaataagactaaaatttataggctatggccattcttcaactcctaataaataataggtctagattttgatcatcaatggccaccaatattacaaagagagagaaaacaaacatttatgtccctcctgatttttttagtacacaataccatctacaaagcagtcttgctgaaaggattgtgcattaatctgattatgcctctagtctacaaatttatagaaaatacaaaagacaaagaaacatactaaaagacaccattgggaaatactcagaaaagccagactaggaaattcaagagaataataaacttattttgataaatataatataatgaagagatagagaggaagcatatgtatttttacaaattaagaactatatcaaccaattacaatgtatggatcttatttggattctgattaaaacaaaatttattaaaaatatgaggcaattgggaaaatttgaacacaaagaagctagctgaggatattaaactattttcattttataagtatgatattagcattgtgattatgtttgaggtatacatattaaaatgtttacagattaaaatatatatctggtatttacatcaaaataattgaagaaggaaagtagaaataaaacatggttgaccatgaattgaaaattattaaagctgagtgatgggcacatgaggattcatgataatagtctctccacttttgtgtttgttttgcattattcacattaagttttttattttttaaaaaaaagggggttctgcccctctctcttcctgaatccttgcttatactggccaggctgcttttcagtgagaaggcatctgacagagagctcattacagcctctgaccatactcacaggagttgaggaacattgaatctgagggagagcctgaattcctacaaaagctcatctctaaggtttccaccttgaactagatctgctaaaagacaatcatcaaaaaagtgaggctaataaaagagaaaaatcataccaatgtttttaacgaaaaggaagccgggcgcggtggctcacgcctgtaatcccagcactttgggaggttgaggcgggtggatcatgaggtcaggagatcaagaccatcctggctaacatggtgaaaccccgtccctactaaaaatacaaaaaattagccgggcgtggtgtcggacgcctgtagtcccagctactcgggaggctgaggcaggagaatggcatgaacctgggaggcggagcttgcagtgagccgagatcgtgccactgcactccagcctgggcgacacagagagactccatctcaaaaaaaagaaaaaaaaaaaggaaaaaaattgatgtcaggaagatggcagaataggaattctctgtcttcactccccatcaacagaaatccaaacaattgctgaatcctgttcacatctttgcctaactaatgagagatccaccttaggtagctagctagaaatgccaaaggaagttagttccctaatctgccaaagttaaaattaattctatcaaagttaaagatgatcctaacaaaactgaagtacctacctgatcatctatactgatgctaccttatcaatatttgcaaaatttttttctagcacagaagaaaaacgatcacaaaatgaaggtttttatggtttgaatatgtccttccaattttttctgctgaaaatttaatccccacattcatatgttgatggcattgggaaatggggctttagggaggcaattaggattagataaagtcatcaaggtgggaaccccatgataggactagtggctttataggaaggaagacagacctgagctgacatgctcccttgctctcatcacgtgatactttccaccatattatgatataacacaaacaccttgccagatgcttgtgctatgctcttcaacttcccagtctccagaatcatgagccaaataaacttattttctttataagttacctagtttgtaataatcagttatagcaatgggaaacaaacctaagacaaagattttggaggttctgcatattgtcaagcagaagaagagaggacatattgcttgagagcatcatagaggaacaaaagctctggccaatatacataaataggaaacacgctgggcgcagtggctcaagcctcactttgggagacaggtggattccctgaggtcagaatttccagaccagcctgaccaacatggtgaaacgctgtcgctactaaaaatacaaaattagccaggtgtggtggtgcaagcctataatcccaactactcaagaggctgaggcaggagaatcatttgaacacgggaggcggaggttgaagtgagctgagattgcatcattgcactccagcctgggccacgagagcaaaactctgtctcaaaaaaaaaaaaaaaaagaaacaaattcacattcaactataaaacctattatctcccaaaaatttctcaagtggggaaaaaggatatgatagagattgaaaccctctatccccagaagcccttctttttggcaatccatgtaatttattgcttaaggcatttattggagacaagtttcttatggctcttatttgtttatctcttgagatgaggaatatacctgaacttatcaagtcaaagctaatattcactaactttagtcttgtattacaataaaaatagctcattagtttttttcattttaaaaatattatctattaattgagttctcacacctgcctcctgctccaccccaagtggtaactagccactgttaatattttggtcaacatcctttcagatctctgtctaaggatatacatataggtatgatagagttttaaattaaatatgtttttatgttttgttgatgacttttttaaagttcaataatacattcttcacatttagcactccattttaatatacatcaatataaatgtgaaaatataaaaggctaaaaatatataccttaggcagtaattaggataattaacagaagcaaatgtttggtgactagaaagcattaaataaaatcacatatttaaaatacttaacacagtggctatcacttacttagtaggcattgaaccaatgacccattctggagaagaatctgtatagtatgtctatatactcataaataagtaccacctattaaaagatagctagtaacaaccacccgatgctaaatttgactggctttcaaagagatagtaaattcggtgactgaatcctgtcctttccctccctaacctcactgaggaagggaaaatacagtcttattctcagaaagaaatcacatcaagatataccttacctctcaagttttgaggaatataaaaggactgatgaaacattagaaaacagtagttctcaatggctggctagttggttagttttcctgacagtttgttaggccagacagaaggcctgaggcccatttataccatacctttccaatttcttacaacaaaatgatcaaaaggaatttgaaaaaataattaaagtggtataaaaatctaggtatatcataattaataggacttagtctccattaacccccaaaataacatcaaaatagtctcccaaaaatataattgatttttatgagaacttaatgtaaacatgcaacaagagatccactctcaacccttcatgtaaacacatctgttgctaatcatacgttcagaatcccttgcttagagtataggcatagtcattccatatcctttaatattctggattctatagacacttccagcagagacaaactctattagagccattaactatagctatataaaacctttaagaatcaatctctaaatacttataaaagcaaataacaaaaaaaaaatctaaatttgagtaaaagtaaacacagtttctctgactttaggcttttatttagtgcctgtcttcaaatgtacttcctccttccattttcttctgtacatcagtttagatgaccaataattttatctttgtccttcacaagaattgcattaattgccttgagacataattgtggaaacattaactggtttcttttggcaacattttatggtaaatgttcattcactgaaagctaaagatatataaatcctgtgtatatatctcatttcacaaaataaacaaagatagttatatatgatttttttcagaggctttaatccgcaaattcatttgttggatgatatgcttctaataaataaactactaaagacttttaaattagtcctgaattttgtagcagttccattttgagctttcattataattcaaaccaaatttattatctacttatctggtttatcctgaagcctctaacttctggctaaatctttctctggtctctttaagacatattccttacaaatacaacaaatttttatgatacaggggaaaatatcatagttcagaacataaattttttaaagagaaaaacagcttaggtcatgctccaatttttatttttcaccatcactttatgatcactatgtttttataactttcatgcaaaacagctggtatttagcaataatcaaatcacaacgcataaccccatgcagcagggtacaaaaagcacaggtgttactccatataaagtttaattttgcaatttacattttttacaatttactccaaagaatcaaaatacaaatgaggacagttgttcttcaaaaggaacacccctaaattattatgaatgtgaggaaaaataacctttgcattggattataattgtgagcaaaaataactaatataacaagcttgttttgttacagactattaaatgtgaccactcaagatacttagagctcaaaattctttggtaaatcatctttattttatctgctaatgttttaactcaaaaattgttattaaaaattttaatcttaataaattctacatttactgtaaaataaaattcttataactgagatccatcttgcatccatccagaaagtttgttattgaaaatattaacaaatcactagctctgaaaataattaaaataatgaggcttgtgtatattctattcagtgatttgatgcaattttcctttggtggagtttctttcacaatatttcaataagttataagttcagccataaaatgactgaaacatgctaaatatttaataaaattttttattataattttgagcaaaatgtcttatagtcaaaaacctctgaagtctacagctaggacaaaactaatgtcctacattaagtgtatagcacttaaccctttactctccagaaaaatgtatagctgttagcccttcactctccagaaatagagtctacagctagggcactcctactggaatgttcctagaagctacgctgaggtagggaaagctgagactaggctggatcacaaaaagtctgggagaggactagatcatgaagacctgaaacagccaatgggagaatcctagattatagcagagaaaccaaaagagaactgccaatataattttgggacataatgcaacaagaaaatgtggaattccttgttcaaaactcactaagaatttcaagacagcagtggaggagatttaaattaagtgtttgcatggggaaggcaagatggccaactagatgcagacaagtgaaacagctcccatggagggactgagatgactgccatgttttttaacagatcttcagagggaaggtgctgaaagtgtatggaggaaagacccagaagctgggctgaacggagagaaagctaggaaccccacatgggctaagagcaccagactcatttttgaaccgcaacagcactgagggaatgggtgagttaaactggcaaggagcaacccactctcaccatgggcctttgaaaccatggcaggaagggacccttcaactactatggacacttgaggtggcagagagagctgcttagagaagtggtggggcagcaagccagctgaagtagagcccagaggatttgatgccagagcatctgtagtagaacacagccagggacagccatccctctaggcttgatttgctcccataagagactttagccctaggagaactgtcagacttgatctgttcagggaagtcttggaaatcagacgggcctggtctgacctgagcaacccttggtctgctggcctctctcagggcccagcctggccatgcctgttaacagggcagttttgaatgctctgggagcccacaccatagcttctgcacaggtggaccatgcccgaacactggatagctccagagaggcagcccttacagccatacaccagcccacatactccctccccatacggcagctttcccccagagcccatggcaactccccacgtcactttgctggtatgtgtctgcacaggcaggttttgttttacttgcaacaccagcacatgtgagtgaagtctgctttgcccccccccaaataaacagctattgcagaggaagccttggcaggcacagagccaacaagccccaccaccaccagcaccacaccctagtgctaacactgcacagagaactcccacaccttgagtgatcactcctgcttgtgggggacagagaaggcacccagagctctccagccagtacccatccccaagccaacaccacctccagtgcaacagcacacagtctccagcagaggccccctgcttccccgccagctgccaggcctccaccactgtggtgaatgcccacgaggaagaaggaactcctgcatcagctagcactttgctgcaccttggtgcccccagcgcagtgaactctaagcctcaacaagccagagaacaaagtcggggaccaatacaagttccccagagttagagcacaccatccagaggttgggagctgtgtgctggccccctaatatctcccataaatgaagccatatctaccttataccatcaaaccctccaggtcatcaaaaaggaaaaaaaaaacacacacatccaaaggtcagcaactgatatagtttggctctgtgtgcccacccaagtctcatcttgaattatgatcttcagtgttggaggaggggcctggtaggaggtggttggatcatgggggcagacttcccccttgctgttctcatgatagtgtgtaggttctcataagatttggttgtttaaaagtgtgtagcacttgcctctttactctctctctctcccgccactctaccatgtgaagaaggtgcttgcttccccttcacacttctatcatgattgtaagtttccggaggcccccccaaccatgtgtcctggatagcctgtggaactttgagtcagttaaacctcttttcttcataaattaaccagtctcaggtagttctttacagcagtgtgcagaatggactaacacagtaggcaacctcaaagattgaaggtaggtaagcccacaaagatgagaaagaatcagctgaagaatgctgaaaattctaaaagccagagtgccttcttttctccaaataaccacatcacctctccagcaaggattcagaaccaagctgaggctaagatggctgaaatgacagaactagaattcagaatatggataggaatgaagttaattgagcaacaggaatacattgaaaccaaatgcaaggaagctaaaaaccataataaaacaatgcaggagctgacagacaaaatagccagtatagagaagaacatagccaacatgatagagctgaaaaacacactacaaaaatgtcataatgcaatcacaagtattaataggaaaatagaccaagtgaaggaaagaatctcagggcttgaagacttgctttctaaaataagccaggcagacaagaatagagaaaaaaagaatgaaaaggaatgaacaaaacctctgggaaatatgggatattgtaaagaaatgaaatatatgacagattggtgtccccaaaagagaaaagaagaatggaaccaacttggaaaacataggacatcatccatgaaaacttccccaacctagctagagaggccaatattcaaatttaggaaatgcagagaaccccagtaagatattcataagaagatcatcctcaagacacataatcatcagattttccaaggtggaaataaaagaaagaatgttaaaggcagctagagagaaaagtcaggtcatctacaaagggaagtccatcagactaacagcagacctctcaggtgaaactctaaaatccataagagatcaggggccagtattcaacattgttaaagaaaagtaattctaacccagattttcatatctagccaaacaaagtttcaaagtgaagaagaaataatattcttttcagacaagcaaatgctgagggaatttgttaccaccagacctgccttacaagagtacccaaaggagctcctctggtattaaatatggaaaggaaagaccattaccagccactacaaaaacacactgaagtacacagaccagtgacactctgaagtaaccacatatacaagtcttcaaaataatcggctaacatcatgatggcaggatcaaatctgcacacataaactaaccttgaatataaacaggctaaactgcccaatttaaaggcacagagtggcaagctaaataaaaaagcaagatccattggtatgctgtcttcaagagactcatctcacacacagtgacacacataggctcaaaatacaaggatggaggaaaatctaccaaacaaatggaaaacagaagaaagcaggggttgcaatcctaatttcagacaaaacagacttcaaaccaataaatatcaaaaaatacaaagaaggacattacataatggtaaagggttcaattcagcaagaagacctaactatcctatatatacaggtacccaatgcaagagcacccagattcataaagcaagttcttagacacctacaaagagacagagacattctcaaataaaaatagtgggagacttcctacactccattgacagtattagacagttcattgagacagaaaattaacaaagacattcaggacctgaactcaacattggaccaaatggatctagtacatgtctacagaactctccacccaaaaacaacagaatatacattcttctaatcactccatggcacatactctaaaattgaccatatcattggacttaaaacttataatcctcagcaagttcagaaaaaccaaaatcataccaatagcactaaatgcccacatcagaaagtttattaagatctcaaattaacaacctaaagaatcgcatctgaaagaattagaaaatgcaagatcaaatcaaccacaaagctagcagaagacaaaaaaaaaaaaacagagctgaactgcaggaaatcaagacatgaaaacccattcaaaagattaataaaaccagggcttgttttttttgaaaaaattagtaagatagataggccgctagctagactaataaagaaaaaatagagaggatccaaataaacataattaaaaatgatgaagacaatgttaccactgatgccacagaattaaaaataaacatcagaaactactatgtacacctttgtgcacacaaactagaaaacctagaagagacggataaatttctggacatacacaccctcccaagactggagagagggtgaaattctctaagaagaaattggagttttcttctccaagaagaaaattcctccaagaagaaactgatttcctgaacagactgaaaatgagctccaaaactgaatcagtaataaatagcctaccaataaaaaaaagcttagtacctgatggattcacagccaaattctaccaaatttacaaagaagagttggtacgattcctatagaaactattcccaaatattgaggaaagactcctcccccaaatcattctatgaggccaatatcatcctcataccaaaacctggaagagacacaacaatgaaagaaaatttcaggccaatatctttgatgaatatcaatgcaaaaaaaaaaaaaaaatcctcaacaaaatactggcaaatgggatccagaagcacatcaaagggctaatctaccatgatcaaataggcttcatccccaggatgcaaggttgattcaacatacacaaatcaataaatatgattcatcacataaacaggatgaaagacaaaaaccatatgattatctcaatagatacagaaaaggcttttgataaaattcaatacccctttgtgttaaaaactctcaataaactagatattgaagaaacatccctaaaataataagagccatctatgacaaacccacagccaatattatactgaataggcaaatgctggaagcattctccttgaaaaccagcacaagacaaagatgaactctctcaccactcctactcaacatattactggaagtcctagccagagcaatcaggcaaaagaaagaaatagagggcatcctctcttcaaataggaagacaggaagtcaaactatctttgtttgcagatgacataattctatatctataaaaccccagtctcagcccaaaactgcctttagctggtaaacaacttcagcaaagtttaaggatacaaaatcaatgtgcaaaaatcactagcattcctatacacaacaacagccaaaccaacagccaaatcagaaagtcaatcccattcagaactgccacaaaaagaataaaatacctaggaatacagctaaccaggaaggtgaaagatctctacaatgagagctacaaacactgctcaaggaaatcagagaaaacacaaacaaatggaaaaacatcccatgctcacggatatggagaatcaatattgttaaaatggccatactgcccaaagcaatttacagattcaatgctattcctatcaaactaccgaagacattattcacagaactagagaaaactatttttaaatggtatggagtcaaacaagagcccgaatagccaaggcaatcctaagcaaaaagaacaaagctggaggcaacacactacccaaattcaaactatactacagggctacagtaaccaaaacagcatggcactggtacaaaaacaggcacatagaccaatggaacagaatagagaggccagaaatcagactccaccacctaaaaccacctgatcttctgcaaagctgacaaaaacaagcaatggggaaaagactccccttttcaattaatggtactgagataactggctagccttatatagaagactgcaactggaccccttccttttgccatatacaaaaactaactcaagatggattaaaaacttaaatgtaaaatccaaaactataaaaaccctggaagacaacctagacaataccatccagtacataggaatgggcaaagatttcatgacgaagatgccaaaagcaattgcaataaaagcaaaaattgacaagtgggatctaattaaacttaagagcttctgcacaacaaaagaaactatgaaaagggtaaacagacaacctacagatgggagaaaatatttacatactatgcatctgacaaaggtctaatatctagcatctataaggatgctgtattagtttgttctcacactgctataaagaactacctgagactgggtaatttatgaagaaaagaggtttaattgactcacagtttcacaggctgtacaggaagcatagccagaagacctcagaaaacttgcaatcatggtgaaagacaaaaaggaagaatgcatcttcttcacactgcagagcaggaggaagagagagagtgaaggggaaagtgccacacacttttaaaccaccagctctcatgagaactaacatgaaaacagtgagggggaaatctgcccccatgatccaatcacctcccaccaggtctctcccctaacattgggaattacagtttagcattatatttgggtgggtactcagagccaaaccatatcataacttaaacaaatttacaagaaaaaaaaaattttaaaaagtgagcaaagtacatgaacagacaagtctcaaaagaagacatacatgcaaccaacaatcaaatgaaaaaagctcagtatcactgatcattagagaaatgcaaatcaaaaccacaatgagataccaatctcacacctgtcagaatggctagtattaaaaagtcaaaaaataacagatgttggtgaggttgtggaaaaaagggaacacttatacactgttggtgggagtataaattagttcaaacactatggaaagcagtatggtgattgctcaaagagctaaaagcagaacagtcatttgacccagcaatcccattgctaagtatatacccagaggaatataaatgattctaccataaagacacatgtacatgaatgttcactgcagcaccattcacaagagcaaagacatggaattaacctaaatgcccatcaatgacagattggttaaagaaaatgtggtacatatacaccatggaatactatgcagccataaaaaagaacaagatcatgtcttttgtgggaacatggatggagttggaggctattatcctcagcaaactaatgcaggaacagaaaaccaaataccatgtgttctcacgtataagtgggagcaaaataagaatttatgaacacaaagaagcaaacaacagacactgctgtttgtctagttgtaggtggagggtgggaggagggaaaggagcagaaaagacaactattgggtactgggcttaattcctaggtgatgaaataatctatgcaacaaacccccatgacatgtttaccgatgtaacaaactttcgcatgtaccccagaacctaaaataaaagttgtataaaaaaacaaaaaaacttgtatttggaataaagatataatagtcgagaatccttcacaggggaaaacataacttcaaaataggtaacacaaaaactgttggaaatacaaaagaaaattcacatatacaagattatttgggagatatccacaactttttcaacctttcacagatacaatttagaaattttataatataaaaaataagattaaattattagattggtgcaaaagcaattgcagtttttgccgttactttgaattaaaagaagatgatggtaactatataattaaaagtaatggcaaaaaccgcaattacttttgtactaatctaataatataccacttcaagcatccattggatattaattaaattaagtatatttcaagccacaaagaagaattcattaaactgcctaaagtagtaattatatagttattatcttctttttttaattttataaaaatttgttgtaaagactaggtcttaccatgttgcccaggctggtctcaaactcctcagctcaagtgatcctcccacctcagcctcccaaagtgctaggattacaggcatgagccagcacaccaggcttcatcttctaacacagtaaaaccagaaataacaaagtttctttttaatatcaaaaaatacaacctctttgaaaatgaaaaagtcttatatatacctattgtttaaaaaaaatcaatctaggctgggcacggtggctcacgcctgtaatcccagcactttgggagacctaggtgggcggatcacaaggtcaagagatcaagaccatcctggccaccacagtgaaaccccgtctctactaaaaatacaaaaatcagctgggcatggtggcacatgcctgtagtcccagctcctcaggagtctgaggcaggaaaattgctggaacacgggaggtggagattgcagtgagctgagatcacaccgctgcactccagcctggtgacagagcaagacaccatcccaaaaaaaaaaagtcaatctaaagtaaaacatttaaataacactgaaaataaaatcacaacctatcaaattttatacaatgtagccaaaactattccaagacattaaatcatagaattgtacttttatggaaataatgaaaaagcattcaagttaagatgtttaaagcaggaaaaagaaaatgataagaataaatctctaaaattaagcaattggtaagtaaattcaccactttgagggaaaaaaatatagacaagtctatatcaaaataaaataataataacaaaaatgacaataaaaaaatgacaagaagcccaggaacagtggttcacacctgtaatcccagcaccttgggaggccgaggtgggaggatctcttgagtccaggagtttgagaccagcctgggcaacacagtgagactacgtttctacaaaaaaaatatatttttaattagctgggtgtggtggtgtgcacatgggtaacagagtgagaccctgcctcaaaaaaaagacaagtagaagaaaacagaaaccacgaataaacacaattttaggaatgagaaaggtgatataataaaagatatggaagtttttaaacatctaactctatataaagctatgctaataaaaatgaatatattaaattgaatattctaggaacaactttctaaaactgcttcaaaattaagtaggaaaatctgattaaacaaaaaatagatgtaaaagttaaattataaaagtcaacaaataattcaaaaatgatttcagtaagaaaattttgccacgaagctctctgaaatgttcatgaagttacctaatttattttatgaaataaacaactttgacaccatagtttgacattcttgttatcgctactacagactaatatcacaggcgcaaaaatccaaataaaacacagacttcagctgcataacatcattaattctttcctaaaaagtaaatgttctgtgctaaaaacagttataatctatcatacatcaacctgaaacctacatttttgtgtagtgactaagaccctatatgtaacaaactatatttaagatgtaaaatgttaaaacagattccttatattcaaacaatttccttttcctgcacatcatcttgtttaaaacttcatattgggtttagaggatatacattatatggctttcaggtattcataaacatgaggcattctctactgggaaaacaataacctggcagaccttcttcaagaaagttgcatacttgcaaaataaattcagcggtatattgtctaccatcattcagtaattcaagagtggcttaatgttagaaaatttctcaatgtatctgtcttgtcagtaggtttagtgagattcatgattcaacacatgatgaccttattagataacaaaaaaacacaaaacatacattccaaattaaaaaattttataaaatcagtactaaaagtttatttatttatttattttagatacagggtctcactctgtcacccagactggagtgcagtggtgcaaacatagctcattgcagcctgaaactcctgggctcaagccttccttccacctcagcctccccggtagctggaactacaagtgcatgccactaagaccagctaatttgaaaaggtattttttaaaggaaggatattcatcttaaacaagaagcaaaccttatgcttaatgggaaaaactaaaggcattcccataaaaaagagaataaatgccagataacaccattattatttaatattatctatgctataatttctattcaaggcaacaaaataggaaaccaaacataatactgacaagggtggaaggcaaattaccattttaatgacaggattatctagaaaagctaagataataatttaaatatttcttaaaattaagaaaaaatagtttgtaaggggtccagtaactggataattatataaaataaaatcttttttctataccacttatagccacttagaagttataacgacaataaaaaatagatttcttccacaatagccctgcccaatattcactgcatgaacaattcaaatagcccagaaactgatcctaatgtatattagagtttaatacatgtgaatgaacatcacaaacaaataagatattaacttattcaaaattgacttctgtttgaattagcgaggagccagactcactcttttcaactatacttgaacaatagagactgtgaggctatcactgcaacaaccaccttgccaccataaggaaaaatccaatctatgaataaaacaagtacagaagaggttcccagaagtgaaagagaaaaacccagatcctgatgacttcttcgggtcctgaaacagggcctgagctaaatttatccaaaaatttaccaataaatttcctttatatttaagatggactaagctcatttcactgtcacctgatacacctaccaagtatatatcttgatacacctacctagagaagtatattctaggaacaactttccaaaattgcttcaaaattaagtaggaaaatacatattttaataatttaacatcattaaatttaataatttaatgatatacctatcaagtaggtatatcaaatatgtatattatatatacctatcaaggctgagagaagtttgtttcatatatcaaaaatatattgtttataatatatttaaacatataacctatctaagtatgtaaagtactttagtggctaaaaattttacaaaattacatatttagcaaatgtcatccaacctgactctcataaaaggaaaattcagtatgggatatagtatgtattaatgcataagttatttgtcaaaacataaagagaaaagtcacactttaatatttattctatttggaaaagagcttggctggacattgtggctcacaactgggaggctgaggcgggtggatcacccaaggtcaggagtttgataccagcctggccaacatggtgaaactccatctctaatacaaatacaaaaattagccaggtatggtggtgcatgcctataatccaagctactcgggaggctaaggcaggagaatcgcttgaacctggaaggcagaggttgcagtgagctgagatcgtgccactgcactccagcctgggcaacagacagagactccatctttaaaaaaaaataaaataaaaaaagagcttatgtcacattcccttacccatatctaacaagaaaatatatcttaatctgtaggaacactgaaaaaagacggcaaaaatgacagtaaatatatacttctttctaccagagcaactactgttgtttgtgagtcaaaaagatgtaatatccataaatcactttcactattaagagtactgtatgtattcaaattgcctaattcattttctctacctgtaactgttcgagtgactgctttatttatttacaagcttattatttctgacaatcaatatcagttatggttctttttattaaatatataatatgtattcagaaacacagagaaatccaattctctttttaagaggttggcatttatggatgtcaaaagactcaacattcaaacatggcctcatcaattaaaacaacacatcgagaaaatgtttctaacatttaaacatggcctcatcaactaaaacaacacattcagaaaatgtttccttctcacccctctcatttttagaaatctaaacaattagtgtagttctctaagagtcaatcattctctttatatgaaaacacttacacagtggaaaattaaaagtatatgtggttattagagagaggtaggctttttacagaaagcaatgctggaactgtaccttagaagagtgattgataaagctctgaaactcctcaatgtaaacactaaaaaaattatttgagcttgaagtaaacttacagcagaaatatggatatagttcctatatattcaattttaaagaaaatgccaatccaatgagccaaccagggttatttagctattaaagataagtatttaaatgatttaaccttttgaacagtattgctgattattatacagccagaagccagagagcctgtgcttctgatactaaaataagttaatgtcttaacaggctttcagataatatcaagatttatttgcttcgtaaagtttttggagcaggaaaggaatgcaatatcaatatgaaaaatatgtttaatgtcttactttatatcttgaaagaactctcacccagataatgtattgtttgtactaaattattaggcataaagttaaaagagacgaaggatagggctaatatgttttttaaaggtttcaacaataagcactgaaacaaaagcagttttctgataaacatgtatctttaaacttagttttggtggttgaagtcttgctcatatcatgctttattggttattataaaaaagaaccctctcattcttaagtctctgtagtaagatatttttctatcattatcccaaatcccatctgtcacttatcattgagttagaagaaaacaaaagcagggttattttttttacttctctgataaattttcctgattgtgtatcctagatgacccaggcgtccaaacctaatctttatttcacaaaaagttgttggtttttcaaagtaattcataatcttttgtatacctcctttttgtatgaacatcaagtaacatccaggctgtgctcccttggctatcctatcccccttgccaccacagggcctttgatgttccctctacctggaacacactttccttacctcttcctctatttcaagttctccttgagatctcagttcaaacatcacttctaaagaagagctttcttttccttttctttgactaggtcaaattcctttatttaaactctaaaaaccctagagtatcccttcttagcatttgtttctgtgatgcttttttgctagattgacaataaacctctaaggacagagactacatgtacatttgttcaccattgtatctccagaggttaacagagtacctaggatttgttagaagcttattaaatatctgttgaataaattattgaatgaaacgcaagtatttaaaaatgaccactaatctgaattgctcctgagtttcatgataatattaaaatgaaccaaaatcaggagaagaaaattatccatttcttcccttagacatgtttaggggctctctgggtccagactcaaacaatgtgttccagaagttgtgtgtaggagtgtaagtacaatcatgaatcacttaacgatgggaatacttactgagaaatgtgtcgtgaggtgatttcatcattgtgcaaacatcatagagtgtacttacacaaaccaagatggtataacctactacacacctaggctatacagtatagcctattgctcctaggctataatcccaaacagcaggttactgtacttaatactgtgggcaattgtaacacaatagtatttgtgtatctgaacatacctaaacatagaaaaagtacagtaaaaatacagtattataatcttatgggaccatcatcatacgtgcagtccattgttgaccaaaatatcattatgcagcacaagactgtagggtgacaaccactttatgccactgaatttcagaatttaagtaaccaaacatttttacatttttaaaaatgtattaaaatgtataaataaagatatgagtatgtttgtgcaatttagtataatggatcatctatataaatatattgatcataagctgtaaaacacttgcactgtactatctaatttattattcttcataggagaatttggtgttccacatacatatattctatacataattgaaaagagtcatttaaataattgtttttaagtttttttagacatcgagtagtaattatcttagaaatgactgatatgcaaacttttacgccacaataaataactgtaggaaactatattttaatttttgtatatattatttataaagttttgccttttccccatctgtcatcatgatttgttgcaattagtgtgcccttaatcagcaattttaattgtctgtgtgctgggatatcagaaagtttgttgacagatgcctaaagagcagtaagtcctaacggcccctcttaagctaaaaaaagcatgaaaaatagaggcaaaaacgtgtgctgcttacagaacagagtttgagttctaactgttgagagacaattctccatgaatctctcacatttccatacacatctagacattaacagtcaacatgctccaggattttcttttcaagatttgtataagcagatggccctagaaagatgaagacagtaacttacggcacatatttattcatgttctcagatagtaaatatagagacaccacctccaccaaaagcatttaagggtaatgaaagtaaaaatacctacctccacttccaagggtagaagtgctacattccaggttaataaagatagtatgtcattccctggaagtaaggatgggcaggtttgccagcagctctgatataaaacgagagtcagaggtacaaaaaagagctagtaccatttctactgaaactattccaaaaattgaaaaggagggactcctacctgactcattttatgaggctaccatcatcctgacacgaaaacctggcagagatgtaacacaatattcttgatgaacatcaatgcaaaaattcctcaaaaaaatactaccaaatcaaatccagcagcacatcaaaaagcttatcgaccacaatcaagttggcttcatcctcaagttgcaaggttagtgcaacatacacaaatcaataaatgtgatttatcacacaaacagaattaaaggcaaaaaccacatgattatctcaacagacacagaaagggccttcaataaaattcaacatccttcatgttaaagcctctcaataaactacatattgaaggaacatacctcaaaataataagagaaatatatgacaaacccatagcaaatatcatactgaatgggcaaaagctagaggcattccccttgaaaactggcacaagacaatgatgccctctctcaccactcctattcagcatagtattagaagttctggccagggcaatatggcaagagaaagaaataaagggtattcaaatagagagagaggatgtcaaattatcttcgcaaatgacataatcctatatctagaaaaacccatcatctcagcccaaaaccttcttaagctgataagcaacttcaacaaagtctcaggatacaaaatcaatgtgcaaaattcactagcattcctagaaaccaacaacaggcaagcagagagccaaatcatgattgaactcccaatcacaattgctacaaaatagaataaaatacctaggaatacagctaagagaagtaaaggacctcttcaaggagaactacaaaccactgcttaaggaaatcagatatgacataaacaaatggaaaaaattccatgctcatggataggaagaatcaatatcatgaaaacatccatactgcccaaagtaatttacagattcaatgctattcccattaaactaccatttacatgtttaggggctctctgggtccaaactcaaacaatgaactctagaagttcttctaattcttcagagaattagaagaaactatttcaaaattcatatggaaccaaaaaaaagcccaaatagccaaagaaattctaagtaaaaagaacaaagctggaggcatcatgctacccgacttcaaactatactacaagactacaataaccaaaacagcatggtactggtacaaaaacagactcatagacaaatgaaacgtaacagagaagtcagaaataagactgcatacctacaactaactgatcttcagcaaaactgacaaaaacaagcaatgggggaaatgattccctatttaataaatggtgctgggagaactggctagccatacgcagaaaattgaaactgggccccttccttacaccttatacaaaaattaactcaagatggattaaagatttacatgaaaacccaaaactataaaaatcctagaaaatctaggcaataccattcaggacataggcacaggcaaagatttcatgatgaaaatgccaaaagcaattgagacaaaatcaaaaattgacaagtgggatctaattaaactacagagcttctgcacagcaaaggaaactatcatcagagtgaatagacaacctaaagaatgggagaaaaattttgcaatatatcgatctgacaaaggtctgatattcagcgactacaagaaacttaaatttacaggaacaaaacaactccattaaaaagtgggcaaaggacctaaacagacacttctcaaaggaagacattcacgtagtcaacaaacatatgaaaaaaagctcaacatcactaatcattagagaaatgcaaatcaaaaccacagtgagatactatctcatgccagtcagaatggcaatcattaaaaagtcaaaaaaacaacagatgctggcaaggttgtggagagaaaagaatacttatacactgttggtgggagtgtaaactagttcaaccattgtggaaaacagagtggcaattcctcaaagatctagaggcagaaataccatttgacccagcaatcccattactgggtacatacccaaaggaatgtaaatcattctattacaaagacacatgcacgtgtatgttcactgcagcactattcacaatagcaaagatatggaatcaatccaaatgcccatcaatgatagactggataaagaaaacgttgttacatatataccacagaatactacacagccataaaaaggaacaagattatgtcctttgcgggacatgaatggagctggaagccattattctcagcaaactaacacaagaacagaataccaaacatcgtatgttctcactttcaagtgggagctaaacgatgagaacaaatggacacatggcagggaacaacacacactggggcctgtggggtgcagagagggacagcatcaggaataacagctaatggatgttgggcttaataccaaggcgatgggttggtctgtgcagcaaaccacttgtttacctatgtaacaaacctgcacatcctgcacatgtaccccagaacttacaataaaagttgaagggaaaataataaaataaaataaaataaaataaaataaaataaaataaaataaaacaaaacaagagtccactaatttcagtaattctctcctataatgcatccccaactgtgtgtgcagacaacatttgaccctattcacattgtcccattaggctaggagatcaggaaaccagagccaagatgttactattgctgtattaaactgtctaaatccatttgggcttattatctccttatcagccaaatctgtggaagagtagcaagccaacctagcagctctaaacacactactactttgaacctgctttattgcttgaccttagttccacacgtattagtcgtgcgaggttgagcaagctatttaatctctttatctcaagtaatctcatttgtaacgtgtacaataatacctcaaaagactgttgtgaagaatgaatgctatatatgagacgcaggtggttaaaatgcctgaaaaacgtggtggttatcacaggtattattatttatttattcattcattcatgctgcttaaggagtttttttatacttatttgcagatgtcttgctatgtttcacatagttaatactgctagataaaagaggtattagaattttttccacttgtcctgtcttgtacattaatataaaacacatatttaaaaattatttctcctactcctttgtaatccagtcatagagtctaatacacagattctaactcagctgagttagaatatagtatatatacatgacaggcactatgctagaattttcatactgtgtattatcaatgtatgtctaatactcaaaatatcacagcagtgttcataacattgataattcaataaataattttgatgatagaaaaaataataaaattggccaggtgtggcggctcatgcctgtaatcccagcactttgggaagccgaggcaggtggatcacctgaggtcaagagttcaagaccagcctagccaacatgaggaaacttcatctctactaaaaatacaaaaaattagttgggcgtggtggcaggcacctgtagtcccagctactcaggaggctgagacaggagaattgcttgaatctggaaggcggaggctgcagtgagccaagatcgtgccattgcactccagcctgggcaacaagagcaaaactccatcccaaaaaatatatatagtaataataataataaaattaaggataaaatacaacacaaatttggcactgcatattttaaagcattattgccttgttataggcacattgcaagtatattttaagtaaaatttggaaggagacaatatatatcactgcttataagagaaaaaatcaacttctaaaataggagtaaaggagaataatatcagaatcattggcaaatctctttcaaactatagaaatcctctcccctcagatctttgctcccctagataatttttgtttttatttagaggtgctgaggatctgtgtgtatatatttggtatgttcttttctttcagttcccgctgaaaacaactgacacaaaaataactttcctactgaaattactttgcctgttatagttctttagattactttattaaaatgtaattcatgataaagaaacatccttacttcaccttcatttctgaatgatatctctgggtataaaatgataagctggtttcatcgctttaataatattccattgtcttctggtctcccatcatttcagttgaatagtcatctagaggttatatttgctcctttgaagacagctgtctcttttctccaatcatttttaagaattcctttttgtatttggtttttagcaattttaatatgttgtgccttcatggggtttattttgtatttatcctgcttaaagtttgtagaacttcttgaatctaaaggttgatgtctttcatcccttttggcatatgaccatcccgtatcttcacatcatacttctgtcccattctctcccttctctccttctgagactctaattacacatatgttccaatgtctcttgcagtcatttctataccttctattcttttactcagtttttcagtctaaatattttccactgaacttgtctccaagcttactaattctctcttttgcactaggattagtgaaatgacaaagaggtctccagttctaatcttttgttaaaaccaccaatggcattcttcgttttatgtattataattactaaaatctgtttgatgtttttataaactcagttatctgttaaattcttcatctctttcctaattcttcagcagcttaatcacaattatcttaaagtttgagaagttaaatatcttgatcaactaggggttctggtgtcttcctggattataattaagtgctgtatattatatacagaaaaaaatataaactctgaattatgttatctacctccagagaggatttaatgtctgtcttgaggttaaataggggcagaacatcttaggtccatcagggattgagaaattttgacactgagtttaaatctttgtgattgctgatgtatttcccatttgttcttattcctgaaaatctgaagtgtttaccagcgtccctctttctgggtagtgcctcctcctgttttctgtcttcccaggagcaccatgagaccaccaaatctagcctacatttttagctcccactttctttctacttggatttgtaacttcctgcctgcctagcttagaaataaacaaatgtcccaaggggaaaagcagcacagcatgtgaggattgcttttctgtgcttccctttacttaatactcttggttcctgaatcattgactaaatttcaagttttgctttcctaaccctgtgaaactgctggaagattttactagccttttatgcttagtatcttagccatttgtccaatgccacttacaaataaaaagatgccttgatagaaaaagtttcagagaatgtcaggttaacatcaatgcatgtcccctcctctctggaatctttatcccttaagtcttatctcctttatttgcttctgctgcattcagctattttgtagtcatataatttatcaagcttctatagttgttctctcaatgggatatttggtctgatacaagctactccaacatcaccaaaaacaaaaaccttcaccattctttctaagatacttaagtatgtgactgaatagtattaaatgagaaggaaaaaaatagttacataataataaaatgcagcttcaaaaataggaatatactctggagattaagaaaagtactctatcctgcataatatcacataaagttatattttttagggagtttaactatgaggtctgaaacccttgagggcacctttaaaatcttcgagaagaaaagaccatacaatttttaaaagaattaaagaagcaaatgaggctgggcacagtggctcacgcctgtaatcccagcactttgggaggcccaggcgggcagatcacgaggtcaggagattgagaccatcctggctaacatggtgaaactccatctctactaaaaatacaaaaaattagccaggcgtggtggcgggcgcctgtagtcccagctactcaggaggctgaggcaggagaatggcatgaacctgggaggcggagcttgcaatgagccaagatcatgccactgcactccagcctgggcaacagagcgagactctgtctcaaaaaaaaaaaaaagaagcagcaaatgagtagtgaaccatccacgtaatccaatatgaaaaactgaaagaactaaaaatccagattaatctgtaaaagtctttcaaaattttattaaaattgatgtaactttaatctcataaacagcttgctactttctgactcatatttttaatcacaattgaaaatatcaacatgtttgtttccacataaacatttgatggaaattaagtaagaagataatccttaaactgataatttttaaaatttgtagagattttagaagaattaaaataaatgttgagattggtcatgtgtgatttttgacattaaaagcagttatagatatttcaaagtttatgtccttccctaagactgccatttcaaactagtcaatcctcatgttccctgctgacagtatataatgttggaagacatttgatgtaagagtcgcaaatgccagcaatatctctaaaggtcactataattttaacaggtatagttagaaaagctattcttattccaaattacaacttcactatatgtttaaagaaaggatacaattttacatttttaactaaaaaacagttcaattaaaacctacatatacattaaaactacaactttataacaaatacagtaacagaattgttgctactattactaatatgtattaactactttctggtctagacatttaatcaacaaacaaaatgatactatttctaacttcaaacaccctacaatcatggttctcaagtatcttcagcgacccctcgagattcctgatgtcctttcagataatcctcaagatcaaaattattttcatattaatactaagattttgtttgcctagttgacttttgttctctcataaacacttgtgtatttttgtattttaaatgtttctcattttccatttctaatacaataagaaacactagatgtaatccacataaagttcttttgcgtcctcaatagttttgttgttgttgttgttgttgttgttgttgttgttggagacagagtccccctctgtcgcccaagctggagtgcagtggcacgatctcagctcactgcaacctctgcctcccagttcaagcaattttcctgcctcagcctcctgagtagctgggactacaggcgcgtaccaccacgcccgcctaattttttgtatttaacacggggtttcaccgtgttagccaggatggtctggatctcctgacctggtgatccgcctgccttggcctcccaaagtgctgggattacaggcatgagccaccatgcccagccctccatatttttaagagtataaaaagatcctgaagccaaaaagtttgagaattagtgccccacaacctaaaagataaatttagacagaaaaatgataaacaaagaaatgttactacatatgtagaactatttttaaaactatcacacaagataaaaatgctaaaaatgtattacatgttgcgttgataaatcctaagtgtccaattataccagtcaaatatcatagaagttaaaaagcaaagttcaccaatgttaaaattcctaccccgacagcgctaaagattttcatattattgatgtgatctcctattacacttagctatttcagagagaatcactatggtagaaaaaatatattgtgcaattgccctccaacatattcttaattctttcattctctttgttcctggataaattgaatgtcaatacaaggacagtttccccaaaataaaataaatgttatctcagacacagaatttgactgtcatttcaaatatgatccttaaaaaaatgtttgtttctctccaactgtaaagcaagttgattaccacaaaatgagagagagagaaaaaaaagagcaaaagagaacgctcatgaagaaaacatacatttttgaacaaaaagtagggaactgtgtttctactaaacactcattaaactccttaggcaaatatcttcacctatggatactgttaaaggaaatctggtcctttgttatcattataatttgggaattttcataatatatttttcttggaaacttatatgaaaaaacataaattccaccactagttagcagataacatttaaggaaaaaataaattccttgaatagctaagtattccaattccccaggaccctagtcttcagatttctaaataaaacatactatatttaaaacaatattctacagtattatgtaaagagtaactatctcatagaatagttttcatgatttcagtgttttaagtatatacaagtggctggcacttgtggtgaccctgaacgttaatgaacaaagccttgcaatagatttaaaaaaaaaaaagaaaagaaaaaggaaaagcaggtgtgcaaagagtgcaaagataaatgtgcacagttgatatcttcccatcatttacacccaggatgttacaacaaatggaattaatctgctcttacaaaagtgcttgccaccacagaaagaaatagacaatctttcaaaagatataattcaatgctaaaattgcatattttaagactaagagaatgatttccctttcatattaaccaattagactgattatatatacatatgtctttaagattttaaatatcttaaatttggaatttaatatcatatgttaaaaggtattgtaagtctattagataatggaaggaaatcttgaaatatactgtatttatgatgtagaagcacgaataataaccatattattgcatattatgtttctactaaagcctttcaatatactactaaattcagattatctgaatgaaaatttatgattggcccatgcctaatttacaattcaattatatcctagcttttttggatgctcaaaatagttatattatatatatacatttaaataatttctccctctgccaaaataatacttttgcataaactgtttacaaatattaatctacatgggcagcctgttgattaaaataaacaatatatcaccattacaaaaaatattgttctcacaccatagtaggcaaatgtggatatgtatcctgtataggatgactttgcatgtcctccaggtaggcccaaagggcagtgttggcaataatgatccatctgttcactactgacaatgataaaacttctaatgaagacagatgtgggtcacccagtataagctggctgcagggtgttaatgaatcctcctaatggtcactacctgccacttttgactgactgataacctaaacagtttaatttgaaaagcaaagatgagtatttcaggtactcatttgtcctaccaagaaattcttttcactttcacttacatactcactctttactacttctctttattaattcttaaacaatattactattgtttattagattgtctttaaaaataaccttgctagcatttttgagaaattaatttctccaaaacttctccactgactggcccacaagatatcaacttcataatgtgatatagcaatattccatatgagaaacaaaaaaggtaatattttctatgtcataaaactctttaggtacatttacatgtaattttataatcaatatcaatctctctaaaatgttgcttttaaaatatttttaaatgtcaatataaaatgattttactcaagattccaaaaagaatattcacttagagataccaatctatgaaaaatgtatatatctattaaaaatttatagagatggtcattttactttcggaaatatgctgtgggtaatacttaagaatcataacttatgcagttgtttttcagaataaaatatgtattacattatacctaagctcttaaagaaaatctaatgttaaaataggtccttagaaaaattagtatgtataaaaagtaaatatataaaatccaaaagtaaaaacacaacataaaaagcacatttcacatataaagaaaattacgtaaaaattgtttaatgtaaaataattttcaattaagtttaaagttcttatagtttataaactatattgttataaattttactttatttacctttttttttagagacagggtctcgctacattgcccaggctgtactcaaactcctgaggctcaagcaatatacctgcctcagtcgcccaaggagctaggactacaggcatgcctcaccacatctggccagtttcactttctatgtaaagacttaagataacctattgttgcttcagtcacaaatggaccacttattcttacagcaaatcagtttactgaagtaggtacccatgactaaacttcattacctgccaataattaacagtcacaattcatgtgaacacatgcaccaaatatacatacatacacacatatatacatgtatgtgtagcaggctatcaacaagggaggcccatctcaaatgataaatggagttggaaacattgaaaaaataagttgatgtcttcgtacttttcaaaaaaaagaaaaaggtgaagtgccaagttcagtggtgtgatatagtctagcctttaagccataatgcccatcttcaaaacatgcaaccagcagtgctttaaaatgggactcaacatgtttacacgattcatgatctccattctgactccttgcctaagccacttcttattatgtttaccaaccaattattgattttcctagatactaaactatttcctcactttcctactaataatctaaccttattcctcagactcaataatcagcttctacctttgagctttcccctccatccttatctaaattttagaagctgccttggccacttttatgtccttgtcctgcctctcaaagctgctgccctctaccatgtcccctcagctctgagagcaaggaaaaattaatgattgcaaaacttccagataagagaatcaactgaaatgaaaggtattctgtgagggtcaagtctcctggaggctaaccaagggtgttgacacagaattaagtgttctagattaaaagcaaatacttcaacttttttaaggaactacgatattgatttatctgtgaggtcagtttggagtatcagtgtgtgttgagccctcctcctgatagtaatccctggctgacaactccttcaaagtcagaagatacagtgtattttttcctaatgcaaggtagtcatcgtccattgagtttccatttctagatgcatgagtcaagggaaaatgagagataaaagctaagggggttctcttgtgaaaaaattatcaatttttcttcaaaacaaattttaaaaaaaactgatgggagaccattatttggagaatcccagaataagcaatggaaataaccatgagaatttctggatagctttgattcagctttacatgaactattattctgacatggcatcagattttattgaaagttaaagacgtggctaaacacttcattttgcttagagacatgacttgtgttcatgggtcatggctccccatatctttgccagcagggcaagattctctgtcttaaaagtcagtattttcaatccttgaaaacatttcaatcttgaggatggctagaatgctgcaaactcttctaatgcataacactaagataaaggagactgagtagggattaaagcttgagctttataaacttagcaaaggaagcaaaaagaagttattaattagttcagcccaagactgataaacagggccatgacaaatagtttagttcaatagaggctatgataaaagtttaagtgcagtaaatactaaaagcccttaccaagaaatacaataattaagtattaagaactgagaagcattgtctcataggaggaagcaagtttatgagaaagttatgaagacagtcagacatccttaccaatatacttccaacccaccaatgaggtcacttgaacccaatgcaaaccccctgcaactatgttctactctagtgcctcagggaatttctctaggcctttattttgaaaccacttcctacattaagagacactcaccttatgacagcgctcaagccaggatacatctcggtttagtcctaccccactttataacccctacacagaaggagcaactcaagaccttgtttattttaaaggaaatatgagaaaagtactgccacagacaggagacccagagctgcagcatttcttatctggactattaaagaaacgtgtacctggtcgcttttcttcccatctttcccatgtgcaggtccacttttttttttttttttttttttttttttttttttttttttttttttttttttttgtcgcccaggctggagtacggtggctcaatctcggctcactgcaagctctgcctcccgggttcacgccattctcctgcctcagctccccgagtagctgggactacaggcgcccgccactacacccggataatttttttgtatttttagtagagacggggtttcgccacgttggcctggatggtctccatctcttgacctcatgatccgcctgcctcggcctcccaaagtgctgggattacaggtgtgagccaccacgcccggctggtccactcttaataagtcaaacatttcctaaataacaaatctaatcatgccactctcttgataaactcttcattgactcccttttgccaatacagtaaagcacaaagcccttacattggcacacaaagcccttctaccacaatccaaatagtactctaaataaatctactccatgtgtattgccactattgccataatcttctactctggatctctccattctagtgcccttatagtataaatagcatgtttctcttctacataaaaccctttattgtcctaagaataagatcaaaatttcttatcaagacctacaaagccctattttggcctctgtctacctcccaatatcatcctgtaccattcttctccttcacttcttcttctctttcaccccacttccactagccttctctcaagaccttaatcagtcccatctcagaaaactaacacatgtaataatgactcttaaacactaaaatcctgaaaaataaatggtaaatctgtgaatttaaattctgatgaaaagataactttggaattcactactaaataagaatttaggtatatcagaattaattttttccaaataattagaatgtcacattgatataaattttcctttagtgtaaataagccaagcaaatctttggtggagcttaaccctttcatatatagaaattcttggaaaatatgaaaacactattataatggggaaaatacccaagattgacaagcagaaaaagactgtataaaaatactgccaaaaagcaagtgtttataggttatccaacccaaatttccatcacatttatcaattcgttcttcaaatatacaattctattaatattggagtattccaggaagaggggataccacagtgaacaaaatatgaaaaacaaaaatctatgccttctcaccacttatattctatacatatcatacaatttacatacagcacaaatgtaatttgcaaacaatatgagttttgacagatccataatttctattaccatcaccgtaatgaagatatagaatgttaatatcacctcaaaagtttccgtgtgccaattctcagacaattcttccacagctaatctattttcttttttgtttttaacacagtcttactctgttgcccagactggcatacagtggcatgagcacaggtcactgcagcctccaactcttgggtggctcgagcaatcctcctatctcagtctcccaagcagctgagactacaggcatgagctaccccacccagctgttttgttgttgttgtttgtttgtttgtttgcagaggccaggtcttgaactcctgggctcaagcaatcctcctgcctcagcctcccaaagtgctgaattccaggcatgaactatctgcctgccctgttttctgttattatagatttgtcttttttagaattttatatgaatgaaatcatacagtatttttaatgtctgatttcttttgctcaagagtatatttttgagatttgccatgtggttttatgaatgagtcattctataggtagttctttatagtgctaaatagtattacattgtatgaatatcccacaatttatgtttatccattcccctactgattaacatttgggttgttttcagtttggggaaatagtcataataacaaataaagctgccatgaaaatatttgtataagtatttggtgaacatatattttcatttctgttacacgaataggagtgaaattgtggtaccacacagtatgtatattttaactttctaagaaactgtccaaatttttccagagtgagtttattattttacattcccataagggatgtatgaagagttctagttgctacatattgctatgagtatttgatatttccagtctcttttactttagccatttaaatgggggtgccttggtatgtcactgtcatttttgtttgcatgttcctaatgacaaacggtttagagcaacttttgttgtgcttatttgccattcttatgtcttcttttataaagtgccagttcaaatattttgcctgtttttaatgagttcttagtcttcgtattgagttataagaattctttattattctagatacaattattttgtcagatagatatgttgcaatattgtctcccagtcttggctagacttttcattatcttaataatgactcaatgagcataagtatttaattttgatgaagtccactttatcaactttttccttttatggttcatactttttgtaccctatctaaataacattttcttaccccaaaattgtacagattttctccagtatttttcctttcaaaagtttcatagatctatgacccattttgaattaatttttttgtatgggatgaattatgttttaaggtttggtttggtttggttttctttggatatccagttgttctggcactatttgtgcaaagactttccatcctctttgaattattttggtacctttgtcaaaaatcagttaacctgtatgtgtgcatctatttctgtactctctaatttttactgtctatatgtttatcctaatactaataacacactatcttgattacctgattgattataaatcttgaaatcaagtagtataaatctgccacctttccatctaaacattataatcagtttatttctgcaaaaacttctgctaggaatttgattgggttgatactattacattgaatccgtagattaatctggaaataactgacatcttaatagtattgcatctttcaatccataaacatatggcatatatctcaacttttttagatcttttcagaatcctctcagcaatgttttatactttttgtgcagaggcattgttcataatttgataaatgtattcctaagtattttatgttttgaggtgctactttaaatggtgtttttattttatttttccattactagaatattgaaatcaatttatttttctatgttaatctcatattgtgtgaccttcctatactcacttattagttccggtagcttttttctaagcaatcataatatgttatttcattaaattaaaaaaggaatccaaggaaatgagtctataatatgggttcttcaagagtattaaaattatcacatccatacatattgatcaagcctaatcagtagttatcacagtcctcatgttccttttataaatattttgttccagtataaagatgaaacagttttgtgttaaggtaggcaacggctcagatgagcacataaaaaaatttaaaacagaatttaaatgtttcaccttgactcagttaaatgaatgtgtatcagtggagtacaatccaaaagaaaagtattatatgtaccattaatttaaacttgctatatttgcagaattgtagaaaatataaattattgaataaagtagtaagctttatcactataatatatactaaagtatgcacatttgcactggttgaaattaattctcacaagctataagataatcctcatttcacagaagagccttataaaagttaagtaatttgcccaagggcccacagctaggtaaaattagagcagaactcaaaccaaaatctgccttccataaagtccgtgctatagtttttcagtgctgatgactttaaataaaaaagaggaagaaaaatattttttaaaaatacacaatagtaagaaagcactctgcttcatatatataaatgtacatataataagatttagcaaattttaaacacctacaactccaccaaaacaaattcatttcatttttaaaagaaaatcattaaatataggtctccatcactatctaaattctcactacctgaatccaaatatttaaataatgatttgccaaacatccaaaacttaatagacaaatagaaacctgttataatgaatccacagatgcatgccagaaaaaaaaaaaaaaaaaaaaaggtgccctgcacaaatctaagcagtttccagtcttaaccattgtcctgatgatattgccactggttttgtttaaagtatagtgcattattgcaaccatcttatcatatttcttcctcctcccattctttccctgctcctcaggcttagcactttattggtctgccaaatgactaaggatacaaccaacccaaacaatccagatactttcactatctataacatactattttgtttacttacattatagaatttttttgcaaattacaaaataatatctgatatagaatagtatcgttgtcaacagcacacaaacatactaatgagctcaataaacatttttgaaaaattaaataacatgtcttaaataactttcagaaatccttgggtgattgttatacagacacataagagcgttttatttaaggaatcaacctagaatcttgcatgggctggatatattattatcgtctcatttaagataatagaatacaggttcctgctacccaaaaatatgctatccaacatgttttcaagaatgcattaaatttgaacaacaagagagttctgtaaaatgaacaactatcagaataacctaaaaacttcacgttttcctgcttaagaatgactaaaataatttatatagaatctgtacatccccagcttctattaaaagccctccattatttatttaatcagggttctcagtactcaccaagacagtctcactagccaaccatattagtctgccagctacacgttttctacttctactcaaaatgccctcatccactgtctccatcaatccaagatttcctttaaaattcagatcaatataattgtatcccttaattcagtaattctctctttttttcttttttttttttttttttgagacggagtctggctctgtcgctcaggttggaatgcagtgccgcaatctcggctcactgcaagctccgcctcccgggttcacgccattctcccgcctctgcctcccgagtagctgggactacaggtgcccgccgctatgcccggctaattttttgtatttttagtagagacggggtttcaccgtgttagccaggatggtctcaatctcctgaccttgtgatccgcccgcctcggcctcccaaagtgctgggattacaggcgtgagccaccgtgcccggcctccaataattcttttaatccatcttgtgtttgggatttaaaattaataagccctaatccctgactccaagaatggaatgatctggtggcagaaacagacatgggaatagaccataataatataacatcataaatgccatgagtggaatatatgtagaataccagcagttgaatctcaaagaatgagcaggaatcagccacctgacaagaaagtgagcattcaaggtcaaagactggcttatgcagagggagagggatgggatgagggaaataatgctaagttcaggaaactgaaggtagttcaatgtgactaaagtataggatgcatacagaaaaactgtgaaagaagaagttggggaggtaattaggatcagattacaatagtttagtatttcatgataagaagtattctctgactaaagcctatctcactcaatatagccctatatttcacatatatgctctttttaaaccttagagatttatgtcattcattcaccaaatgtttaaaggagacactatgtattttttctaattgtttcctgtatgtgatgtatgtctccaactaggtgacaaataaaaacaaagtttctttttagcttctaaaaccctaatgaaactagtgtaatgctgaacaaaatactcacttcaataaatgcttcttgaatttaaataataataattcaattattattaagttatttaaaatcataaacctagatcttattttggcagtattcctaaattagcaaacggtaaataatatacatagaaaattatactggtaaggactataaaatctctcctttaggggaaaaaaaaaaaaaaaaaaaactctagccattcaagagcttattctctgccttccatctcaggcaagctccctgaaagagtgagctgtttatattcatataattcttttccctaccatccatccattcttccatccaaccattcttctcttccacccatccatttttcaatccactgctatctgctgtcttcaacttagtccagtgctttgctaaagtaaccaataatatcgaacttctgcaaagttcattggatgcctttggatcccacttttattaactaacccaaggtattaatatataaaacaggtagtaacaactctcttgaaattcagtccccctctggctcctgtgagatcactccttcttcattctaatcctgccatttttttttaatttcaatagtttttggagtacagatgattttgtgtacatgaataagttctttagtggtgatttctgagattttggtgcacccatcacccagacattgtatactgtacccagtaggtagtctttatccatgacccccctcccaaccttaccctctgagtccccaaagtccattatattattcttatacctttgcagcctcgtagcttagctcccacttataagtgagaacatacaatattcgattttccattcctgtgttacttcacatggaataatggcctccagctctaaccaggttgctgtaaaagacattatttgttcctttttgttgctatgtagtattccatggtgtatatatatcagattttctttgtcctctcgttggtcgatgggcacttaggttggttccatatctttgcaattgcgaactgtgctactaaaaacatgcatgtgcatgtgttttttttcatgtaatgacttcttttcctttgggtagatacccagtagtgggattgctggattgaatggtagttctacttttagctttttaaggaatatccacactgtttccacaatggttgtactaatttacattcccaccagcagtgaaaaagtattcccttttcgctagatccatgccaacatctttttttttttttactttctaattatggtcattcttgctagagtaaggtggtatctcattgtgattttaattcgtatttccctgataattagcgatgtacattttttcatgtttgttggttatttgtctatcttcttttgataaatttctacttatgtcctttgccccccttttgatgggagtatttatttttttcttgtttatttgtttgacttccttgtaaattctgaatactagtcctttgtcagatgcatggtttgtgaatattttctcccaccctgtgggttttctgtttactctgctgattatttcttttgctgtgctgaaactttttagtttaattgggtcccatttatttatctttgtttttgttgcgtttgcttttggggtcttagttatgaattatttgcctaagccaatgtctaaagcagtttttctgatgttatttcctagaatttttatggtttcaggtcttaaatttaagtcattgattcatcttgagttgatttttgtataaggtgagagatggagatccaatttcattcttctacatgtggcttgccagttttcccagcaccatttatagaatagactgtcctttcccaatttatgtttttgtatgctttgtcaaagattagttagttggctgtaagtatgtggctttatttctgggttttctattctgtttcattggtctacatgcctatttttatactggtaccatgttttatttttggtacatataggcttgtagtataatttgaagtctggtaatgcgatacttccagatttgttctttttgcttagtattgctttggctatgcaggctttttttttgttccacatggatttcagaattgtttaccttaattctgtgaagaatgatgatggtattttgatgggaattgcattgaatctgtagattgctttgcgcaacatggttattttcacaatattgattctccccaaccatcagcatgggatatgtttccttttgtttgtgtcatctattaatcctgacactttcaatccttcttctttatttctttcttaggtcccccttcctccacttaccactaaatatcccagattaagtccctaatccctatagattgtgtaatttaatgcaaaggctggttcctaaatctctagttgagatcctcctcaattttcttactaccttcaagacacttatgcctatataatagatgctaaaaataacctgattctccaatactacacacagctacacacacacacaaatacatacacacacacacaaaatgtcacatgcttcttatatcctctctgtccaaatctccatatcatcatttacctagtattctaagcaaaaaatctaagagtcatcatcaatactcctttctcactcatcctcccacatcaaattaatcactagataaaatcaatgctaacacctaagtatttgtactttcccctcattatcagtctcatttaactattttaatacaggcattcactatgtgaaccactatgcattacctcatgatttccctctctctctctactctcagatcccatccatttgcctaacaattacctgttctaactttctgagattacaaatctgttcatgaatcaactgcttaaaatgtttaccggcccaaaatctcctatagataaaaatacaagttgctttctcacaccttcgtggctttacaaatcctcattgcctggaatgttgtactccgtctgacaaatagctacttgtccttcaaaatataactctaacacactttagaatcctttcttgatttctatcattccccaagcaaaatcaacgcatttctccttttaagcctcattgactttatttggatctcattgtataattgtttagatatttgtatcttccattgaggaatgtgaactccttgattcaagaagctttgccctattcatcatctttctatccacagcatataataggtgttcaattaattgttcattgagtaataataactatcatttactgaatattaacaaatgtcagacactgtgttaagcattgtgtgtatatacatatatattcagatatcattggattctcacaataacctttttgtagagtattattattcatattttagagacttaaaaggaagaatattgaggcttagaatagcaaaatatcacacacctagtatgtgatggagcaagaaattgaatgcagtgtgattccaaagtctgaattctttaccactaaaccataaataaatacaaaaggttttatttattttatacacatcttaaaattttaccatgaatgagtatgactttggtatataaaactcactcagtgcagtacaaactattttacaataagacttgaagagataaggtgctctcccaaaagatactgaattattgtttaagcaataactaaatattttcaatctcttcctcactccttctctcacatataattttgtccatttatcttttaataattcaacccttccatctttattgacacttttttcacttctttaaaatccataatttaaaaattgaaaaactttccttagaaaatgggaaaagtgagcaatcagaatttgagatacagtaactgtaacatgaacaactaatttaggtttggggggaaaagcgtgtttaattatgtgcaagtcttcttaagtctctgttcaccctcaaaaccaaggccactaccacatattactaacagtaataaattgccaagtgcctgttataaagccaagtaaccagataatttaataaatattaaagactaacaatgataaggaagaaagtaaaaatgtttacattgaaattaatggaataatccacccattaaagaaaaaaacacagaaagttttaaattatttctccctttcatgtccttattattaacctgtttagcataattttacttatttgaaactaaaactttctatttaagatctatattagtaaattattttatgtaacctaaaattttatactaatcaagagaataacctagtctataaataacatcttttaatataacttttaaaagtctaataattttgataaatttatatagatgaatagaaataacttagtttgcagctagaatctaaataatatttttaaatagttccaaggtattttcatttggcagaactgccaaaagaactaaaatttccagtttaggatttgctcaaatgaacttcaaggcaaattttcgtatcttgccacataatttttaggcatttgttttaatgaatttgagaaatgaatgaataaataaggtgttatgtcaataaagagccaaagtattggcgccacctagtgaaactgtactcagttatttgacctaatacaaagctaacacagcaacttcatatattttgtattaccaaattaaagaacttcaatagaaacaattaccaaatgtttttgcatagtaaagatttatcttaaagactttgttaatattaagaaagatactaaaaaatttttcattgccaaaggcaagacattccttagtgaactattcaggttgcataaaagttaatatttgtgttttttaacaggaattctcagtaaattataatgtcataaatattcaaaagatatattaaaacaatactacatgtacaaattaagtaaattcaaggacagttatgatttaaaaaactcacattgattaaaatattatattcatattattacacattttgttgcaatatcagaaaatgcttaaatccaaagatactataggagggggataaagatgatggaatagaagcctacaccattcatctctcctgctggaacacaaaattttaacaactatctacatgaagaaaagcaccgtcacaaataccaaaacccaggtggcaatcacagtacatggttttgacttcataacgctaaaagaggcattgaggaaggcaggggatatagtcttgaatcatcgatgtcactccttccccatcccccaactgtagccatgcagcacagagacagaatcagtacattttggagaggcaaagcacagcaattgggggactttacattgaacttggtgctgccctgtcagagtggagaataaagccatgctgagctcagccagcacccatgcatagaaggagcatttggactagccctagccagaggggaatcacccatcccagtggttggaactagagtttctcaggaagtcttgttacacggagtgaagtgctctggggtcctaagtaaacttgaaagacagtctaggacagaaggactgcaatttctaggcaattcatagtagtagactgggtttagagccaggaagctaggatagcacaggacctagggagataccagctggtgcagctaaaggagagcttgtgccgtgcctcccacaatcccaggcagtgcagcttatagcaatgaaagtgactccttccttctgcttaaagagagtgaagagtaaagaggactttggatagagtattgagcagagttgtgaagcctccattccaggccctagctcctgaatgatatttctagacacaccctgggccaaaaggaaacctgctgccttgaagcaaaggcatgattcattacctgctgactaaagagcccttgggccctgaataatcagcagtgataactagggagtttgccttgtgccttgggttctgaaatgtgctggcttcagtgacaacccagcacattcccagctgtggtggctacagtgaaagactcattctgtttttaaaaagcagagtaaaggggactttgtctcgcaccaactcgaccagtggagtagagcaacaagcaggcttttggggtccccgagtccaggcctaggctcttggacagcatttctggacctgccctgggtcagaggggagcccactgacctgaagggtgtgtcccaggccaggcagcattcatcacaaactgacagaagagcccttgggctttaagtgaacattggcagtggcctagcacaacccctccacctcaaacccccatggatcagtggtggtagtggacacagggagaggctcctctgcctgtggaaaggggagtgtaggtcaagaaggacttcatattatagtttgagtgctagcttagccacagtataatagaacatcaggtaaattcccaaacacgaaattacagtgttatacttaacaaagtatatagttgtttatgcttgttaaaataagcttatacttgactaagtataaagaccaaatgatgaaccaataaaaaataacaactacaagacctaggtagtacaataggacataaggaaaaacaacaaaaagttaaaaaaacagagaattaaagtgtagtgcttttattagtttatttctgcatgttatttgcttatataattagaattacaacagtttaaaataatgggttacaagatagtatttggaagcctcatggtagcctcaaatcaaaaaacatacaacatataagcaaaatattaaagcattccaccaaagaaaatcacttccacgaaaaggaagacaggaaggcatgaaaaaaggaagagaagaccacaaaacaaccagaaaacaaataacaaaatggcagacgtcagtccttacttatcaataataacattgaatgtaaatggactaaactctccaattaaaagacatagagcagctgaacagatgttttcaaagacccagtgttatgctgccgacaagaaacacacttctataaagatgcacagagactgaaagtaaaaggatggaaaaagacacaccatgccaatggaagccaaaaaagagcaagagtagctatacttacatcagtcaacatggattccaaaacaaaaactgtaagaagagacaaagaaggtcattatataatgacaaagtggtcaatttagcaagaagataaaatgattataaatacaaatgtgcccaacatgggagaacacagatatataaagcaaatattataagagctaaagaaaagatatacaccaatacaataacagctggagacttcaacaccccactttcagcaccagacagatctcccaaagagaaaatcaacaaagaaacatcaaacttaatctgcactatagaacaagtggacctagagatatttacagaacatttcactcaatgcagaatacacactcttctcctcagcctatagatcattctcaagaatagactatatgttagtccacaaaaagtctttgaaaattcaaaaaaatgaaatcatatcaagtattttctctgacaacaatggaataaaactggaaataaataacaagagaaattttggaaactatacaaacacatggaaattaagcaatatgctccttaatgatcagtgagtcaatgaagaaattaagaagaaagtttaaaaatatcttgaaatgggctgagcatggtggctcacacctgtaatcccagcactttgggaggccaaggcaggaggattgcttgaacccagaagtttaagaccagcctgggcaacatggggagacttcgtctctacaaaaacacaaaaacaattagccaggcatggcagcatatacctgtagtcccagctactcaggaagctgaggtaggaggatcacctgagcccaggaagtcaaggctgcagtgagccatgattatgccactacattccagcctgggtaacaggagtgaaaccctgtctcaaaaaaagaaaaaaaaaaatcttgaaacaaatgataatggaaatataccaaaacctatgagatacagcaaaagcattaagaagaggaaagtttatagcaataagcccctacaccaaaaagtagaaaaatttcagataaagaacctaatgatgcatcttcaagaactaaaatggcaagagcaaaccaaacccaaaattagtaaaagaaaagaaataataaagatcagagtagaaataaatgaatttgaaatgaagaaaactatacaaaagattaatgaaacaaaaaatggttttttgaaaagataaacaaattgacaaacctttagccagactaactatgaaaaagagaagatccaaataaataaaatcagaggtaaaaaagaaaattcaaagatcatgcaaaggaatgaatttgcagaaattcaaaggatcattagtggctactatgagcaactatatgccagtaaattggaaaatccggaagaaatgaataaattcctagacacatacaacctaccaaggttaacccacaaagaaatccaaaacctgaacagaacaagtaataagatcaaagccataataaaaagtatctcagtaaagaaaagcctgggacgtgatggcttcactgctgaattttaccaaacattaaaagaagaactaatatcaatcctactcaaactattccaaaaaatagaaaagaagagattacttccaaactcattctatgaggccagtattaccccgataccaaaatcagacaaggacatatcaaaaacacaaaactatgcctgatggtcaatatccctgacgaacatagatgcaaaaatcctcaacaaatactagcaaaccatattcagcaatatacttaaaagatcactcatcataaccaagtgggatttatcctagggatgcaagaacagttcaacatatgcaaatcaatgcatgtgatacctcatagcaacagaatgaaagacaaaaactatatggtcatttcaattgatgctgaaaaaacatttgataaagttcaacatacttgcctgataaaaaccctcaaaaaaccaggtatagaaggaacatacctcaacatagtaaaagccatatatgacagaccctcagtcaatatcatactgaatgggaaaaactgggagcctttcctctaagacatggaacatgacaaggatgtccactttcaccactgttactcaacatagtactagaagtcctagctagagaaatcagacaagagaaagaaataaaaggcatccgaactggaaaggaagaagtcaaattatccttgtttgccgatatgatcttatattctggaaaacctaaagactccacaaaaaaaattatttgaactgataaattcagtaaagttgcagggtaaaaatcaacatataaaaatcagtagcgtttctatatgccaacagtgaacaatctgaagaagaaatcaaaaaaagtaatcccatttacaatagccacagataaaattgaatacctaggaattaacttaaccaaagaagtgaaagacctctgcaatgaaagctataaaacactgatgaaagaaattgaagcagacaccaaaagatagaaagatattccttgttcatcgattggaagaatcaatactgttaaaatgcccatgatacccaaagcaatctacagagccagtgcaatccctatcaagataccaatgacatttttcacagaaacaaaaagaaaaaaacatcctaaaatgtatgtggaatcacaaaagacccaaataactaaagctatcctaagcaaaaagagcaaaactggaggaatcacgttacctaacctcaatattacagagctacagtaaccaaaacaccatggtactggcataaaaacagacatgtacactaacgaaacagaatagagaacccggaaaaaaaacccacacacctatagtgaactcatttttgactaaggtgctaagaacatacattggggaaaaaacagtctcttcaataagtggtgctaggaaaactggatatccatatccagaaggatgaaactagacctctctctcttgccttacacaaaaatcaaatcaaaatggattgaagacttaaatctatgactccaaagtatgaaattactaaaagaaaacattggagaaactctccaggacattggactgggcaaagatttcctgaatgataccccacaagcacaggtaaccaaagcaaaaatggacaaatggtatcacatcaagttaaaaagatttctgcacagcaaaggaaacaatcaacaaagtgaagagacagctcacagaatgagagaaaatatttgcaaacccatctgacaagggattcataacgagaacatataaggagctcaaacaaccctatagggaaaaatctaataatccaatttaaaaatgggcaaaagatttcaatagatagctcccaaaagaagaaatacaaatggcaacaagcctatgaaaaggtgatgaacataattgatcatcagagaaatccaaatcaaaactacagtgagatatgatctcaccctagttaaaatgccttttctaaaagtcaaatgctggtggcaatgtggaggaaaggaaacccttgtacactgatggtgggaatgtaaattagtgtaaccactatgaagaacagtttagaggttcctcaaaaaaaaaactaaaaatagagctgccatatgaaccagcaaccccactgctaggcatacagccaaaataaatgaaatcaatatatcaaagagatatatgcactcccatgtttacagcagcactcttgacagtagctaagatttgggagcagtttaagtgtccatcaatagatgaatggataaagaaaatgtggtatatattcacaacagagaattatttagccatacaaaagaatgagattctgtcatttgcaacaacatggatggaactggaggtcattatgttaactgaaataagccaggcacagaaagacaaacatcacatgttctcacttatttgtgagatctaaaaatcaaagcaactgaactcacatagatagatcacagaaggatgattaccagatgctgggatggccaggggatgaggctcacaaggaggtggggatggttactgggtacgaaaaataaatagaaagaatgaataaggcctactatttgatagcacaatagggtgattagagtcaataataacttaattgtacatttcaaaataacttagagaatacaatttgattgtataactcaaaggatatgcacttaaggggatggataacccattctctgtgatgtgcttatttcacattgcatgcctgtatcaaaacatctcatgtaccccataaaaatatatatacctgctatgtacctgcaaagtttaaaaatcaaaataaattctaaaaaactttttttaatgtttttaaatacctagtatttaatagcacaacagggggactatagtcaataacaactgacctgtacattttaaaataactacaagagtataattggattgtttataacacaaaggataaatgcttaaggagacggatacccaattttccatgatatgattattacacattgcatacctatatcaaaatagctcatgtacctataaatatatataccaatgtacccacaaaaattttaaattaaaaacataaaaaatgatgatactatagcacttactctttaaactattttactactttaaaactatactgcttaggcaataggataaatacaaagaaagaaaaaaaacccaagaattatttctctacattcaaaattttaaataaaactgcccatttttcagatctgtaattaattcattcagaaagcattactaaacataggtacctcacttcactatatgttttaaaaagagaatgtaagatatttgtcctctaagaactatggtttaattgaggatgttagataaatatatcaaaaaatattccatatacaagaaataatattattcaaattaatcataagttcagacaaaaacaccattaagcattaagggtcaaaacaacctggaaatctgaaatcttgagaaacaagagaaagaggaatgggttcaatataagcaaagagcattccaagacaatttcaaggacttactacctataactcatttttatgtaccatctattgtaagggtgcatctgctgaacttaaagagccaagaaatggagtgaagctattaggcctatcacacaccaaatttaccaaccttcccaagtcatatcttctttttctttctttttttttttttttttttttttttgtttttgagacagagtcttgctctgtcgcccaggctggagtgcagtggtgcaatctcggctcactgcaacctctgcctcccaggttccagtgattctcgtgcctcagcctcctgagtatctgggattacaggcacgtgccaccatgctgaactaatttttgtatttttagtagagacgaggtttcaccatattggccaggctggtttcaaactcctgacctcaagcaatctgcccaccttggcctcccaaagtgctgggattacagtcgtgagccactgcaccccgcctccttcagctgctcttaatgtgcaggagaggtactccaaagtgttattttccttggacctttaaaactggttatttcttcttgccttttaccacccctgggatcccacattaagacatttctccagttggcctaccagattttttctttgttcatagcagctattgaaaattctgcagcactttgccactgaaatctcttcccatattctcatttctgttcagctgcatttaggcagctaagactatgaaagatatacagaataagagacaatttccagaaatcataaaaagttagggatcaagcatgaaagcaaaagaagaaagcaccatgggagagacatttttcccatgcattttctctccttgcctagagaaagatcccatgagtaagggagttggaagaaaagcaaaagatttaaacataataatttgagaatgggccctaagttttctacttgcccatcccaaggctaagtgctaagctgagaggtgtgaaggagtgatctatccaaaataggcttgtgattcccagaaagaaaaaaaaagagcttgagcctcattttctaggtagcagccagaaaactggccagtcatcagaatcacccaaccttaaatatagcccagtacaacgcaagagcagcagcgtagcaattcctgcgagagctttgtaaacagaactaaaaaaaatttttacagttcccttatcacctgatcacaaatttaatctccaattcagctacctatagacagaaaacactcaagatttgtggccactagaaacaatttcttctccatgacattgaactctaacatttaccctcagtaaccacaattctcaattcttccctgttcttacaagccatgaatccccttatgatttcattatcttccccctcccccccgaccttagccttgattccaagattaaccatactggccttggaagctctgattctctcaaacccttgccacttaacaatctttatagctccaacctctggcaatgcttagccctacaatacaggtttctactcttgccctcatattgtcaataatgagcttgtgctaaccactgtaaaatgggatctttttcttccacctgcaactattttatttatcttatttgtcacattccttatgattcattatgatatgtattccattcttctcaattactgaatacctacctccctcacctctgaagaggacttcattgaatacatcaccagaacaacataggttatccaaataaaattactggatctcctatatgcctctatatttgtctttcagggatctgcaaactgtggcctgtaacccacatccagctactgtctgcttttgtaaatgaaagttttactggaatattattcatccatatattgtccacggctccttttgtgctacaacagcagttgagtagctgtggaagagattatatgacccacgaattctaaatatttaatatctgcccctttacagaaaaagctttctaatccctgatctctttcatcatccattctttcttccttttcataaaaaaagagatatttctgttcctctttaatataaactagctgtttatgccttgggtccctttgatcatctgcttctgaacattaccctattaattatcagttcaatgcatttctgtagctcctctattcccactggatccttcaactattctaagaatatgctccccccaaaattaaaatgtctctcattctgttatcttttcaatcgaccatctgatttttcttcttccctttaccatcaaagttctggtggtagaaggtggtagaggcattgaatattatatataatattgtcataatatatataacatatattaatatataacaatacaacataatgtatattaatatggaatatatcatgtaatatattaacatgtaatataatatataacaaataattataatcatatatattatatattcaatgtttctattgcctggtcccatttcccttattccatggaatctaacttttatctgctacaaaaactgttctctcaatactcacaataattaaaatacatactctctcaatacctttcattaactaaatataaagccttgttcttgtcctgcattcctctccatgagctcttcttttaaacagttattgcaatttcattatctttttaattaacatgttcattataaaacaacagaaaattcaactaagcagaaaagataaaagtcacccataatttcaccactttgagttaaacagtataaatattttactatgactaaatgtacatacacttattaatagtaataaaaatcatattatgcatttgcttttttatttactaacctatcatgaccatctttctataaaaatatttcagggctgggcgtggtgactcacacctgtaatcctagcactttgggaggctgaagtgggtggatcacctgaggtcaggagttcgagaccagcctgaccaacatagagaaaccctgtctctactaaaaatacaaaattagccaggcatggtggtgcacgcctgtaatcccagctacttgggaggctgaggcagcagaatcgcttgaacccaggaggcggaggttgcagtgagccgagatcgtaccattgcactccagcctgggcaagaaaagcaaaactccatctcaaaaaaataaaataaaataaaataaaataaataaaaataaaaatatttctataatctttcatttttgaatctctatccttggtatctaaatttctaattcacttcctacttcactaattatctctcctctagctcttctatcatgcctcactctcaaaatctgtgttcctccaggatctgttcttaattttcttctcatctttgtattctcttctatagcaacctcattacttcaattatcaccttcatgagtatgactgccaaatcagtatctctacccataatttctattacaaattctattttcaaatttctactgtccattggtaatttttctccaaattcaattgtctgaagctgaactcattatctgctcatcataatgagtagcttctgtgatgaccacctctgctagtgacacagtcatccaaattcacttttaaatcatccctgccttttcctacttgcttgcctatacaaacacatgcaaacatgcacaatcagtgtcagcatttagttgtgtatataacaaaacaatggaaaatttaatggttccatgtcaaaataatcaggagaaactaccatttagcattttataagccaaaaaatttggaatttagggaatgaataaggttccatcttccctcattgcctgaaaatttaaattaaaattttttacaccttaggaacaaatatttgctatgacaataaagcactgagaaaatgctacatacaataaagcccctatattttaaccagttcattcagtttaattccttattctttttactatgtataaggtaaagaaataaaaagtgattcttctgatttttatttctctagttttaagatactgtgatagaaaaagtgattgtacaaatcttcaattttaagcaaagcgtttattttatattatactaaatatgcaaaaataacaatactttcacatttctgctttaattataaattctctttgatacttcaaaattcttattttatcagacttgttttcacagagttgattttcaaaagaaagagtcacattacatttaataataaacaagcctctgggtaagctcacattttttaaattatgtatttcagagcatatatgtaattagaggtaaattacccttatgtaaggtcaaatttaaactgtacattagatctcactagaaaggaacacactaagaagcaatcaaatcttcagctttttagaacattcacatgtttccccatctactccccaacaccccaagatatctagtattaccattgttgtggacaaactgcaacctaacttaataggcagacaagattgaaaacctaacttagtagtatgtacctgtaacaatagctgagtcttggccaatcccagcagccatacttcaaagactcatacgctgctgagtgttcaaactgtgttcaaataaggcaaatgccaagctataaccaatccagttgtttctgtatctcactttcaattcctgtgtgtcatttccctgtttttgtctataaatttattctgaccaaaaggcatccctggagtctccctaaatttactgtgattctgggggctgcccaattcacaaatcatttattgctcaatcacactcctttaaattcggttaaagttttccttttaacagatggtgtcagaagcggggtccaaagtagagcttctaatgaccccaggaatgctgagtgaacaagcaaggtagctgcaaggaccctgcaaggacccacttgtgtccttgattcctcagagcggctgagggttgtggtaagttctctctcccaagttcagagctccaagaatttgtgttttgagctctctgagtttctttgagcaaatttctcttccaaactgggtttggacgttttaacagaaatgggactgggtccaggatgggatttgatcccttaattaacaggcttggatccagttagaggcctcttacatctgactgggtcagaaaaaaaccagcagtaaatggtaataatgtagggattgtaaaatttggcttttgaaaattcacagggatttttgtgttctaccctttgtttcatttttcttgcatttaaatcatttaaaaaaccaacttaggagtcatgagttctttgcaagaaggttttcaagcagagacagcaaccacttgacagaaataataaatacttccttctacaatattcattgaatgacgattagctatcaggcacattagatcaaagagcacagtaaccttgtgataacaggattcaatgatcttaaaattgggaaaatatatgcattagccacttttcaacttaccttttttttctcctgcaatactattatttcatatagtcgtgggataaatgaacaataattttgttgttgatctctcttgatgttaacattttcataatatgatgtctttttccttcagaaaattcaaatagaaattaagaattctcaattttaaacctataaatatttatgtaagcaaagaaattctttctacagcaacatgtcctgcaattaaactatggaataataagattatctaggtatattagaccaatatattcaaaattttgtaaaatgtattagttttcttggttagttatgatttttttccaattcagatcattattataaacctatctgaataattattacaaaaagaaaataagatctggtatttattgaacaaaaagctaaccctaaaaaaaagtttcctgtgtagtctatgtaccattaaaagtctaaaattccaaatcaactattatcaaaataagaggaaaatagccctatgctatttatatcataaaataatcagaaaagggcataaagatctatgaaaacaaaaaggaagcttcttttcattgaaattcagacaacctcaagaaagaatcagaaactaaataagcagtgagcaagagccccagctttggagttagacagcctaataagatcccagcattgctacctactgctacctattggttatataaccttatgcaaactaacttctctaagcttcagattcatcacccaatgaatctggtgattggaaactggtaattggaaatagtaataaccaattctcaaggttgcaatgattaaagtagacaatatatgtaaggtggttaatgccatacatggctcataataagcacacagtaactgttagctattattattgcaagaatcacatttaaacaggctatacagaccacactactattttttctattttgtaaagataatttcaaaaaaaatctgatacccaacatttccaacaaactataccaaacatatgcagattaaaaaatatataatacaaagttatgtaattgctattactttctttgttcagcagtgctatgatttaatatgcacttaccatccccgctcactgctaaaggctcacctcctcactgattgttatttgctaaaaactcaacaaataaaccgctttcaaacctcagaaaggtttatggataagaaatttatatgtggaatatcagaaatgtcacatatcatttaggtctgtatctttaccaaaaagagacctatacacttatctttcatttagagtaaccaaatatctccacttttatactgaatcaagcctccaagaataattctgactcactaaataaaacaaaaagtctaagaaagaaaaaaacaagtagaaaatatcaactgccagaaggaactgagacaactacaagtcaaagatacagtgaaagcagctaactcaaagagcaaacaaattacaaaaacggtgaagtaactgaagcagtcaggaatgaaatccatattcatacatttcttcaggttaaaacacaaatggaagaagaggaaaaacaggagaaataacaaagatcaaataaagcaacagcacaacaaatgggggaggaatgagagtgggacaaggttgagaagtaaaacagactggtaggaaaaaccaccaagcagaatcagttaacactgcttacagtcccgggtatgcctggggtactcaggcagaagtatagtgaaatggaatgaaaacaatcatcacagaatgatatacattttaaaagatgaattttgatttatgctatttaaacctcaataaaactgagaagaggggaaagagagacggtgagagagagagagcatgagcacaaatcagccaatatggcagaagaaaaggataggattaaaatactgaagaacaaaagcatatgtcaagaagactatgatatgtgttagagtattctacagaccttgtcttgcttggaataataataataatattaagtaaagacttaattaagctaaatatgcatgttaaggttctagcataactactaaaagaataaaaatacaaaggtatatattccatattaagagagtgaaaaagtgaacagcataatggattagagtataaattcccaaaaacaaacgccatgttttattcttgttattctcagttactaagttcagaactggcacatagcaagaattcaaacaatgtttactcaatgaatgaacagtagcaggggagtccaagcaagatcctaaaatacatccactgctagtaaacagaaatatctgatctgtctagcaaattaattgagtacgtaatcactctggggcttcttgggagaaaatttatgctatgaaagaaaaagaatcaggcagataagctggacccttaaaaaattaattataagaaagggtagtagattctgaggacaacgtggtatttgttactcaattttgccttccatgaactcatgtctaaaacctgactgtggcagtaggagaaaatagagttattttgccagaaatgtatttcttcataaatattctcggacttacactgactgagaatgccttctaaatccatcatgtagtcagaggactgaagatgagagccagggataaaatggagaattctgggtcaccttcttttacattttctctgatcttttatctactttataattaaggacagtatattttagtacatggctacatgtgctgtataatcaaacgggcttcaatttaactttagctctgccatttaatagctgcatgatcttgaacatgttatttatcccctctaacccttgcattttttactgataaaatagatgtaacaatattaactatgcaaagcttgctgtgaagattaaatgagttaatgcatatatagtagatagcacaagatttggcttataaaaaaacaattaacttggggggatggggggctaggggagagatagcattaggagaaatacctaatatagatgatgggttgatgggtgcagcaaaacactatggcacatgtatacccatgtaacaagcctgcatgttctgcacatgtatcccaaaacttaaagtataatttaaaaaatcaataactttcatatacattacaccaaaatgtaatacttcttggagtttttcatactaatttttcctttctttacagcatagcctagtctgaattattaaaatacttttctagtcaagagctacattaaaggtatactatatttttttacttactggactatatcatactgtcctggaccaggacctgactttttaggtaactcttgtcttcctgaagagttgccaaaatgtatacctttgtatttcaaagttgcattggaaacatcctaaaaaataaaaagttttaaaaagtgaggatgaaacatagtttaaataagtcatgaaacaatgtttggctttacctaagtctaaatctaaagcaaggatagcctcagtaagggggttccactggtaaatgctaaagtgctcttggatagatcccaggctaagttgtcactgttggttcccattccactcctgagtcagctagggttcccagagaagtacctctaacattagcatattctcaaccaatatgaacagctttgctcttggcagtacacccagtaatctaaaaccttaagaaaaatgaaaattagctcctcatcatttaaaaaagagagaggggataacattatttgggaaatagaaatacctattaaaaattaccttaactaaacagattgaaaaaatgcaaacatcaccaatggtcattacataacttcatattaatgtaacctttaaacagagttagaaatacttaacaataaattaaacactaccctagttcattttattgctaatgcttaaagacaggatcagtcttttaatgacagagaaattatttgtgacatgagaaataatcatctttcctttatacccactacaataaatgttaaaattaagcatgaaccataaaaagtttaagcacactgtttcaccagaaactaaaacaataaagcataacacaacagtagcttcttttttacaggaatcctcttgacctaaaacattcttagttgagaaatcatttaagaatattttaaaacatatttttaagctaatggtatttactataatttccataacatatagtttaacaatgtgtcaagttgttacagcaggtagacagcctgacatgagcagggtaagagagagcccccccagccaagaatgtcaggcgaccatcaggtgatggtcaggcagttgttaacagtctaaaataataattcattgcagctggcaccagggaaaggcagtctcccaagagaaaaatcctgaagctggtgatcagcagcttccagataacatctcaggagttgcgcgaatgggctcacacatgcacactaaaaggcaaaatggccgtgtttaaccagcatatgaccctctaggcgcattcaactggaaaggtaagaatgcctcaagtgagcatgtgtacaactccagtaaacacactgcacacgtggcccctctcaagtgctagaaagccactgagcatgtgaacagcccaccccaaggaaagactcaggggacaagtaatgcaagaccctggaagcatgccaacatacaaaacccaaagttaaaaggtcaatccatgcacttgatctctcaaatcacctgctgggccctcttccaagtgttctttacttcctttttaataaatttttactcccactctaaaacttgccttggtctctcactctgccttatgcccctcgattgaattctctcttatgaggaggcaagaattgagctggctgcatacccataaggatttgtaaccgctaagttgttctaggtggctattactattctacagcagtggaaccaacctctctcagttaccattataagcaataataatgcagtaagtagcaacattagtgacaaaagcataatttcagtacaaaatggtgaatcaaatccatacctgccccacccgactccaaaattttaaaagaagtatatcaaatagacacaagtaagtgctagaaacttcacatgccagaaactttaaggactttctggaagatatagcacagcaaagactagaaccagaaaaggacctcattacatatgaaaagagtctcagctgaacccacttaacatccccagaaccagaaaaggacctcattacatttgaaaagagtctcagctgaaccctcttaacatccccagaaccagaaaaggacctcattacatttgaaaagagtctcagctgaaccctcttaacatccccaaaaaaacagaaactggagataaactcttaggtagcgagtagggggcaattctcaaaactactagcacctttggagatgtgcaccagtgccattacattaagtgatgaggagaatgctaacctccactttattattggcagatgtagttgaaactaaattgaaagcactttcccctgcccctagtgactttctagttagagaggcaccactccagaaagctttgaggtgccacaacaaaatccaaaaagaagctggcgcacactaaaattccttgaacttaccactaacacctagcccccacacattataatatataagcacaatagaattaactttcccttctacatctgcctggcctgaaaaaattaaatgcggattgtgatggtcaactttagatgtcaatttgactgagttaaggaatactcacatagctgataaagtgttatttctgggtatgtatttgaggctgtttccagaatagataggcatttgaatcagtgaaccatcctcacccaatgtcgtgggcacctttcaatcagctgagggcccagatagaacaaaaagacagaagaaaggtaaatttgttctcttttctggatctgagatgcccatcttctcctaccttcggacatcagaactccaggttttctagcctttggattcttggactttccccagcagcccctcaggttctcaggcttttatccttggactaagagttataccatcagctcccgtggttctcaggccttcagacttgaactcagctactccaccagctcccttatttctccagcttgcagacagcatatcatgggacttctcagcctccataatcacatgagccaattcccagaataaaccccatctcacatatatagttatgtaccacataatgatgtttcaatgatggactgcatatatgacaatggaccagatatacaatggtgagcccgtaagattataacaccatatatttattgttccctttcaatgtttagatgtatttagatacacaaataccattgtgtatctgtatctttgtaatctgtaccagacagtacaataacatgctattcaggcttgaaccacagaaacaatgggctataccatatagcttaggtgtgtcatagactataccatctagatttgtgtaaatatactctatgatgttcacacaatgacaaaatcacctaacaatgcatttcttaggacgtatccctatcattgattgacacatgactgtgtaagcattggttctgtttctctgcagaatcctaatacaaagactaacacaacctctgacagaactttaatgtttgcatgaagtaaaatgagacctttgttgattcttttttcatagatgcaaacgtgtacagaaaattatagtttttctaaagagttatcctgctttgattttagtaaatccccttgattgtttctttctttggtggtagagaatattggagctgagaagagagaaacaagaagtcgtctgctatgtccaagtagaattcagacatgttttggaatacctggtgaacaaagcaaaacaaccaaaaggcaaatgtaaaaactaatcctatgagaagaaggagataatcatgatgccccacacctagtaagaaaatcttagtgtcaaaagagtggcaatgctaaatactggggattttctgtcaactgggtttgcgttctaacacagacaatcctcaatgactttatgcctcatatccttttgagtgtgaagaaactatgaaaaaaaaaaaaaactaaaacaactgtttcattaaaatattggctaaaagaaaaaaaaaaacctgcactacttttgaacctttctaacagagtataacacgaagaaagacatcatcatcctccccctactttatcccagctaatccggcagctttagctgtgaaagagaacattggtggaaatgcccagcagagagcaccatatggcaagagactgaagtgcctggtggaacagcagctgtactcaatggaaagagacttattcgggagcatagctgagacagcccccagggatgtctagaaatacatgggtagaagaactttgcaaaaggctatatgtcctctacattgatagttacagacaaaaaaaaatggtatttaagttattaacattattgcaactctctttagtaactccaatccaatgaagcctgggaaaatgtgttatataaataaaaaggattaatccttatttcctctaggaatatttccagcactgtacgtggtctcagtgggcttgaattattgatctgcaaatcccttctgctgcaacacaaagagcagaaaggcatttgcccttcttcactatggacattcagctttaacactgagtgatgagtgacagtcttataaagcactatctcaaagtaatatattattattcttaatagcattattattattattacaagtagggattctaatttgatacacaattccaaagcccagccccttgtcatgtccttgaaggaacaaagctatgaataaaaactgaaagagctatcccacaaatctctgcaacacatagggtatatatacactactttggaattcctaagtataacacaaaaggaaataagggagtcagaccatccaaaggcattgggtttggtgggtgtaggggggcagagacaaatgctataaaacttagcagaatgacttacaaaagtggcagagtctgacatgtccagcacagcagtacatgccagtaaaagagcacggagaaaccctagcatccactagagtagttgaaaacactcctctctcctcttcttatagggtcagtggcaattccaaagactgctgtgccaaacagaacttaaggaagagagagaacctagccaaacaacactttctcttgctaaagtaagtgctccagatcacctttcaaatgcaattacctaatacaaccatggattttaaagtacataggcagttttgatggcagaaagaatgaaatttcccatttatgttagagtttatttttaactcagaaataaagcagaacatcataattgtgcatatttttttctactatattatgaccataacagacagtgaagtacaaaatgtgaaactacattctaatataatatagtcatgctggatattttagacattgtatatatttcacacaagaacatatctaatatgttgatttactatagcctatacatttgtcaaaaaatcagtattttaaaatacagcattttgatgtcatcttttacatcacatttttatagcctaaaatcatgttaaggttttgtattaactcttttaatgcaaggattcaagaccttgagcaggattctattgaagaagctttctttaagtgaatttacattattgagattttatgattcaattgtttcacaattctaatagtaatccagtaggaggaaagattatgtatgtgtacatgtgcacacacacacaatttaagaccccacaataatatccatttttttttttttgtgtgtgtgtgtgtgtgtgtgtgtgtctacaataatatccatttcatttaaaccacatgaattgacaagtacttaactcattaacctctgcggtactcaggtagatgttgaatcagaaatttaaaaggcttttaaaaatacagacagaaaacaaaggataaattgatgcactcttatctctaaattacagtttcttttatgtcaagaagtgttggcaataccaacttcaaggtcactgtcaattttgaaaatcattagcaaataaaatatgacttaattgaagcaaactcagcatggaactgcattattttaagtaaatgctatattataatttgaagaagaattactaactgccactctcactgacaattaaataaatgaagatggggctatgcaactttcccccatgtctttccataattaaatatggaaatagaatttgtgaagaattaaaaggcccaaagtgcaataattcaaacactaatgaactgttttccagtgtggcagcacacaggtagttcccagcatgttatcattagcaaatatgtcagtatcatcattccaatcacaaactttgcttgtgaaatacacctctgaaaaatagatttctaatagttacctgggctcttctaaaagaagaaagaagctaaactttatcattcaaaatgttatataaaataacttttttgtagaatttctcttcacaaattaaatttagctaaagtttaacatttgtcacttagagtcttacacaactcttaattctgtatttaagctttattagacagcttcagcagatgtgattcaccagttaagaaagaatcacaataattacccatctattggattattttcttaattttctatcaatatgcacctctggaaactaaacccacatatagtattaaatattatttcaaaaagcaagcaaagagttacccagaattatcgaaaattcagataagatttgaattaacattattacagtatcaatttggcagtagtttgtgaagaacctgtgtttttctgcaggagaaacagaagaaaataaagccttcagctactgagctttgccacgctatctctagttctctcaaatacaagatgaggatttcaaaaaatatcacaattccgtttgtattaaactttgctgaatcttcttgaatattatgaactatgtctttaactgatacagaaaactacgtttttatatgtttttaaattacatctagatttttattccaataaataaataataagttgtattgattcaatacttattaaattaggccatcaaataaattaggtcatcaaataaatgtcttcttcttcttccttatttctataaataataatttagccaggaagtaatcaagttttatatgtctaagtaatgcttattcatgtggggaaaggattttatacatgcagggaagcttggaggcatcattgtggccttctaatagatgacacattattctgaaacaaaaaaaaaatagcttaaagcaagaattacattttgagatgtaagttatgagtgattagggaattattaagctaaagccaagaatctatgactaattgtgaagaatacttattccaatatgttagaccatagttatttttctcaggatattttaggtaaggaaactgagcacaaagattaagtaacttggccaaggactaataactattaagtggtagagtcaggacacataaccaggaagtctggctccattacacttctttgcataacttgtccgtcaccttggggagaatatcctaatatcaaatcataagaccatttcactggagtttttacagaattgaacctattgttcacataagaatatcttactcaaatatttaagatacttaaatatcttaatgaagattaattgtcacattgttattaataggatgatgggacagtcaaggcctagaagaccaggtatgtcatagagagagagaatgaaatattcttgagacaaaaactcccatggccagaaagaaatgggaattcttatggttagaaaaggaaacatgtaacttatattatccttacttttcatgttaccagaattaatctggttcttcaaaagttttatagcatgaaacaatccattagtcttaaaatatctgcctactactgtatttaaacacaaaatgtattatttctagtttgttccataatcaataggaattcttctaaaaacttaaaaatcaaaaattaaataatactggcttatatatttacctttatcattgttctttaattatttatgtgaatttgagttattgtctgataacatttcatttcagcctgaagactccatttggtatttcttttagggggtgtgccagcaacaaattctgtcagcttccatttatctgaaaatgtcttaatttctcctttattttcaaggaatagctttgctgattctggaattcttgattggcagtctgttttttcaacactttgaataagtcatccccctccctctgacctcatgatttctattaaccttttggaggattccttctatatgatatgtcacttttttcttgctgccctcaagattttctttttgtctttggctttcaacagcttgactgtgatgtgtctaggtgtgcatctctttgcattaatcttacttagagtttgttgagcttcttctttctgtaatgttttttcatcaaatttgggatgttttcagccatgatttcttcaaatattctcttttctccttcctctttctcctccgcttctgggattcccattatgtgtatgttggtatactcgacagtgtcccctagatctctgaggctctgaatactcttcttcatcctattttctttctgttcatcagactgcataatatcaattgacatgtcttcaagttaactgattctttcttcagccaattcaaattttcttttgggctcctctagaaagtttttcatttccattattgtaattttcaaatccagatttctactcggtttgtttttataatttctatctctttattgatgctctctattgggtaaggcactattcttatacttccatttagttcttcagacatagtttgctttatttctttgaacatatttaaaatagctaatttaaaaattttatctaagaagtctaatgccttggcttcctcaagaacaatttctttttctgtatatgggccatttttttattatttgcatgtctcaaaattctttgctgaaaccagatattttgtatgatataatgtgacaactatgaagatcagaattcctaccctgagggtttgtttagtgattttccaagactaattctctaaactctgtattctttgtacactgaaatctcagcctaattagctgagtggtcaggtaatgtctggacaaaaattttcttaagtgccttgaaccaataaatctccaacctttgccaaggccctctgtacatgtgttgaggcataattttaatgctcaagcggtcaatttacaaatctgtgtttagccatcacttcctgcttgtgtagagcctcaaggtcacccaaaggtaagagcttgtagaatctcaactcttttttttgcagtgatagtttaccaattctaaaactactttcaatgtactatgggattaagcaaataggtacataattctggataatgggagctaggtttcttactgtggaagtagcgagtcaaatatggaaagagaaagtctagaataaacctgtagtgttagactgaaattggaggtatatgtataaactcacaggttttaacagacaaagaagaagtatagatttcttactctgtccattgagatgacctagaagccataacacccagtaacaatgcatgtacctagtatacagatcttactttgaaatacattctgctgctatggaagtagggctccttaaagaagtggctgattgcaaggctcaggcaagcaaatgaataaaatgaacctggaatatctttttatgccagaaagtaaggaaattttcaaagaatgatatgaacatgtcaaaaggacacaaaaagtggcttacaaggctcccaagggtcaaatctggaatcactaatgcctcaaaataaacaataaagaaataaattatagcactttgagtaaaataggaattcacaaatccatactgatataaatatataaatggggaaaaaataaagctcttctttatagtaaaatgccaacaaataaaggttaaaaaatagagttagaaaatcaccatttgataagcatcatggtaaaactggttcaggaatcatcaatagatgttaaaactattaagtgagagtttgatgagaaataggtaagagtttgatgaggaatgaaatatctatttagtcttaaagtaatcctcaaaaaatattcactttacatgagttaaaactagaagtcaccacctcaagttaacataatcatttatgagataaataccttgttactcttaacatgatatattaagaacctatcacttctatagtactcctgccaaaatattaaacaaaccttcagatattcataatatatacaaacccataactgaagcatattctacaaaataaataaactgtactcttcaaaaaaaaagtaaagattaaagaagacaaatactgaagaactgttccaaattaagagattctaaagagacatgcaactaaatgcaacatgtaatatcagactgaactctgaatcaaaaatctttttttctataaaagatacaattgaggtaattagcaatatttttcataataatgaatgaaatgccctgattttgataactgcattatggttataaaaaagaatgcctttttttttttaagttccagggtatatcagcagaatgtgcaggtttgttacataggtaaacatgtgccatggtggtttgctgcatattaagccccacatgcattagctatttttttctgatgctctccatcccccaaacctacccccaatgggccccagtgtgtgttgttcccctccttgtgcccatgtgctctcatcatttagctcccacttataagaacatgttgtgtttggacttctgttcctgtgttatttgctgaggataatggcttccagctccatccatgtccctgcaaaggacatgacattgttcctttttatggtcaatcctttttatggctgtatagtattccatggcgtatatgtgtcacattttctttatccagtctatcattgatggcagttgggttgattccatggctttactattgtgaatagtgctggaatgaacatattcatgcattttttttgtttttgtttttgtttttgtttgaaatggagtcttgctctgtcacccaggctggagtacagtggctcaatcttagctcactgcaacctctacctcccaggttcaagcgattcttctgcctcagcctcccgagtaactgggactacaggtgcatggtaccacacctggctaatgtttgtatttttagtagagacggggtttcaccatattgatcaggctggtcttgaactcctgacctcatgatccacctgcctcggccttccaaagtgcagggattacaggcatgagccaccacgcccagccacaagtatctttataatagagtgatttatattcctctgggtatatacccagtaataagattgctgggtcaagtggtatttctgcttctagatctctgaggaatcaccacactgtcttccacaatgattgacctaatttacatttccaccaacagtgtaaaggcattcctatttctctgcaaccttgccagcatctgttgtttcttgactttttaataatcgccattctgactggtgtgagatggtatctcattgtggttttggtttgcattcctctaatgatcagtgatgagcttttttgtatatgcttgttggctacacaaatatcttcttttgaggagtgtctgttcatgtcctttgccccttttttactggggttgttttttattgtaaatttggttaagttccctatagactttggatattagacctctgtcaaatggatagattgcaaaaattttctcccattctgtaggttgtctgtttgtgctgatgataagtttcttttgctgtgcagcagctctttaattaggtcccagttgtcaatttttgcttctgtgtcaattgcttttagcatttctgtcatgaaatttttgcctgtgcctatgttctcaatggtattgctcagattttcttctaggatttttatagttttggattttacatttctttaatccatatcttgagctaatttttgtataaggcataaagaaggggtccagtttcagttctctgcatatagctagccagttctcccagcacaatttattaaatagggaatcctttccccattgcttgtttttgtcaggtttgttgaagatcagatatgcaatgttatttctgagttctatattctgttccattggtctacatttctgtttttctaccaggaccaagctgttttggttaatgtagccttgtaatataggttgaagtcagctagtgtgatgcctctagttttgttctttttgcttaggattgtcttggctatacagactcttttggttccatatgaattttaaaatagcttttactaattctgtgaagaatgtcaatggtagtttaaagaaaatagcattgaatctataaattactttaggcaatatagcctttttcatgatatggattcttcctatccatgaacatgcaatgttttttcatttgtttgtgtccgttctggcttccttgagcagaggtttgtagttctacttgaagaggtccttcacttcccttgttagctgtattcctaggtattttattattttggtagcaattgtgaaagggagttcatttatgatttagctctctgcttgtctcttgttggtgtataggaatgcctgtgattttttttgtgtgtgtgtgtgtgacagagtctcactctgtcactaggctggagtgcagtggcatgatctcggctcactgcaacttccacctccagggttcaagcaattctgctgcctcagcctcccaagtagctgggactacaggcgtgcatcaccatgccaagctaatttttgtatttttagtacagacggagtttcaccatgttggccaggatggtctcaatctcttgacctcgtgatccacccgcatcagcctcccaaagtgctgggactacaagcgtgagccaccacactcgaccaaatgcctgtgatttttgcacactgattttgcatcctgagattttgctaaagttgcttatcagcttaagaggcttttgggctgagacaattgggctttctagatgtagaatcatgtcacctgcaaacaaagataatttgacttcctctcttcttatttgaataaactttatgtctctctcttgcctgatttccctggccaaaacttccaatactatgttgaataggagtggtgagagagggcatcattgtcttgtgccagttttcaaaaggaatgctcccaggttttgcccatttagtatatcggctgtgggtttgtcatatatggctcttattattttgaggtatgttccttcaatatgtagtttattgagagtttttaacatgaaaggatgttgaattttatcaaaggccttttctgtgtctatcaagataatcatgtgatttttgtatttagttctgtttacatgatgaattacatttattaatttgcatatgttgaaccaaccttgcaacttgatcatggtggataagctttttgatgggctgctggatttggcttgccagtattttttgaggattttttgcatcaatgctcatcagggatattggcctacagttttctttttttgttatctctctgccaggttttggtatcaggatgatgctggcctcagaaaatgagttaaggaggagtccctccttttcattttttttggaatagtttcagaagaagtagtatcagctcctctttgtacctctagtagaatttagctgtaaatctgtctggtcctgggcttttttcggttggtaggcctcgatttcagaactcattattactgcttcgatttcagaactcattattggtctattcagcgattcaacttcttcctggttcagtcttgggagggtgtatgcatccaggaatttatccatttcttctagatttttgtagttcatttgcacagaggtgtttatagtatcctctgatggttgtttgtatttctgtggggtcagtgatgagatctcctttatcatttctgattgtgtctatttgattcttctctcttttcttctttgttattctagttatcagtctatctattttattaatttcaaaaaatagcttctgggttcattgattttttgaagggtttttcatgtctctatctccttcagtaccattctgataatatttcttgtcttctgctagctttagggtttgtttgctctcgattctctagttcttttagttgtaatgttagagtgtagatttgagatctttctagctttttaatgtgggcatttatttctataaattcgctcttaacactgctttagctgcatctcagagattctggtacattgtctctttgttctctttagtttcaaagaacttcttgatttatgccttaatttcattatttacccaggagtcattcagaagcaggttgttcaatttccatatagtcgtgtggttttgagtgactttttaaatctttagttctattttgattacgctgttgtctgagagactgttcattatgatttcagttcttttcatttgctcaggagtgttttgcttccaattatgtgatcaattttagataaagtgccatgtagtgccgagaagaacgtatattctgttgttttggggtagagagttctgtagatatctatcaggtccaggtgatttagagctcacttcaggtcctgaatacctttgttaatgttctgtcttgatgatctaatattgctagtgagatgtcaaagtctcccactattattgtgtgggaatctaagtctctttgtaggtctctaagaacttgctttatgaatctgggttctcctgtattgggcccatatatttttagaatacttagctcttcttgttgacttgaatcctttgccattatataatgcccttatcttttttgatctttgttggtttaaagtctgttttgtcagaaactaggattacaacccttgcttttttctgttttccattagcttggtaaatgttcctccatccctttattttgagcctgtgtgtgtctttgcctgagataggtctcttgaatacagcacaccgatggatcttgactgtttatgtggcctgctattctgtgtcttttattggggcatttagtccatttacatttaaggttaacattgttatgtataaatttgatcctgtcatcatgatgctagccagtcattttgcagactcctttatgtagttgcttcacagtgtcattggcctgtgaacttcagtgtgtttgtgtagtggccagtaacggttttttctttccatatgtagtgcttccttcaggagctctgataaggcaggcctggtggtgacaaattccctcagcatttgattgtctgtaaaggattttatttctccttcacttatgaagcttagtttggccaaatatgaaattctgggttggaaattcttttctttcagaatgttgaatattggcccccaatctcttctagcttgtagggtttctgctgagaggtccactctttctctgatgggcttccctttgtaggtgacttggcctttctctctgactgccccttaacatgttttctttcattttgaccttggataatctgatgattatgtgtctttgggtttatctcatgtagtatcttactggggttctctggatttcctgaatttgaatgtcagcctgccttgctagtttggggaagttctctaggatgatatcccaaggtatgttttccaacttggttccattctccccatctctttcatgtatgccagtcagtcataggttcagtctttttacataatcccacatttttcagaggttttgttcattcctttccatttctttttctctaatcatgtctgcctgtcttattgcaacaagatactcttcaactctgagattcttttctccacttggtttgtttggctattgacacttgtgattgcactgtgaagttttcatgttgtgtttttcagctccatcaaggtgtttatgtttctctttaaacttgttattctggttagcagctcctatagttttatcatggttcttagtttctttgcattgggtagaacatgctcctttcgttcagtgaagttcattattgcccaccttctgaagcctacttctatcaattcatccatctcagtctcagcccagttctgtgtccttgctgaagaggtattgcaatcatttggaggagaaaaggcatggtggctttttgagttttcagcatttttgcattgattctttctcatctttgtgggcttatcttcttttgatctttgaggctgctggacctttggatggggttttttgtggggtcttttttgttgatgttgttgttgttgctgtttgtttgtctcttaacatcagggccctcctctgtagggctgcagttttctgggggtccacaccctatttgcctaggtccctcccccacctggaggcatcacaaatgggggctgcaaaacagcaaagatgacagcatgctctttcctctagaagctctgtcccagagggcaccgacctgatgccagctggaacactcctgtatgaggtgtctggcaacccctattggaaggtctcacccagacaggaggaacaagatcagggacctgcttaaagaagcagtctggccactccttggcagagcaggtgtgctgaactgggatgaatcccccttgtctagactgtccagactctccagggccagctggcaggaaagagtaaatacagtgcactgcagagattgtggctgcccctcccgccaggggctctgtcccagggagatcagagtcctgtccataaacccctggctggagttgctgaaattcccatggggaggccctgaccagtgatgagggatggatcagggtcccacttgaagcagtctggctatagtctgccacacccactgtgccgtggtgtggggaattcttcccagtacagaccagtctctctggcactggcagaagaaaacagccaactgtagctgcagagatggcagccacccctcccctggggaactcagtcatcttaggcagtctccagcctgctgctgctaggcagcagagattccaagccagtgggtcttagctagtgaggttccatgggaggggggcccactgaatgatgctgcttggttccctggcttcagcccccttcctacaggagtggatgatctcctgcctcaccagaattccctgggccagagtatgaaaaacaactcctgcatctcagtgcctgcccaagtggccacatgcctgagtggctgccaacctgagtggcccccgtcagcctgcacagctctgtgcttggggatccaaggcccgggtggtgtgggctcacgaggggatctcctggtccatgagttgcaaagatccatgagaaaagtgtagtttcctggacagggtaacacaatcactcactgcctcctttggctagggaagggagctccccttgccccatgcagctcccaggtgggccatcatcaccccactctgcttttcctcactctctgtgggttgcaccaaccgcctagtcagtcccaatgagagaacctggataccttagttgaaggtgaattcacttgccattttcattcttctcagtgagagccacagaccacagctgcttctaattggccatcttcagctagtgtttaatgtcttgttattagaacacttacactgaactacttaggggtaaagaggcgtcatatccaaaatgtactcccagatgatttaataaaaataataatataaatatatggggagaaaaaatgatacaacaaatgtgataaaatgttaacacctgcaggatctgagtgaaggataggattattattattgtaagtttttctataagtctgaaactatttcaaaatattaaattattttttaaaaagaaacatctaactgggaacaatgaatgaattagatctaatatactcatacggttatatctggaaaatataacagtaagcaaaaaaccaagcaacatatacaccagataatatttatttaaatttttaaaatcataaaacaatatatattattattcatatatgaatatgtaatgaaggtttaatgtttattgtggcaaagggagaggaatgaagacaggagaatggggcaaacatcgtaataacatatttttttaaaataaagctcattccaatgtgacgaaattttaacctgtgttttatctgtgtgatgggtacataggtatccattactattttcacagtatctatgtgtttgaaataagttacaattaaaatgttttaagaaaaaagattttaatggttcaaaggatctaaaaccccaaaaacttcccagtgtagctactgccacaaaccaaatggtttttgaaggtgcttatgtctaagcccaaagatgtagtcacataccaacaaataactatagaatactgggaataaagatcaagataaatactgagaatgccttttctttgcccaaggtgtctcttcagcctttccttaaatatatgcttagttttagaattttcctcactagaattacttcttctacatctcattaaagcacaaaaataccataggttcgaagtactatgtatttctgtcttataattgagtaaaatcagacataccatctatcttcattgtctgtattcatggataacacatacatttcaactgtctcagtgaaatcttgacaactctggtcaggtttgaaatttaaactctggatgaaatgaattagctatattgtaactgatatttcagtcagagagaagctccttatttttttaataatcatttctggaataaatgatgtttacattctcagattcaaattcttttaaaaataaaatgttttttcttttcaaattaagaaaaataatatctatgtattatttatgattatacactgtggcagagactcctaataatttatacccattccttcttcttctgagatacacagactatatttcccattctccctggcagttaagtatggccatgtgactggctatagctccaagcctggcctacaaaaacttccaagcataattccccatcctcttctgccagcttgatacacttgacaacaaggccctagaggatgacagaagcacaactggaataatcctgtgtccctgaatctcagcatgaaggaaagtcacttaacgagaatgtccatgtgaatgaggaaaaataattctactgtattaaaccactaaaatttgggggtctatttgttaccacaattagtgttccattaactaaaacgtgtaatcatttttttcttggagaaataagccaggaaaaaaagaaacccatatgtaaatcataaacaattttccaattgtcaatatgaaatacattatacttacaaattgaggtttgtagtatgctggaccaagtgtactgtcacaagcaggtggaaaacattttataatactgccatcatcattaatatgataaccatatgactttccacaagaaggaattgaaggaacatcaacacttctggtaagtgtaggtgatcttgaaattttctgcaaggaaaacattttatattatttattccaaggcaagaggaaggggaatgaagaaccaaatattaaaagttactaaaaggcaactattaaatattgatttaatgagtttcatgatataaaacaaaaatgtttgttttgttattgttttttttgagatagggtctcactctgtcacccaggctggagtgcagtggtacaatcttggctcactgcaacctctgtctcccaggttcaagtgattctcccctcgacctcagcctcccaagtagctgggactacaggcatgcaccactatgcttggctaatgtttgtattcttagtagagacagggttttaccatgttggccaggctggtctcgaactcctgacctcaaatgatctgccagcctcggcctcccaaagtgctgggattacaggcatgagccactgtgcctggccaaaaatgttttgtaaaagtaatttaaaggagtgaattcaagtctgttgcttcacctttaaaccaagagaatgtatttctattaaatttagaatagaatagaatagataactattaaagtcatcataagaagcaaagattctttctcgtttgggtcagttatttatcttgcttagtaaagccaccattactaattctaaaaacaggcaatcctattcacatcaacaatcatgctattatactatctactatgcaaaaacaaactttgtatttttcagtaatactttctggcttcattccttcccagctcctgactttttgtttccacatttcctgagtcttgtataaatgtcctaagtatgcaagctatatagcaggaaaatatctatgatgtaatgctaaatggaaatagcaaaatataaaagtgaactatgaatatagctaagttatgtgaaattatatataaatgtataaagtcacatacatatataatttaataccaaaagaagctatacaaaaattaacagaaaattaatgttagagtcagaagttttagggtgattatccttttatcgaaatttggattaatggaaaatattttataatttaaataaaaacatgaaggtgtaatatatattacaaatattaatataaaatgtatcaaataaaagtactggcatttaaagcatttagttactgggacactgaaattattaagaatatattgattcctgaagtttctgcatgaataaattaatgctatagttgcatgttcacatgcccatgtagaattatgttataaacgtactatcactggcagaattttctttttctttttttctgagacagagtttttgctcttgttgcccaggctggagtgcagtggcatgatctccgctcactgcaacctctgcctcctgggttcaagcgattctcctgcctcagtctcccaagtagctgggattacaggcacatgccaccacacctggctaatttttttgtatttttagtagagatggggtttcaccatgttggccaagctggtcttgaactcctgacgtcaggtgatccgcccacctcagcctcccaaactgctgggatcacaggcacgagccaccgtgcccagtcgtttttcttttttaatataatttttggagggcgggggacaaagtctcactgtgttgcccaggctggagtacagtggcatgatcttggctcactgcaacctctgcctcccgggttcaagtgattctcgtgcctcagcctcccaagtagctgggattacaggcatgtgccaccatgcctagctaatttttgtagttttttagtagagacagggtttcaccatgttggcctggctagtctcaaactcttggccacaagtgatctgcccccacttccctggcctcccaaagtgctaggattacaggcataagccaccacacccagccagaattttattttttatcaaattaaagacaaccattaagtagtttcagtaatacctatgggattaattaccaaattaaaataagaaaccattgaacggctttccctcctttccatatatttaaaaagaatttgtgtgatgtcaaaactttccaaaataggccaggcgcagtggctcacacctgtaatcccagcactttgggaggccgaggcgggtggatcacaaggtcaggagatcgagaccatcctggctaacacggtgaaaccccgtctctactaaaaatacaaaaagttagccgggcatggtggcgggtgcctgtagtcccagctactcaagaagctgtggcaggagaatggcgtgaacccgggaggtggagcttgcagtgagccgagatcacgccactgcactccagcctgggagacagagcgagactccgtctcaaaaaaaaaaaaaaaaaacaaaaaaaaaacgactttccaaaatatagcccctacctccagtctctattcctacaactctcccttcgctcctgtactccattctaaagaactttgttctttcctggaatatatcacactatcaaacacttcagtgtctttattcatgtggttttttctgcacataaagtgggaaaaaatattttttcccattctttttaactactattttttcccattctttttaactactcggtgaatccttcttcaagatcaggtccaatttgtttcccccattccctccaaagactctctactttgagctactagtgaacactgtattatggctctaagatagcatttcattaacagtattatactgaatttcattcgttattttcctgttaaaattatacatctcaggaagcaatgattttttctatgtattaccaacatctagcattatgtatggccacacagtcactcaaaatatatttgataaactccctaagtaaatgaacatttactttgtccccacacacgaaatatctgcaatttaaatatacttacaaaatttaacctcattgtcattgcactgatattattcaacaaagtacttagccttaaaacatatcttcctaagcaaaaagctgattaaaatgtaatatgagctacatgaaaaagttatgacaagagaaggaaccactctaaacaaacagtgaccaaatctgctcaataatagcatttatttcaaagaggtagcctttgatgtaaaaattattaattatatagcacccaatgtacctttctaaacataccacatactagtattctgcacaaattcttcatttcaattaaaataaccttctcactaccttccataaaaatcccacttctgtatcttcactcatgtaatactccagtttgggatccagattccaactctattcttcaatgccatgtcaaaacccacctcctctataaatcttccataaattatgccttcacataatatagtagtccacctttaaattcctatggcatttcattacatgatcattcatttagcaactgtcacattttgtcttgaattagcagctacctatttgtctacctcccatataaattttaagcttttttacttcaggaatcatatttttaacttatattatttatattttttccttccttgccaccaggaaggaaatatattattaacagtactaacacagagtttcctctatacataggtaaaccactcaggtagtttgtaaaatttcccttactttttattcaccacagatgttgaaagtgactatagatttgctaggagcaaaaaatgaagttagatatgaatacagttaaaaactaaagtttatttacttataaaataactaaaatgtaaacactaataaatttttataggaaggctttttaaatgtacttcatatcacataaaatattaaacctttactattttaactaaaaaatgtcattaacaagtataatttaaaatataaacgtactgactgaagatgctctctggtctctaatacttttctgttcatgatatcttgtgttctaggataaaactgatcatagcttgctggtcctggattatctgaaataaacttcttaaaacgtttctcccggttttgtagactatggcctccttttatgttacactaaaatggagggaaaaaaaccttctgatatataaaagaagcactttacaattaatttctacttgataaatattaatcattatcagaaaatatttttaaaatgcaagctaagaaagtttactattgactgaggatatagttctagtaaaaggggatagtaagagaagatagcaattatagttgtcagttttaacttgaaactcaaaactaaaatttgctgtacttggagcactttgagagagtgcaagaaaactgtttttaaaacagaaatcagagatgggaattcgtaaagctgtagagcaagaataaaggcccttagaaaaatttttacccctgaaatgaactaaaaaaaaaaaaaaaaaaaaaaaagttggcattcatattgcagggaaaaagcaaacctttcaaggttgtttagtgttaattattttcatgaataacattttggtcatttccagaaaaaattataaagacttattagcaacagcttggttttatgttcagattaattttaaacattgtttattacagagcaaacatttgagtggaatcttccagggctctccatgctacctatctggattctccagaatctgaaaattatcaattgactaatatccaattaatttgggtgaaattacatcataaagattcctgtaaacaattacagtgcaatcatttcaaaaagatgatttatgataacagtggctggcatttgattgatcagctaagattttaagtcattgatctacaaatagcccttttcacatgtccagttgttcacagtcaccgttcacagagcctatctctagcgggtaccttattcaacttcactcagcttttaagaaatataccaaggaggccttcttttaaaaactgagtcaaattttatttttaaataggcaattcactacttgattactattttaaaaagatcagaatttctatgtttaaagaatagatgtataaaaataactttaatgatttattttacaaaaacactaacaagttgaacaaaaagtaaaatcctgtgaaaagagaactttccaaattttgataatttaaaagccattaccataggctctatgatcatacaaatcaaactgcaacctgcatctatatcgatcacttcaacaaggactttatctgagcctccaacaggtgagttaaaggtctgctgggatcagctaggagccaatacatataaatgcaaaatttatgtgaaaatggcaaaaggtgatactcatgactatgaagatatcagagttatatctactatttctaaacatgaatgaaccattgaagataatctggtcacagattcttgagactgtgcagaaacaggagacagatgagacaatggcaatggctatagctttaaagcatggcacaaaaaccaattctttcactctaatgccattcctcttctacgcatttttactatctgcacaacttccatgggccataattcattcaagagtcctattctctcattctcaaggaccatatagcatgtaacaatgttttgtgtcttatagaatatgtagaataatgaaaaacatccaacccaatcatgcaaccaacattgaataaatttattttctattattcaaattataaaatataaattgaaagtgaaagaagacaatataagcagaaaataaaatacaacaaatgacatttggtctattcagggaagaaaacatggttttattaagtcaattatagtaactataaagttacctgtgcttctgaaacattatagtgtcctggacctggaacagctttctcaatgctagaggcaatggtaaaagtactttctctggcagtcaaagaaagaaatggtgcattactacctataaaaataaaatcatatgaccagcagataagataagagtccaaggatttcagagaaaaacgctcaaaatatatataatcatgagtatcctcaattgttaagactttattttcagaactgtctagtcagagaagttattacattttttaaaatctgatataagatcagaatttttattaatatattaaatataagaacctaaagaacttgacttattgaacaacaacaaaaaaaaaactaaagaaaataaagcactcttatcttctaatcacttttggtggggatgaaaatggcaattatatttagctgataaaacattttcatcctcagaagaccattgttttatatttttaaatagcatatattatttgcagaaaacatcatatataaacttgtaaagacaccctagatggaaataatttaaagtgggtttacagcagataattggtcatgtctccttgcctaggcacatagtttgtatcagtaaatatttcttgattggctgaccctaaacaaaggtttacaaatacaagacacaaatttctttggaacaagtaattataagattatacaaacttgaacactctactgaaaaactggtactaaaaaattcaagatctgtattggaaaaattattagtgtttaagcaatgtggatatcaaagaagagatgggagagaatagagcagcagctatattcaaacaggtaataaaagaatgcaagtgaagactcaaaacttttgcactaaatcttgtatactaaaggaaaatgtgtgctactgtaagaatgtatggtgataatcaatatagtaaaaaatcttgctaatctggactaataataaaagatactctatttaaaataaaataatgtgtttcttttgaggcccacatgtattaaaatgcaaccaatgtcaagaattatttatttgtgttaggtattgcaacataaaagaggtgagcaaaatatagatcttacctctaaaaaagtaatatcttgaagcattgagaaaagtattgaaataattttaaaaaaggaaaaacatctctaatgccataatggaagacacatgcaaattcagaaagaagagaagttctcatccacattgagatgatcaggaaaaacttcatggatgatgttaaaattcaaggtgttaatttagtgactgatggttttagctggttatcccaaatcagagaagaagggaagaggagagggaaaggtaaaaggaagggaaagggaggaaagaaggcagactgaccttcaaataagttacaaagaccacaagaccagaaatccttaaaagtaagccaaggttcattttgaaaaggcaacagttgtctggtagagctgagaaattcaggacaccaatgaaacattctacttactcagggtaaatagccagagaacaagaaccagatttcattccaaatacatatataaatacacacacatacacactcaaactacatataaaatgaatcatacaaattaccagagagtgtactttcaagactcaggaaaatatgacccataaagaggagaaaagtcaatgaaaagaaacagattgagaaatgaaaaggtggaattagcagacaagaatactatatataatctattataaatatcctttatatattcaacaaggtagaaaaaagatgaacatgatgagaagataaagggaagatataaaaaagacccaaatcaaacttataaaacaaaaaatacactagatgaaattaataacaaatgtttgtggattaataaaatacattttttctcaattcttaatccctttaaaaaataaggtgctccttgacctgtgatggagttacttcccaataaaaccattgtaatttgaaaatatagtaaattgaaactgcatgtaatatacgtaacctataatagcatagattagtttagcttaacatgctcagaacacttacattagcctaacgttggggaaaattacctaacacaaagactattttataataaaatgttgaatatcttatgtaatttattgaatactgtactgaaagtgaaaaatagaatggttgtgtgggtactggaagtttggtttctactgaatgcatattactttcacaccattgtgcaaaattttaaaaaaatgtaagttgaatcatcataagtaaaggactgtctgcaattgcttaaagcaaaaaatagtctcaatttattgaggcattatagcagatgtagaagtaaaatgtacaaccacaataggacaaagggtgagctgggagaaatggaagcatactttgtgaggcttatttactatatatgaagtggtacaatattatttgaaggtagactgcaataaattagaaatacatattgtaaaccctaggcaaccacttaaaaataaaacaagagaggtatagcaaataagccaatagtggacataaaaaaagaattattttttaaaaacctttattcctgcaacaaaagtagggaaaaaggaaaaagaacagatgagataaatggaaagcaaatagcaaaagagcatattaaaacccgaagatactgatagtgaaattaactataaaagttctaaacacctcagttaaaaggcggagattgtcagattgaataaaaaagtaagaccaaactttatgctgtctataagaaactctcttaagacataaaaacagaaattaaaaggatggaaaaagttataacatgcatccatgaatccaaaaagctggagtgcctatattaaaatcagacaaagctggctttagaacaaggaataacagggataaaagatatacttcataatgataaaggggtcatttcatcaacagtatttaacaattcataaagaaaagcaaggaagttattaccataataatcaggatagtgtttaactgtagggcagaaagaaaacattgaaataaaaaaggccaaaaagaaaattttggcaatgttctatttctgttttcttttgctttttgtttttgttttcctcttcccactgatggcagatctattttttaactgaatatcttctttttaaggtctacatttatattttatgtgattttctatgtaagtattctatctcacaataaaagggttttaagtttaggttcatatgaacactaaggtaatctgagataaatatgaaaactaagaaagtgaaacccaggctacttctgaggtagttggcatcagaacacagcagggcccctaaatgaatctaccttaaacaaatgtaaaattagttgcagagtactgaaattcatataaaagttaaaaaaaatacactagccatgtactcaacatattattaatattattaatggtagagtatacatatatatgaaataattgggcaataaagagaatcaagaaagctggtactcataaaatcttcattgaagttttccaaaattaattatatagaatcttttgtcaataaaagtatacgagaaatattgagcacaagtaaaactacaaaaaatttaaatgtttataatgatacactccatgagagaaggaacttacctgtttatttattcatagctgtgtgcctaatgtttacagtgagggtgaccaattaacaaatgatattctaaactagtcatccattctgtaatagtgaatgttttattatgtatgggagacatgcatgtatgataggcagtgagagtacaataatgaataagataaaactctgccctcaagtagtgggtaagcctgacaaatagacaattatgctacaaaaatcactgccaataattaaagtataaaatatagaagagtgttctggggaattagagatggtagagtttgatatgggacatatggatatattgacaagtgaagtgctaactacaaattataaatcaaactgacagaaagaagaaattaagtgtatagaagaggagatttgagaagaaagaaatgagttcagtttgggatatattgagtttgaggcaccaacagaggaagataaatcaaactggtatgaagcaataaaagtcagtctacgctgagaaagaaggtgggcagtatgtgattaaaggaccaattctatagtcacaactacagccacaaaacaaagaaaacggcatttttcacatataagcagtaattagatctttgaaatatgtactcatcttcaggacaacaacatatacagcaatcacatacatattattatctaaactttaaaaaagatagattgcattccctgatgcagctatattctgataggcaaataagaaaaaattatcattgttggcataagcacataggcacaggtatgagaccatagccagcttatccttctgtggcagataaagctaaccactcccccaccaaaaaagaaatctgggaaagaatatttttaggagatgatgtcacccagcttagctaactaatagagaaccaatagatataactgatatacagctgatatttattacataaataagccaaaaagcaatgaaatactccttggcacgataatgccaggagtagtcacattagtaaaaggagtatgtttttatcacattatactaggctggttgtctctggggaatatttactttaataagagatgtttgcttctcaggtaatcttaagaaattcaggcatagctctcactaatctcgaatttgagtatccactctctcctacctcatgaaagcagaaagaaaagcagcttagtcctgtcccttcaggttgaaattcctgggtaggagagattctccctgatcaaatggcctacagccacggaaatcgagtttcaattaaggtaaaaagaatttcctggggaaaatgtagagacaataccctgaaggactggcctggccaagcaggctacagtgaggggacagtgggagaacagcagttaggagagaacggttggaaataaagagtatctgtatctaaggctctaaggtcttttcctcttgtgaaattcaaaataacaagtaagttatataaagtccctacatctgttcttctcacatcatactccataaaatgaacctgacccttagctgaaataattgtacacttctgcatagtccaacgtgttactggtcctaaaggtaggtgaggtagtttgtacctaggaaagagatggtagctacttttaaattatctttcagagaatccagcagagaaatcactaaagagatacctgttccttctattgattatcagcatattcttagtattgctaaaacaaaatgtataggatgcagctgctcaaatttccccagcatggaatttcctactttatctcatagatcaacaagacactatcctataaaacagtaaaagggttttaccacacgctccttacttctctctaagcaaagttacaagttacaagagttttaaattacgctatatgtggctcattatattttaattttatttcaagattactgtttgtttttgaacttatgtgttatggtattcacctaaaaactaggaataatggagtaaagatcgtggttattgccctcaagcagctcacattttagtgggtctgccagataagttaacattaattacaatatagaatcaaagtgctataaaggtcattaaggagtcagagaagaaaaacctgagaaagagtagtcagtgaacaacttcactttagctgaatctcaaagaataaatacaaattagccaagtgaagaaagaaaacagtgtactggacaaatgtatcagcagatacagaggcacagaggtgagtgagcatgaacttaggaaaactgtaaagttgaaattgctgaaatgtaggtcaggtggaggtggaggtgtgggagatgaggtcagggcccagaacatgaagaacattataaacaacattaaggagtttagatgttaaccttgatattacaaaggatttttttttcacaaataatgtaatatatcttagaaagatcactcttgccacaagatagaagatggattgaagactgaaataaggaaaaacaagtaatattttatatgtttaattcaaaatagaaataatgagagcttgaactaagtcaaggacagctaaatggaaaagaggaactaatcaaacaggcactgagaagatagaatcattaggtgttaatgatcaacaggagtagtcagggagaaaagagtctagaataattccaaaacttaaagtttattatagactaatagggaatttttaaaaagggaccagtattgctggaaaaaaattttaaaagggaccagtattgctggaaaaaattatgagctcagacacttaaaacttcagataccggagaccatctaggtagagatgttcaaaaaagtaactggttatgactcaaggacatcaacagcaacaaaaaaagaattaaaaagaagagaaaaacaaacaaaagtgattggcagtgttgaaagccgaaagattaggagaaagctcaccttagagacataaatcacctgtatctcttaagatttccttctgggagtcatcagaatcagaatatggatagcaaatgagaaagtacacacgagaaaagtaacaagcaaaggattggaagtacagtacataaacatttaaagatgtgtcaaatgaggactaagctctgattttttttattttgcccaaattcctatctaaggggtctagggagtcacgccctacaaactatacattcttatcagatggattttatttaatcctatatatagtggcttactttccaatctgactctggcataacattatgagacaaggaaaaaaaatcaaaatgttttacctaaaaatatatttccttgccataccttgaaattgccctgcaaagtctcttgtgggaaaaatcaacactctatagagaataccctttccccttcgttttccttcctttccagatgcaggagataatcaactaagagccaggcactcttttaggtctgataagaagcattttacaacctgctccctctctctgaagtctgctatctgagagtttcctctgcacaacaaaacttggtctccacaatcctgtatcttaacctgaacatttcttttgatgccagtcttcagatagactcaaccaattgtcaaccagaaaatgtttaaatttacctatagcctggaagcccccactttgagttgtcccgcctttctgaacaaagccaatgtatttattaagtgtacttgattaataactcatgcctccctgaaatacataaagccaagctgtaccccaaccaccttgggcacatgttctcaggacctcctgagggctgtgtcacaggccatggtcactcatatttggctcggaataaatctcttaaaatattttacagagtttgactcttttcatcaacaagaaacataaaaacatttaaagaaggccatgaaggactgcttggagagggggagaagatgatgccctgattcggcatttaacaaatgtttattaggtcccaatcatgttcccagacactcttccaagacagtagttgggaaaaaaaaaaaaaaaaaaaacaggaggaaatgatgttacattttggaaagaagtgtttccaagaataaagtggtcagttatgtcaaaattaaggattgcaaagtgtcacagggggtcattgttagccattgttaggggaattaatgcttataatgcccaactccattaaaataaagatagaataagctgcaagaatagtgataccagatactgtgaagcagtacaattcaacatgtgaaacactgacagaagtcaaatttgtactccaccccaagaaacctaaaccttcccttatctgatcagttatgtaacagaataatggatcctggcatttgcttgaaaatacatagtgtaggtatggggaaaatgtaggttaagaaaaactatcatttggacggtattaagctccagaaaatcaccagaatagaaaaagtagaaagcaaaattgatgtatttatttttgactaagtcactaactgcaaacaaacgaggagagcaaatattatttaaattatccatccccactccactggtcaaaaatataatttttctttacagaatgtggagaaaaggggctcccctgaagtgtgttaaaagagatgaggacggtcagaaaaatctgtctgaaaaaaaaacggaactatctttaaataatactgcaaaatagaaatataagctacatcttaataaataaatgtctctggttaatgggaggaaagatgtgaggcaggcaggattacaaagcaacgagacagcgggaggtaagggcacaggatttggagactcatatattatgtcaacacagccaggaaatcaaaatcctagacctaaactgcacaatcaaaagtaggatgtagacaactattgcggaatcaaaagtcctagccatatgctcaccagccttttgaaatgggacaagtgatactatcagtctcatctgtaaaataaaagtatagtgttttccctgcctacttcatgttttgttatgtttacaaaatggtactattccgctctatgtttaactcacaagcacgcagaagcggagcaggctgaagataggatgcctgtcacaggagctctgcctcttcctacatcttacctgtcgcctgctgcttcaggaaaggtacctggtaggatccaggacccacatgggcctcagtgctgccaccttcagccaatttgagcaggcggggagcccgatcatacatagtgctcggggtggtgggggcgctggggaagggcaggtgccgaaaacgataaaaacaaggtagctagaagtgtggagaaaaaggaagccg

SEQ ID NO: 1736 - DNA, 34899 bp, Homo sapiens
tttctttgatctcaaaagtctgttttatttttttaatagctttgttagtgaatgcatgtgttggcacaggagttgcaatgtcaaatgcctacaggggccaggcacgtgttttggctcctctcaaaatcctgaacaggtcagggtcagagtcagttaagtttggaagaatcccagagcaataaaacttgtgtcccatttgggaccttatgggaggagaacacttgtttcaggccagaagttagcagctgtgggggttgaggggtggtagagatgaccatgtgacacaaggtggtgagacagagggtctgagggtccccaccctgctggttccccatggtttgaacctgaggggacagtttcagaagttcctgtacgtccccagtgggggacatggaaagtaggtgagagatgcaagtcaggagcattgccatgggcaccctgggtgagaggcaaggtaacgccatgcagagcctgcaaggtaggctgcctgcgccagggccaggcagagtgcatgtctcagacagaggatccatgactccaggaaagctgagctgagagttttggaggtggtagtggaggtgttattattgcctggcctcaactatgtcaagaaaacagaccacagatcacaagtgaaaccaaggatttcaacagtggatacaagcaggaccccaggagaccagcagcccctgccttccttaggaagtcgtctaaattgtttcttcctggagatgccatcttgggaagaggaggaggtggtgaaccattgagcctaagaaacagcagtgatggactttgaaccttcaatttgactgaatattgatctgaaagagatatttaaattgaaagagtctctgttgaagcaagtgaaacttttaatttgaaagagactgaactacctttaactagcaaatttcaacgcttctatcatcagaaattttgtgctcataagaaagagtaatgagttataaaacctgaagaagccacatttatcttaaaatatttgttagtgtacatgttaaaatatgattgggttctctcattgaaatgttgattttatttgaattcaatgaatgccacttcattaggtattttttaaatcttttatgtatttattatgtttgttgcatcgagtggcataattgtttgaatacaaaactaaagaaattcagggaatttctccctaacatgcactgtaatagttaaaacacatacagacaactgcagattatgttagaatacaagattgttatttgctatttaccacaattgcaaaatcaacttgtcaaggaaagacaattagagtccttcaaatatcttgatgtttatgtgtttgatggctgtaatatacatgtaaattgtggagtatgacatacaaaaaattattgctttaaatatcattattgctagccccaaaaagagttgcaaaacatagctaagtgtatgtttttttcacatagcaggcatttgcctcccattccttttcctcaataaacaataggataaaggtctaaagccttgactttagatttggagttgacaatctgcacaatccttctgcccaaagccatgaatgtcttctcgtgtaagtgcgcgtgggtgggtgcgtgcgtgcgtgccacgcctgcagagacttaagctttgggatacagagtgaccgtgtcatagccctctgggggctttgtgcgggctcttgcgtgggtttcgcagtacagctccccttctatgaagaagtagcccttttgcttgaggttgaggttgcagtcggcacacacgaagcactcagggtgccggtacttatcccgcgccttcaccacagcaccgctgttggggaagaaaacgagctcaagttaaaaaaccacagagcaaaaatatgagacaaaggagagaacccaacagagaaggcagatgttctctatttcacagtcaggaaacaatggcctccagctgtgaaagcaggcacagccgtgaaactgtatgtaattgtcatggagatctaggatatccacaataaaccatcccgtgtttctctctgatgttgacgtgtgactatttttcagattttcaaacaagtactttatagaaaatttgtaggatcctacttcatgatctttccccatcgtttctttgaagagggagacatgatggagacaagaccaacccctctgcaaaagattctgcttttgacgggggtggttgtctacccaatgaagagtctctctgattgctttccgtctgcgtggtccagcctctattcaatggagcaagagaaaacagatcaaagacgaccgggcgtggtggctcacgcctgaaatcccagcactttgagaggccaaggcgggcagatcacaaggtcaggagatcgagaccatcctggctaacacggtgaaaccccatctctactaaaaaaatacaaaaaaattagccgggcgtgggcacctgtagtcccagctactcgggaggctgaggcaggagaatggtgtgaacccgggaggcggaggttgcagtgagccgagatcgcgccactgcactccagcctgggcgacagagcgagactgtctcaaaaacaacaacaacaataacaacaaaaacaaaacaaaacaaaaaaccagatcaaacagcagagatggaattcctttggggtgggtggattggcttctactgtgaacagtttattccaacttaggcacaatgattgcttctggtaacgtcaggcactgttgtattttactgagggcctctctgctccgagctccctgccctgctttgaccttttggtctcacgttcctccttttgccctaaccaggcttatcccccactgccttcttgggatgtatcctggctaaccggacagaggacacatcagtgtgtgagttcatggcaggaggaatggaataagggaatggggacgtggccacatggcacgaatgccatggagatgttagaattatcttggttgacttgatcctgcactagcaagtgtggctatttaaacataaggtccctgccgggcacggtggctcacacttgtaatcccagcactttgggaggccgaggcgggtggatcacctgaggtcaggagtttgagacctgcctggccaacacggtgaaaccccctctctaccaaaaatacaaaaattagccaggtgtggtggtgggtccctgtaatctcagctactggggaggctgaggcaggagaatcgcttgaacctgggaggtggagcttgcagtgagccaagattgcgccactgcactccagtctgggtgacagagcagggctctatctctgaataaataaaagttcccttgtaatggaagctgacagtttttcaatattttgtttcaacatttgtgtaacttacactgggtaaggataatgtattttaagtaacatcctgttgcctgtatttgtttccctgtgtttatacagaggaggatactatgtatactaaatgtatacacagttcatgtatgcatttactaaacactatacgttaacaggggtgggggagtttaaagtgaagtcttgattcttagacgtgacttttcaacatacatttgggcatcttttttttttcatgagaatctatctgaaattgtaagtcaaaattgctgactcatgtgatgtgacaatttggaggtatatctaaggagtgacagtcacaatgtgctaaatgttggggaccttacgtttcaagttgatgaatagaaatttggttttcacagttgcctttagtctataaagtcttaaaggagaagaaatgaactgtcgccaagctgtatcgtaaattccagggttaaaagtgaaacttacactatgccactcccacatttgtcacagagcggcatcctctgtgccccgcctgaaccgccatggactttcgtcaccggagctctcacactccgcgttccagccggacggtcatctgaaaaacaaagcgtttccatttatggctagggaacagctggccgcagcctgtgcttggcttctattttaaagtgtgcactttaacctgaagttgcatctgcaccgtcattccgagaggggcaggactgatgcaatcataagggacgctgttctgaaatagggcattatagaatggaattagtgaaaacatttattttgttgtggttggaggaaactgttacaaaaacgctcaaaggagcagagggcattattattttttattgtagcaaaatatacataaaatttaccattttcaccatggttaggggtgcaattcaatgacattaggtacatccaaaatgttgtgcaagcactgccaatatccacctccagaactatttcttcacctcacagaacctctgtacccatgaaacagtaactccccacccatgaaacagtaactccccgtgctcctgctcatagcccctggtaactttcattctactttctgtctcttggatttgcctattctggatctctcaaataaatggaatcatacaatatttgcctctttgtgtctggcttctttcacttcacataatgtttgcaaagttcattcatggtgcgccgtgtgtcagaatttaatttctttgaagactgaatactatttcattgtatgtgtatactacattttgcttatccattcatcagtcaatggacattgggtgttttccctctttgggctattgtgaataagataaatgctggcatacaggctgggcgtggtggctcacgcctgtaatcccagcactctgggaggccgaggcgggtggaccacgaggtcaggagttcgagaccagcctggccaagaggtaaaaccccgtctctaccaaaaatacaaaaattagccgggcgcggtggtgggtgcctgtaatcccatctacttgggaggctgaggcagaagaatcacttgaacccgggaggcagaggttgcagtgagccaagattgtgccactcactctagcctgggcaacagagcaagactccatctcaaaaaagaaaaaaaaaaaaataaagaatctgtttgagtccctgctttcaagtgttttggggtatattcctaggagtggagttgctggatcacatggtaattctgtgtttaacttttccaggagctgccatcctctcccagggttgctctatgttaccttcccatcagtaatgcacagggttcccatttctccatatcctcaccaatacttgttattctccatgtctgccacaatagccaccctaatgggacattttgcatttttgtgtggcttttaaaggacagtctatatcttttgggcatggagaagcctaggtcagggcaggagccctgaagatgacgggagtgggctggagacccaggtctgtggctcactggctatgtggcctttcacaaggccacccgcccatctctcagcgtctcatttgctaagtagggcaaataataggctcacctccccaagttcctgtgaggattacatgatactgtatgcaaaatactttgcacagaacatggaacacagtaagggtttttagagcattgtttagtttttgatgatggtgatactccagagtgtgggggggaggctgagaagtttgacaacattcatttaaaatgatatctcatgatttgtaagctgagctagcccttgactaccattaatgcaatttgtctttggtgtccttttgtgacttcacttggtggctacttggacatgtcctggaatctccttttttaaacgaggcaccatccatatcctatccttctgagcaaaaattcatttggctcccaatgaaaaccaagttttagactttcattcccagtatgtttgctgtcgtccccgtcccgccccctgcagtggcctctatcaatacgtttcagcaggtgtcagcggctgctcaccagagccatcgtccaccattccctggagcactctgaaggagcccgactggcgaggctgtgtgggctcattccgattgtcgtggagcatccggtacacgtccgactcggggggcaccgaggctgtgggctcgctgaaacacaggcacggcggggagcatcgtcaggtgctgggaggcaccagacgtgcaagaggccagagacatcaatactcagccattactctatgcacagccactcctgaacagaggtctagtattttcaagtgaatctctagtatagttaaaagcataatgtgaattcaaatggctgccttggaaatgtcattgaacaacaaatcggggagtcacacccacactcctccacttggcaaaatactttggaaggaaactaaaagataattgtcaggaaatagtaattaagaagaacaagacttgagtctgatggatacataatgatagatgtgaacaaaattaacttttcccagagaaaaggcaatatacacatgacagaaagtgcagcagtgagcactcagattattctcagtcatcaaattgtcggtaaaattcacattcacttttgatattaaacaaaaagtatatggtttaatatgtttttagttttaaggctaatttgttaacccctggaaataacaagggtatcattttacttgtaaattctagaaatttaacctctcagggtttgaaagcctgtaatgtagaaacttacatttttatatctgctataactgactgcactgtcttttaaaaatagccatgttaaaattcatttacaataatgacagcagctttaacatgctttctacaaatatattcataatagacaataaagaatttcataatactatatgttaagcactactttattattttatatcattttattgcattatctagaaaacatactatctgtaatatttttattccctatgtcatatttgcaaatggctttgagatatcttacactactattagttcaatgtgttcatcccaagagatagctttgggatatcactatttaacactctgaagcattataataatttaatttataaatagtgattctgtaatagtgaaagaagcagtaagattttatcctataataaatctttttaatcaaaatctttatggcaaaagtactgtgaacaaatagttataacaaagaaaaaattagtcaaaaagagaccagcaaaaattaaatatctacattaacagcctgagggtattcacctaaaaacctttatgcacaataaacattgtaaatgagtaaataatgacctctccacaagctgctatcagaagagagaagaatcatctcataaaattcctctaaacctcccacctccttcctaatttttgatccccaaaggacagacatagggtatactagattataaataactttgagaagtattacaccagatatttgtaaagtacattgtagctttcgagagacatatacatttggtccttacctgatttcattttattgctatctgacacataaagctctacagataattcctcaaatcacctttatcaccaagcctagatatttgcaataaatccttagtattttaaaaaagcttttcacatagctttctttccaagcctagatatttgcagtaaatccttagtattttaaaaaagcttttcacatagctttctttccattaagacaatgttaaaagacaccagtaaagctgacattgcccacgtgtttagttaatatgcccatggttcaaagagactcatattacctcatcaaaggtgtttcccctagggctgttgaaacctgaccctggagtgtttccataatattgtcatctgagtacaactgcataggtgtattaaactgagcatgtacaatcttcacaccaggaagttccatttccaaaggaatgttaggggccagcttagccgcaactttcaagtcacctgggcaaatggtactaacagtactgacagaagaaggggtgctgcgtccactgccacagtcaatcccggagggagtgctgcatccactgtgttaatggatacacgttacacagagatggcaccgggagccagacagtccagacagaagaacacagagaacacgtacagagaggttaaaaggaattgaagacaaaagtgagaggtgaattacatcaaaataaaaccaaatcttgatttgtcactagaatttatttataaagggaagacggtgaaaaattcatgattgaaaaaagtttaataaaattaaaaggtacaggtgatactgcattttttggctctgtttcactaggcaatgtgtaatttgagggttacatgtagaaaagttgtatatgaagtagaaaagatgcagctatcctcactttttaaaaataggccaaagactttaaaactggtcaatatcacaagtgatgaaggaaaattacattggctggacatccttttacatttctgaagtgcaacatttaaaattaaagttttagtgaacactgaatatgcagcatgaagatgcaatcacatatttgggctcaacatttcaaaatcagaagtatatttcagtaatacggttgaactttaattgaatagtaattggtaacttgtaggttttatggtacagattatgttttaaggctatcttgtaaatattttgttactattttaacattttctatttttactctttagttctgtgaggagtatactttaagacaattgttcagtggtttaatacaagccctagaaaaaaccaataaatgcttatcaccttgaaattaatgattagaggagaaataaggtggtgtttcactctttcgatgcttatatttcttacatagctattttatgcacaatttcagaagcacgcatctattcccaggcatatttcccttttccttttaaagatacatttcagggacttattaaaacatcaaaggccagtcatgcacatcgaagaactagggagattgtacattctatttggaaactggataggggtcagttaacaactgacatgctagtgactaaaaagtccatttttccacatgcatgagagataccaagagatttttgtaaaaaaagcatagtcatttaagacaaagcaaaaagaaatattagtattaatgtaaatatttatcatactttccagttagtgttgctgtaagctcaagacagagaatggatgtatatggtgtgtttaccgctaagtcaagattgtctctggtctcaagtatggccccatatctgcatttactctctagaggtattaatgctaacttcagcccatataaagataagaaaccaaaaggtattgagcagtaactttctctactccagcaatgttgcagccggattagtctggagaactcatgtcactaaatgggtttaaatttttttttttttgtcttgtgctatccagtttaactacctacataacctaaaccagacaggtgaataccagcttgctccttcacttcctgccttttgagaacctattgaaaacccaatctgtacattgtttagatcacataccaaaatatcaagtggcctattcaccatttttgtacgatctatagtgactcttgaaatggacttcagctggtaaaagaatatgagtacattttcagttgtagtgcagtttagtcaggatcatgtggatttaacctgagtgtaatgaagcttatgaaatcagtttagggatttgaaacacagagttaaatcctgggagacttcggcctcccagtaatgaacctactcaacaagcatttataactactctcaccctactgtgtgccagacatagtgcccgtactgggtagataaacaatgatcaatttagaacttttacttatgccatgttttatagcggttattagtaatatttttctgctataaaagccatgtataacttttgactcctccaaaacttaactaccaatagcctactgttgaaccgaagttttacagataaacagtctattagcacacaaatagactactacctatgtgtattgtatacattcatggcaaatctttttcttaatttttttgatatttcaaggctaccattagtgacttttttcaaattgtcgcaaatctccaaaaatttttccaacatatttattggaaaaaaaatccacatataagtgaacttgcacagttcaaacccgtgttctcagggtcaacagtatatgcatatgtgtgtactatgtaattttagttaaacatgcattcccagttcctttatcaatcaggcccatgtctattaaataaatgagtaatgaaccctaagcaaacaagaatgaacttttataaatttctgggccaatttaaaaagatcttttaaactgatcctttaagtaaacgagttttcatggattccagtcactgtggatatcactggggatagcaccgtgggtcaccacgacctgttcctgatgacctggaaaggcaggtgctaatgagattttctggggttgacttagtgacttggcaaggccacttgtaaggttgataacacactcaattacttcatgcccagatacgtcatttgacagattgctaatttctctggggtgtgtacagacattttggggcatacttccggaagcaacttgtccaaaaaccactcataggattgcattttatcatttggatctaaaataccttacatatgtatttaattgtagctttacccttaaaaattttacatatttgtatatgaaaacaccagtcttttaaaaggcttcagttatgatgaaataatcaaaagaactatagctaatggtaaaaccccagggaaattgagctgttaacaatttagcatgtccaacttactacttttttttttttttgagacagtctcactctgttacccatctggagtgcagtggtgcaatcttggctcaccgcaacctctgcctccagcttcaagtgattctcatgcctcagcctcctgaatagctgcaattacaggcatgtgccaccatgcccagctaatttttctatttttagtagagatggggtttcatcacgttggccaggctggtctcaaactcctgatctcaggtgatctgctcacctgggcctcccaaagttctgggactacaagtgtgagccgccatgtccagcactagcatgtccaacttacttttgattaaagaagttcattaacagtgtagttacagggtgactatagttaacaacaattatttgtatatttcaaaataactagaggagtggatgtggaatgttccaaagcacaaagaaagttactgctcgaggtgatggatacccccaattaccctgatttgatcattacatattgtatgcatatatcaaaacagcacacgtaccccataaacatgtacaagtagaatgcacccgaaaaaaactacatttgttttaaaagttaaaaacaaatctagttgtaggctggtatgcagccactcacaattccaccttgatgaagaatagtttggtgggaacaaaaaattcagaagttatagcaaatagtgaggagggacaggaagagaaggaggatgttgggggcactcttataattctttttttttttttttttttgagatggagtctcacgcttgttgcagtggcatgatctcagctcactacaacctccgcctcccaggctcaggcgattctcctgcctcagcctccccagtagctgggattacaggtgcccgccaccatgcccagctaattttttgtatttttggtagacatggggttacaccatgttggccaggatggtctcgaactcctgaccttgtgattcgcccacctctgtctcccaaagtgctgggattacaggtgtgagccatcgcaccaggccttataattctttaagatttgtgcactggcatctgttttttaagcaaaccttctcatttctgtttctctccttctctcttccaaattcagctacattaaaaggtgtgatcttcaaatgacaacattatgagtggcttgccattatccctatgtttaagttaaaatgaaaaatttttttaaaaggtgattatatacctaggattctctgactttcctgactttttataaaattaaatgttataggtttttagtaaaggcaggatatgtgttactctaacgtatcactttattcaagccttctgaagccccagagcttgtgtgggtggactcagtcacactaacctgaaaagaatgcaagtgattaattttactatgcttctttgggaagttgtatatattcaacagtaaaatatcatatccttttaactttaaatccagtgttttgttattggggttgggttggggtggggaagctgttgaaagtggagaaacggaaaagatgcagatgagaacagagtatgaacgagggaacacatagagagaagcaggagaggacacagagctgccagcatcgggagcgagacggctctggactcttcttgccacttgcttgggaaatgttgtgcaccctcaggatttgattcctttatccagtgagcatttattgggcatttattttgtctgtttgtagatggtcgcttattgagcatttattctgtctcatttctaggtgctgggggtataatgttgagccagtcagaccaggcccctgcagacactgagctcacgttctaggggggggaagatgtgtttgctcatggttgccttcttaacgcctttctcctgctcctctggtccagggctcctttctggatctgatatcacaagaattgtctggcatattttgagacaatcacctggctctgcctgtagcttcctgaaaggtctggacatggaaatcatacataagggatgacctgctatccgcagcttatgacaggagtcataagctcgggtgtctagaggggccaggaggtcacacatgtatgaaaatgggccgtgtctcacacacttaagagtgatgtgcattttgacaagatggtgagtttaaatgttctgtctaaaggcacttaaattctttttttttttttaaacaaaagaattaaataaaacatgcctgtgaaataaatccacctatgggccatcagtttgcaacagctgcggtaaatcatattcaatgttcctgtcggaatcaatccggtctaaccaccagcttccttcctgtgggctgactggcttagctgaggtcagaaggatggaacagaggtttcctgaagtcactgtttcctgatttggcaatacagggcattattttctttccccttaggttggagttcaatttctagagaagatatttgaaaaggatgatctgaagatgatcagtttctctactgagagacgagaaggaagagcttgctccttatcattctggcttgttcacctgattccttcctcctaaccggggctggtttccatgctcgctcctgctggcagggctttcctgacctgggatagacatactgactgcccgactcaaaggtcacagtgttctggatgggatccccagagcctcaggggtgttcgctataaatacacgtggtgattgcatacaatttcacagctctgtcatcttgtcaatatttactcttggaaatgcaagttatttggcttctgttctctgccaagtgagtttgtttctttttgcttttgaaataagcttcgcaatgagaaaagccactccaaacatctaccagttacttttcttgatgattagtaagaactgatttaagaagcatgcactgcaaactccacagtctcagcgcttatgacctgcttcggcccgggatcacgaaaggtttgggccgaatattatgcttgtgttcaaagtagttcccgtcctgtgaaaacaaagcgttaaaaaggccctcagtggaaggcggacactgttgcagataagattaaacgaacgatagttgtacagggaggatcatttaccaccaactactgtcataactaagaaaggcgatgacgggaccaggacgatgtcttctttccaaccatctatccgctaaacggtcaggcactggcggattggaccccacaacaattagaacatgttttagatgcttgtctttaaaagagaaatctgatagtgccttcaggaaagtaaaaataaaacagcaagagctggacttttgaaaagaaaagaaaccatgctatcactgttaggtacactgtggccagaacagagccggatacttacttttgaggtgagctaggaatgagaccccgcagctgtccgtgaagcgcatcttgtatattgctagttgaatagagcccaattggcgagttataggaagcgctcactacctgtcttttgtcatcaatgtttgcagctgcaacaaaaggctgggcccttctgttgtgcgcggtaccaatgggtttgaattcctgtacaatggcagacaaaatacacagccacacagcgcacaagaaagccattagtgagcgaaaccaacagcatcactactgttaataaaggcatctttacccacgacgagattgacggaaagattagaggaggagttagccataaacttttccatggttttctctgagctttacatgtgctatattcaccgatcaaatgttaaggtgaaaaggaactgaccttatttaacatattataaaataatttaaacattgcacctcttatctgcccctgacttcttcatctatagctttaagaaattctaatgactcatttgaatacagacattttgtgtcagaaatgggatttttggcttgaaaaatatacttaacgttttctcaagtagaatttacatatggtttctcttctattgatacattgataaactttcccccattttgagacatgagggaacaaaacaaggagaatgagcatttacgaataattagctacactgaatcatttaaactaagccaggtgaaaactcgtttttgaaaacaccttttaacaaaaagttcttaacttggattaagctataatcttaattttagaaaacacaagtgagagactctttttatgaaagcgggaataacatatacaacccctccctttattgtaatgatttcatgttgtgtgtttgaagacctcttcatgtttactctagtccccaaaagattaaagtcagtaattcagagagagaaaatgtgtatggttcacaggaggattttcactttattccttgggaaaaggaccaaacagcagagtcctcaaccctgagtttgaaacatgtctgaatgatctaaaatcctataatttttttttttaacgtgggaatcatgttttccagtttttgtacagatttataattttgtaaagcctttaaaacttttttcttctaagcaacagaagaaaaccaaaagggaatgctcaattacaggtcagctgattctctttccaaatctttttttttaatatttatttatttatgagacagagtttcactcttgttgcccaggctagaatgcaatggcgcaatctcggctcactcaaacctccgcctccccggttcaggtgattctcctgcctcagtctcccaagtagctgggattacaggtgtgtgccaccacacccagataatttttgtatttttagtagagacagggtttcaccacgttggccaggctggtctcgaactcctgacctcaggtgatccacttgcctcggcctcccagagtgctgggattataggcatgagccaccgcgcccagtcccaaatctttctatttggcagaattagtaagataaatctttctaacagtattttcccttacacattcacatcaacttcatttactttcgtgaatgtggcaccagtgttccagatttgaaatcgtacaaacatatataattatttgaaataatactggaaagagattatcgtctttaaaacattaaaagatcctgtaatatttagttttctccttttcatttcagataagttgtgggttatgcttttctgttagaaaacagactgtcaaaaacaaaaagaagaaaaaggaggaggaaagaaaagagagtgtctctcttccctaggtgtaagaccagagtttttcatagaagattcttgtgcctgagaatatgaacaacttcctgtagggaccccagctacaaaacgctttctttcagttcttctgagtatactccttcttctactatctaggcctattggcaaagctcacttaaaaaaacaaaaattatgccagggcaatggggtacagcttcaaatcctagcctaggagcctttgactccacccaccccaaatctcaggggatctgagaatctgtgatggggtaaagaacagcatttctctcaccaaccttggacagcatatgttaacagcctcctgaacccaaaaagaaggtctgagttgaattccatttagtctatgattttgtagtgtgattgagttcgctgataccttgttcacttaacttttttccttcataataatggctcacagccaaggagttgattaacattattgtagctgctcttaggtagaatgacccaaaccatcaaatgtagctttagaaaaatgcctaatcctagatcctgtgaaaatgtgtgtagctaaacatttataaatggtgcaatctaattgttttagctgatttattagtgaatttggattggctgagttttgtgattaaccagtataattagccattattatggcatgaaaaactagaaataattgtaagtaatgacaatggccatgattcaagcctttttgatatgagagaagacagcacactaattgcctaactgcctagttaagttttggtggattacaagtctctcaggctaattaaagaatcaggcagtactgaatcacttaagttttgtggagcttagctttttttttttttttttttttttttttttaaagaaagtaaggcctgccttaaagtctttgtaaatagaattgaattaataaaaactaacataatataatggctttatggaaaatacctctgcccttatttcttcttagccttaagatgataattaaatataggtagtgttgtcctgtaaataaggcaacttctctgaaaatatttgtgcattaataatctctagtagaatttctaaatagcagcatgtaagttaatcagctccaagcaatttctttgcaattttcggttttggttacacatatattgcaaagatcacaaatgtgtaatttgttaaaaaaaaaaaccaacaacctctattttacattcagatcataaaaggaagtgtttctaatacaggctgcaaacatttttatttaggctttgcaaagcattagtttatgggcttttagagtcattccaaaaagcacaatgaagtgtatacaccaaaggtttaccaagaaatttaagtggggcactgaggggcaacattctatccaaggcttacatcattgttgatggtcaaatgtaatcaaaagacaaaaccaattagaagtccgctgttccactttaattcatttttatttttcctggaaaaatcacaagtaactgaaaatgccagttaaaaaagtgtatacaacagttaatatagtccagctcttgtgtttattctatctagaaaaaaccacccaaataattcttatttcttaggaattcaatatgtaattattcccttaatggatacatttaaaatttttattttaaatgttagaggcttatattaaggaacaacattttgaattaatggaatgctagagctgccccagtgaaagctaagtaacttgacagaactctgctgatgttaagaggatccaaccatggacagcagtctcccatgtccttggaatgacctcagacatgacagcagtcaaaggcttcacctttcaacttcttacttggagactgctcacagataaagattcagataatctttataattctgaaccatctccaacagaaacagtatgtttgattcatagatatacacacatatatgtatacacatatatatttatatataatatgtatacatatgtgtatataaaatcaaatcatatatatatgaaaaaatggtgggcatataagagaaacaaactctatgaagtgatcttatatttgatcaaggcatgatgaagaaattatatttcatcacgtttgaagtttagaatcacttcctcctcatactcacccctcaaataaacagtaaagtcaccctcatcatccttttttctccagtgagcagtttcaagtgtttcccatctctcactgggaagagcttgaggaaatggtgactatgaaagcttgttttatatgggctgccttccagttaccaaaacactttttatttgtgaaaataaaaatgactttatcccacactcttcttgactgtgtatgtaaactctattatcttctctggcaaggatgcaatcctttttatggaaatggagacagctttcttcttatttagataagaaccatttttgtttctgaaagcatctttcttgtattgtgacaggcacagtatacctttgagttgttccactaacattaagcaaatatgagggttatggtttgagaatgtaagctttgaaaaaggacaaagagcttcattaacatactcttagtcaagagcaacacttcgtactaaaaaatggaccattttgtctatttttgtacagaaaaatagagaaaaatagattgtgttcaggattgcatggaaggcatttattcaggtgctgggagttgatctaaacaacaactaacgtgccctttaagcctaagattcaagtctaaactcagagaaacaaaacttagctatttgatgatagcatggaaaaattattattattattatttgtgagacggagtcttactctgttgcccaggctggagtgcagtggtgcgatcttggctcactgcaacctccacctcttgggttcaagtgattctcctgcctcagcctccccagtagctgggaccacaggcgtgtgccaccacatctggctaattttttgtatttctagtagagacagggtttcaccatgttgaccaggctggtctcaaactcctgacctcaggtgatccacctgcctcggcctcccaaagtgctgggactacaggcgtgagccaccatgcccggccacattttaaaaatctagatattaaaattttatatcaactattcctataaccatataagaaaatgtctccttagcttaaacctattcacaggggaaaaaaacccccagaaataaacatactaatatttaatatctgtggctgggcttggatggtatagttttttccccaataagtaagtgagaaagtgtattttattccaatgtcaaaggtcacataacttacaataaaagtttgacttgggttgagaaacaaaaactcaaatttcatattgttccatggccttttgctattcatctgcaatgacatcctgaagcatgataatattaatggcatttgtttctctaactgacacgtatttgctgtccagaagattgctgtatttgcagagttgtcattttgataaaaaagaaaaagacatcttttttgcacagctttgtattacttagaaaaacaaaaaaccctataaccatagcttagcttttctctcgtctcagtccacaagtgaaactcactgtttgacttttatcagcacgttttgttctggtttacgctaaaggatttttggatagcaggagatacactgcaatttagttatttttgtgtagggaatgtctgtcctgaagtaccaagttacataaactggccgtgcagaaatctggcctaagagtctcataaggagtagaaatcctttggttcattagtagaactgaattgttcttatcttggagcatttcaaacaccggcctcttggagaggatgtcagtaagaattagtcatgacgcaaagtcatggaatgtttcaaggctccatctgactggctgctatagcccttaacctaatctcaacctttaaaaaaaaaacaatttaatctcctttttctcatttgtagtattgtaaatattcatattttctaacccccaaatgtaggacacaagggctaatacatgcttgacaagaggtcagagtatttaaaattaggattatgccttaaaatcccatccttagaataaccatagtcataaattaatactcatagacttgcaatagaagcctctgctagagctacaacttggaaaattacccttaaactccaattctggagagatgttagcaaaacgtgggctcccatcctggtctaaactcactttgtgcttagtaaatacttgctgaattacttacatgctggggtgacggatgcaaccatgatgaaggatcactggggatttggtacttcggtcagatctatctagttggcctcatttcttgcatctcatattaacgaaattgggtttaaaaattaggagaaattcttgcatggaaaaataagttgcaaaggatgcagtgcaatattggatgtgtgctgtgtagggaaaaggaaatgcagagtcccttctggttggtccaggtaatgataagaggctgagtggtcaataagtgcatgtctattgactttaattcttaaaagcaccatatagtctctttttctcatgtgtcacctccaggtgataaattgatgacggtgggaggaagcaggtcagcctgggcatctctgcaaaaggctagatacaagtgagaactctacctcaagaactttccttttttcttccactattttcttctagcaaagaaaatgttgactagaggtgtcattattcaccagcccacctagtatgtcagggggagtcgccatcagcattcagatcccttctcattatatttattatctgtgccatccattttcttttgctcacttaccccaaagagcaaaagtcttacctagcctaagtatcccactcaactttcttttcttttctttttttttttttttgagacagggtcttgctctgtcacccaagctggagtgcagtggtgcaatcacagctcactgcagcctcgacatcctgggctcaagcactcctcccacctcagccttctgtgtagctgggacttacaggtgtgtaccaacatgccctggttaatttttaaaatttatagaaatggggtctcaccatgttgcccaggctggtctcaaactccagggctcaagcaatctttttgcctctgcctcccaaaggattataggtgtgagtcaatgcgcctggccccactcaactttcaagattactttccatgcaacagctgagagtgatggcagaacaccattttgagaactggctcccaggacaggtcctggcaatgttagaaaatgcacagctcatttttaggccctccagttcctttcatccatttgtcagctatttattgagctgtgggctatttattgagctggagggactcagagggaagacaacagcctcaaggttcctgccttcatgaacatattctctgtcctgctcactccttttggggcttattttctcctacttttgcttttagtggattttagattcagactctaccttccctttagtcaaaactctacgacaacaatctaataaactcatttcctctaaagattacattactcaggatccttcttctccaggagagattatattttaactgaaaataaagctttgttccatttgtcacgaccctcgtaatagcaatgaagaaggcattcctagcctctaggatgtcctatcatgtaggcagctaactatctcaccagcaagaaacgccaggagactttcggatcccagcctggggtgggggtaacgtactgataataaggacagctaccacttacttgagtatttctatgaataactcaatgtgccaacttctctgcttgtattattttattctaatttttgagaagccctaggagacacatgtactgatgttattcaacatcttttcacaaaagaaatcagaggcttatggagacaagtagaaaacttgaaggacaaattcaggagttgattttcttgaaaggggaaatactgctaaacataaattacaaatacgttttcagttccctttcatcagttatatagaacaactacatgctgggaatatctaatcagtttagcaggaacatgtgtttcaaaagggatggtaaattcatgtatctgtatctctaaacctttagagcttctatgtagaggtcataaaatgcttttcttaattagatttatgagtacatcacaatcaagatttgatttaatttcaggttttttgggccttttgaaagtagacatagataagcatcagatgattagtttagtttattacagttgcctccagagaaaatcctttatcttttataattcagctgtaacggcagaatatcaccatcatcacactaggcaacactcttttcttagagtaaatttaattacagaatcccagaaatgagaattaaagaagaatgtagaatgagatctgggtgaagacctcgaaggactgaaattcacagtaaccgtagattggagacacctgtttcaaatggtagaccttatttttgctttgctttgttttaacaacttaaactccttagattacctcacggtcatttcacagaagtccattataagaaatgaaaaaataataagtggactctgtagatttagccaaattctttctgatgggagcatattttgtctttcaacaagatgttcacataggaacacttctttttcttgatgtaagaaaacacggataatataaattaatctcggagaggaatgacagacaacagcttcataggtggcttgttccaatttttctatttgtctcttcctccccttggaaggcatccccatgatttaaaaggaaatacaatgtgtatcatttgctctaaaacgcatacctgtggttctgattctaagttgattttgaaaggatgggctttcccatcttcagatacttgtggagaccataagtgagtttctcccctggaaataaaataaaatttgtaaacttcaaattctaatggtactttcagttttagcatactttagtttcccattatgtttgtgaaaatactagcaaacctcactaacttatgcaaaaacaatttttttttttgctgattattctgtattttcccacataattagtcttccccccccctttttttttcttttaatgttgtctccctctgtcaaccaggctggagtgcagtggcaaaatcttgactcactgcaacctcctccttctgggtccaagcgattctcctccctcagcttcccgagtagctgggattacaggtgcccaccaccatgcctggctaatttttgtatttttagtagagacggggtttcaccagttggccaggctggtcatgaactctggacctcaagtgatccgcccagttcggcctcccaaagcgctaggattacaggcgggagccaccacacccggccgaagtcgtacatttttaatgtccttttgggtatggcagactagataaaaattgcctggagtacactgcacagtttctggaggaaggaggcctgcaaggcatgtgggaaacaggagagggagactctgcaggcacactctgcagatgaccaccaggcaagctccctagacctccctacttccctccagtcctactgaggccactgcagaagacagtgagtgatctgccaggtggatgtgttactggcatcaaggaaatgtgctttgtccaacccttctcatgcatctgcctgggacctagtggctcctaagggactgtgtgctcggcatgaacacaggttatgcatagagagtgaaagaatctatttcaccccaaggaaacggcagattggtggattgattgatccttctgtaccacagcacggaaaactgtgagtacaatcataacaggataaacacacactaacaaccactataacaaattattattatcatggttcagttttggatcagggatctgatggcaagagatcaggctcaatttcttagtgtttttggggggtggggtcagaaacatctcagtatttcacatgcccacgtgcatatgcactctcacacctgtaacattcttctgggctgaattctgtacaaaacagccaatggcagacaggatattagcaaccagttttaatataattacagtcaggcaagtcaagagattatttcaggggaatctctccattccattccattccattccattctctaccacactgagaacagtgatataactagttgtgttgttcagtgtttatgtggctaatagttctattttcatagttaattaaccgggttattactggaacaaattcttttagcctcttttattattctaacattccagagaatcctttttagaaatgatttgtcaacaactgctagattgactgactttagtaaagaattaagtagctaatatataaaaagtcagccaaaatactaggtctgtggccctccttgctgggaggatgaagttatttatagttctggttcaggttctcctgcaaaacagatcagatttaagcaccattagttaagaagcacctgtcaattttgagacacagctggtgagctgctgctttaatcctgtcctgcgcatcagcatgagtcatggactctgtcccaaagccgtcaatagccaggatgacatctccaggacacaggttggcagctgccgccttgcttcctggtgtaatctggaagaaatcatggcactatttaaaaaccaacatcccgcagtatcttgagttttgtgcctgacatttgtgtttcagcctggtaacattttaaatgtttaattgggcagaaagactgtaaatctaactaaagataactcttagttggtcagttgagttaggtctattttctcatcctgctgaatgattttgtttcttactaaccacatttcatatccttgtatctgttactctcttttaaaacatcttacataattcccagtgtgaatcatacatttttttgttttaaaaaattattttttatttttcatcacccagaagtctctatttgggaatagagttttactatatttaggcatcttttacattcaggttgaaactgctttcaatccaaatatagcaatccttactatttatcatctttaaaattcacgtaagaggcatgcaatggactttttatctccccccaaaactcaaatgttgaaatcctaaccacaatgtgatggtatttggaggagggacttttggggggtaattaggtcagaagtgaggagccctcatgaatgggattagtgcccttatgaaaaaggcctcagagagagctctcagctctcttgcctccaataaggaggaaacaataacaagtgaggtgtctgcaacccagaagagtttcctcaccagaacccaaccatgctggtatcctaaccttggatttccggtctccagaacagtgagaaataaatttatgttacttataagccacccagtctattgcactttgtttagaaatctgtagagactaacaagaagaggccagataatacacaaaattataacttctcttgaacccttcagagagctaaagtcacagggcaataaacttgaaatctaaggaaagacaggtgccttcaagcaaaggcaagacatgagcacaggctcacctgcatggagcagggcatggaggaagatggggctcccatactagctgttatgaagaattcagctaaaattattaacaaattgctaaagatccagtgtgagttaacatgagcgtacagaactcccggaaaccagagacaaaggaagtttgtattcactcatggtctcttctccacgaatgaaggacagatgaaaccaaactagcaagacagtagattttaattaaaccatagcagcaattacattaaatgtaaatcatctaaacacatcacttaaaaaacagagactatcaaactaggtgaagaagtgagatccaattttatgctgtccacatgtttttcaggggcaggaataaaagaaatacttaagaatacagaatatgggaaaaatatggtttcccataatttaaaatatttaaaaataggaagtttgtaattattactgttgaatattcagttaaagtcaatgattcttttgaccagtatacctactcccaatttttctgggcaaatcccaactatacacctctgtctagacctcacatgggtcttaccttgcctacttctctcatatcatcttacattattcctgctctccctcatccatggtgctgtggccattctgatttccttttagttcctcatgtaggccaagcttgtgccctttctgggggttctcatgcactcttatttctgcctgaaatgcttcccttactcttcactccttctcaacctttaggtctaggttcaaatgctgcactctcagaaagacttcgccaaacatctgaagtagcttctctagtcctcccctcatcatttttcaccattacatcctatttccttaatgaaagttatttgtacttttatgtttgtttatttactcgtgtattgtctgtcttcccaactagactggatgctcttgaggatatgtacaatatgatgtatatttttaatacttcacagtgtataccccagtatttagaataattgaagaatcaattaaaaagcatttgtcagagcttatataaaaaagaactagtccctatatacccaaagattatggcttttaatgtcaacttgtcattgctatgtttgtgagtttctattagagcagaacaatacatactactatcaaatctcaaactgctccaggaagaaactagattatttctaatgctttatttagggatcagtaattcatttgctttttctttatttgcttattctagctatctaattgcggttctaaggaagatacaagttcatctgaataaataaaaattgctaaaataataagttgtcttgtgtcctggatcttctgtctcattactaaaatgtttattgtactcactttatttctatgatcacctcactgtagctatcacaatgatttcccagtaggaacagttaatagaagctgggtgaagacaactggggattattatatcttagcctttgggaggcatttcatagccgttttccatttagaaacattctcagacccagaactgttagtagaacaaaagtttccatccccaaagtgacttgtaaggataaaaataatcttaaacttttaattttctctcatttgtcaaaatcagtattttctatttttaaatgtctaagactagaataattttctttgagttaaaacacagggccaggcatgatgcctcatgcctgtaatcccagtgctttgggaggctgaggtggaaggattgcttgaggctaggagtttgagaccagcctgggcaaaatagcaggaccctgtctctacaaaaaaatatatttttaaaaagctaggcataatggtgcacacctgtagtcccagctgctcaggaggctgagggaggaggactgcttgagcccaggagtttgaggccacagagagctatgattgcaccactgcacgccagcctgggcaacagaggtagacctcctcctctcaccaaaaacaaaacaaaacaaacaaacaaacaaacaaaacacacaagcaggtgtatctcaacatatttgcttttagagcctaacttagcttttctaatataccttaatagagttaagttatgtaatactcaattctgatttggaaaagtctaacttttcttttagctctggttaggatgagtgtaaggtgggatgagtgggggtttgtttctgcatgtgtccacactaattttaaacacacatctgaacaatagcttttcattatctaagtccaatatctattgatatctagagccatacccctgatattggacttagataatgaataactattggatatctaagttgaatatcttagatactgaatattactaaaatttactaacaatattaatactaaataataccatcttatacttatgcaaaatgttacatttgcaaagctccttctcacacgtttgaccattacaactctctaagacaggctggacaaggaaaactggctctggctttcagaggagaagaggtgtctaagtaacctgcggctttgctgctgagcagctgtacagctatgtcaccagctccttcagaagtcagctaggacaggtggttgatagtgatggccagatcccacttctcattttgtattcaacctggttattgctgtcctgagacctctaaggagacagttgatgagaaaaaggaaatagagagaggaatgagagagaaggagaaaacatgatgtctttactttttcctcgttttcaagttcagcgagcccagtgatcagaaaatgactgcgaaattggcctgattttactaagttaaacgatctgttttccctgcattactttatattattactttattgcattattatattctttccttattatattactttgtattagcatgcacagtttattactgttttcccaaattagaagagagagctgaaatgaggcatagtgtttgtcagcggattattttttatttaggttcattagggtctcaaatatcaaaagtaccagagagatcattgaacacggtactgcagtgaatcacttagcaccatgttttcaaacttgtgtgattataagaatcacctggggcccttgctgaacgttaaaggctccagtcctattccagatgctcggaatcaggaacagaatctctaggagaggagccagggaatttatgctttcaacaagcgcctcagatgatttctgttattcacatcaacttatattacttggatctgttggggaaaaaaaagctaactgaaaacacagataaagcatctataatgtcctatttatgtggagacgtaaggcaagcccaagacatggtcctgagatgatgtttctgttaataaaaacgactgaaatagttatggagcaagacaagcacacactgaagcactgcacggtaggcacggaccaaaatcatgagaaaccccattgttcattctccatccctagcaaatagactccgcgtgcctccttggcatccacagccctgcagcacctgcctgccaaagacatttctagagccacaccccacaccggttatattagaatctctgcatgcacctgggcatggctgtgttcagaagtcacatgggcggctttaacatgctgccagggctgggaaccatcaccgtattactattgagaactattatctcacataattcttaagacaatcttacaacatagttatctcttttttaaaatgagaaaatggatgcttggaaagtataagaagcttggttagggtcccacatcccgagaaaacctgaaattcccatctgggtccgcctcgctctatagctcagaatcttctatcatctcgcattgcctctcctgcaggtaatctttccttcaacacctcctagctctttgaccatacttttcttgtggaattctggataggttgtgtgatggcagttcatatacatgttcctttttttctgctgatatattatcttctcaggggttagaagcccatctaagccacagttatatgcccacagtgtctttcacatacgagacattctgcacacagtagatgcttgtgggatgtatgagttacacatgaaccagtacttccacgtagacacggtctgtgttagaacaaaattgaacaggtttttatttacatcaacctttccactacatttgtgttttaccctggaaaagaattgcattccattgcaaacagtcctttctaaaagtttaaacttcaaatgtagtttatattacatgaaatttcaaaagtagtttatgttaaagtcatacactgttctatcttaaagcctgtacaaattaggaacacactaactttttctatattggtactcaagctcatatagcattctcagttataataatcttgatcttggatgtgctctgcataggaaggagggaggagtgaagagggggaagacattttagtgagaaaagacacactggcatcagatatagacaatcattttatatcatgtacacaaaagaagcttgccctgtacactagcctccccttattcacggttttattttctgcagtttcagttatccgagaccaactgcagcctacaaatagtaattggaatatttgagaagtaaacaactcataagtgttaaattgcagctgtgctgagtagcgcgatgaagtcttactctgtcccacctgggtcatggatcatccctttgtccagcgtatccaccttgtctatgctgcactcttcacctgtaaatcacttcgaagtcttagttatcagatcggctgtcacagtattgcagtgcttgggttcaagcaacccttatttcacttaataatggccccaaagtgcaagagcgctgtgcccaagttataaattaaactttatcataggtatgcatgcatagaaacacacacacacacacacacatacacacacacacacacacacacacacgtatatatatatagggtttggtactaatgtaggttttaggcaaccattgggggtcttggaatgtgtcccctgtggatgagaggggattactatattccatattgaaatcttgtcaaagcaaacgatttgcaacttgtctgtgagagtagatctagcttctggatggtccaaaaacttagactctttagaagcttcttataaaaagaaaagatgctcacttgaagaagtgaaccttcaaattcttctgtgaaatgcttaggccagttatacacggtgtttaacaactccctcccctaaactgaacatccaaaactgaaattttatattgcacaaggtctatcacacttattgcctagaaactgctttcctaaaaattgtgtttatcacaaccagttgctaaaaatttgttttgagaatgtctggtgtttgatttaccttacttttgatttttttataatacaaagattcatctggctatttggattgtaaacaattacgggcatgagggccctgtgtcctaattttgtgaactgtaatttcaattgatggaggcagtcatatttgtcactctcctacaaactctggttggagccccattgtctagcagtattgctgtcgtctgtatttgtatagtgtgaggcggggagtgaagggtatagcttgtaggaggacaaaagctgatttaatggggactcgattaaacacatctcgtttatgggactttttgtggctttaagtgtagatattggtatttcaattctttgtatattaagaacttatttaaaactgacacatcagccaggcgtggtggctcacgactgtaatcactttgggaagctgaggtgggcggatcgcctgaggtcaggagtttgagagtagcctggccaacatggtgaaaccctatctctactaaaaaaaaaaaaaaaaaaaaaattagctgggtatggtggcgggtgcttgtagtcccagctacttggaaggctgaggcaggagaatcgcttgaacccaggaggcagaggttgcagtgaggcgagatcgcgccactgcactccagcctgggagacagagcgagactctgtctcaacaaaacaaaacaaaaacatgacaaatcaactcacaataaaacaattctcacttatctttttgtgaaatatttttgagaacacattctatacctatttataataaagtcatgtaaaaagggaacaatctagtcaatcattcataccgtgtctatatttattctacaacacatatgctctactaggcactgtgctaggccctgaatggcccccagattagaaggtttctgccttcggggaatgtgcaatctggtgggatacagatgcagtggaacatctggtacaggcatgacataaggaggggttatacaggccgaaagctacagtaatcaaccggatgagatggttgttactgaaagaaggcttggggagaggcatttgagtggtttccacaggcacagaggacagtggtgtggtgtggggaaaaatggtatcaggagcaaagacacgtcagggaaatcgtaagtagtccagagggcggtaccactgcctacgtgtggaacaaggggaggaaagggagagacaacaaagggagaggaaagaaatgaagttagcaactcaaattgggataggagatggtgaaaagtcatgaatgttgtgcaaagacacgcatttcactctctacaaacaagtgatgccgctgaaggatttttaagaatgagaaaggagcaatttggcattttccagagacggtaagaatatgctgtgtgaattggacgggggagccaaatgtctaggcgtggagctaggaaatcttgaagagggacagtagtagaaaaaatggaaagtggcagatgttgaagacagcatcaataaggccagtgatgaacaggatggcacaaaacaactctttagaaatattggaacaggtgtccattttcacatgtggccttcagaatgcaggctttggaggcacacagacctagcgtcagagcctgtcccactgcttgtgatcatcggcgggttaataaatcttttgaagcctcattctcctcatttgcaaaaggggatgtcactactgctactctcctaaagattattgtgagatttcagtgagttcgtgcacataaaaggttcccatcaatgcctggcaagcaagagagtacaataacacacttacaacctcacacactgcctttcaaaatggtgttaaaatgttaaaagcagtacaacaattcaccatttaacaatactgatagttatttttctgtaatacttttctgtaatactttttattcttttccttaacaaatttcaatattcttatcatttcagtgaaaatattctgaattaggtgttcactaaagcataaaagttcttattgaataaataaatgttcttatttattcaataagaatctactatatacctggctttggggacacttgggatacaaaaatgatttggttttacctgctgtcctagaattaattaaagagaaaagccataatcaagtgaaatcatatttggtcataaactgttattgaaccaaatgtcaaaaatgagtgatacaaattagttatgagttaggaattccagatagaattggtttccctaataataactgccattatatcaaatatatttaccaatagctattgtagtccaactctggaatgtaagtactgctttaaaataaacatttataatgtcaacaactcaaaatttcaagcatatgattaattatattgacatacgattatactataatagcaaaatatttcttttataaacaccttaaaagttttcgtgacaaaattattttggttagaatttaatataaatatgatttattctgtgttaggattcaaaagcttattcaatttaaataaaaaccatactccagaaactaaaacatttcttagtagatataacggaaactgtttttgttggtaaatctataataggaattgcttggcccaggtcactgaagcattttctgcttactttacttaggaacgtttttgggggtatgttgaacagttttcatgtttcatataaaaacacgtcagatgtgtttatatgtttttgaaaaatgtaaaacaaggcttgaaacgttccattgtatgcgtctgtaggatacacattttgacatatttttaaaaggatgttggttcccaaatctcataggcatatataaataaaacagaatttaaaaggtattaccttgttcaaaatctgtatgagcagatcaatcagattataacacatacaattataaaatatggcatgagaagaatacaagaaaataaagtataatactctgcaactaaaagtataatattctggaagtttacgcctttaggtattaaatgttttatatgtgataactgaaataatacattaattttctatgaagaaaaacattgtgttagaaaaaaaccagctagaccaaataatgctttagaattaattctacaaatttactgacaggagagaaaccctgaggttttatttttaccttgttttctcattagacagtagagaacaccaagtaaagcttgactttgacattaaagcattattttccgttttaggctgagtggtttactttgcatcaggtaaactaaactgtctgccacgttttctttgtagctagagttagaagttggtaattcctaagccaagttctcagctttggaaaacgtgctcaaaatgcctggaaactgaggagtgagcattaggaagacttcccctgtctgggctgataggagcggctccagtttggccaacgcaggtcgtgccccgcgaacagcgcgctgctgaacttttcatccggacgagaaaaacgctcagatgcgcgccagctccagggaatgccggggggtgccagtccctcgcctctcccacccgggacccatcatttgttacggaagggcgatggggtgtgttttatttctgttatcacatataaaacatttaaaacctaaaggggaggaggcactcgagcctggcagcctcgccttccctgagcccagtggctctcctcggaaagtcgctgcggacccagaggatgggacacctttagagcggactttgtcaaatctctgagccgctccgcagccacttgacggagttgccgccgcccccggagctgggcgccgaagcccgggagccagcagcgccccgtccgcccgccctcgcgcgctttctggccgccctcggccccggggcatccactgcgtccccccggacgccgccggagtccccacctcgcagcaaaagcaagaatgccgacacctaccctggtgatgaccaaaggctggttgaagtctatgccccctgagagcctgaagccccagggcgcagggcccgggaggatcaccgtctggggcatgccgccttcctcccgcccaccgggctctaagtgtccccgcgcagggcagccactccgcgccgggcggcgtcctggccccgacccgggcgggggcgctttatccccgctgggggtgacgtcaccg

SEQ ID NO: 1737 - DNA, 34899 bp, Homo sapiens; identical to SEQ ID NO: 1736

SEQ ID NO: 1738 - DNA, 34899 bp, Homo sapiens; identical to SEQ ID NO: 1736

SEQ ID NO: 1739 - DNA, 34899 bp, Homo sapiens; identical to SEQ ID NO: 1736

SEQ ID NO: 1740 - DNA, 34899 bp, Homo sapiens; identical to SEQ ID NO: 1736

SEQ ID NO: 1741 - DNA, 29306 bp, Homo sapiens
accaaatttgaatgttaatatatttccaaaataatctggacagcaaacagagtcttgaaatgccatctcaaacattctttagaaaattgttaggagggcaaaaagtccataaagtatggcacaagggtaggcaacaagaagctgctgtccttccatgtgcaaggctgcaatgaagatcttggaagctgagagactacaccagccaatgatgaccagggatgacatgattccaaagatgcccctgcagcaaagacaaagaaatgattgcctgtgccagtagaaaagagattattgagttaaagttgcctctgaaatatccttggcacaatatttataactactttcccgagtggtaaaatgaaaatgataaaatatatgaacaaaagcccttggccagttaggcattttttagtcaaattcattacagagactaaatattttatatttctgttaaacctgaattagaaaaaaacagtagaagtcacctgcagtcactctgttctcatctgtcaatattcaaatcctaactcctaaaattcccttaaatacagcattgagagccttcacttccttatagctacagatttccttttccctactttcctcaaaaattggccaacagcgtaggagaaagatagacagagttacattccagtggggtgcctagttcccactacttccagatctacttttcaggtttttgtcggacgtcacaaaaagcctgacacagctcaagtaaggaacacatgggacaggaaagcacatatgtgtgtggcttcccacctcatccttgaagttccattttgtatatttttagaatgctgaaatagatttgttcaaccggtgtcttcaaaaagtaactgtggaggcaagtgagcaaataagatagttaagtctagtcacttggagagtaataaggcaggaagggtggtcgagagtgaatttcctttcttatgtgctaaatagaatgcattatttagaaaaataagacataagagctgggagaaatctcaggagatgtctactgcccagttttaaagcataaagtgatgataaaaattgcatggcaaagtggacaataggtcaagatctctcctagcatagtactcttttcaccaccaaactaaactgccttacttgatcttggtttgacactgaagttgggaattatgtttattatttgtgaaaatgatagaaatatctgcttctaataattgaaccaaagcaaaacaagtgaaaagctccacagtatagcttctaatgcctcagaccattaataaaacaaacatatttttaaaacaccaaataagtactacatttattgatttaaataaaacctattagggataatttctagagttgtttaatgtactgtattcttagtaatggtcttgagttgcacatactaattgcctaaattaaggaagaaaaaagaaaaaaacatattgactgagcatgtatgatataaagttctccaacattaatatcctcatcagggttcctgggaattctacgtggcaaagagcccagctgagaaagaatagttgttttcagcccagaaggcagagtgcctgaaagctgaagcaatttatcagtgttcaccaggcacttactcttccaaaatcaaacaagtgaagttcctgtagttcttattttacacatgacaatagttcacattgaaaaatctgacaacttaaaaagtgccagtttttttttctctctctctttttttttttttttttattttgaggtggagtttcactcttgttgcccaggctggagtgcagtggtgcgatctcggctcactgcaacctccgcctctgggttcaagcgattctcctgcctcagcctcccgagtagatgggattacaggcctgcgccaccatgcctggctaattttgtatttttagtagagatggggtttctccacgctggttaggctggtctcgaactcccgacctcaggtgattcgcccacctcggcctcccaaagtgctgggattacaagcatgagccactgcgcctggccaaaaagtgtcagttttaaagataacttggattaatttattttttaagtaattgaagtaagaacagcacctgggccaaaactaacctacttttcttaatctatgagtagcttttaatagccatggttttcccagttccactaccaaaacaatcaggaagggctcaactttttcatggctgtggcaaaccttggctatgattgtgcatgtggggtcattgagagcacacagacacttactgcagtgaaaagaacatggcgcaaccagacaggatgaccatggggagcaggcagtaacccagcacgctggccacacagccgtacgacacccctgaagagctcatcaggttcagcaaggcatgaatcacaaggcagccaatggcactcatgccatacacataaccaaactgaacttttcctgcctgaaacgacgtgaagaaaaaacagtttgaacacacaatggacaccgagaggaaatctgaatatcatgaagcagagagcatcttagagtcagttcagtgctgttccatgtctttgtaggactgtcatcaggagactggaagttctgggaaaaacatggccaatggtttgaattcagattctgaaaacaaacacttctgactagagttaggatgggataagcgtgctacaaaaaagattgaatatttctagacttatattttttactctaaattgtccattacgagtacaaggcataagtaagactatattttgttcccatatttattaaacaaataagtgattgaacagaggaataaaaaatccaattttagtcttggagatttacaaggcatattagtaaaattagcaaacacctacagggtttaccatgtcagatcccattctaagtgtgctacatatatttatgtaatccacataacaaccttatgaaatcagtatcattattacaccaactttacacatgaggaaactgaggtgcagagatgataagtaccttgcccaaggtaatataacgctaagcaatggaggttggcttttaacctaggtatttcagctctaaaatttaggtcctgaacatcaacgggaactcttacaagtcctatcccaaaataatggcacatatttaaccctatttaatttagcatttagttgaccacagaatccttttatgtttcatgatacctattgccaggttgattaaccacaccttatgaaaaggtgatttatataaactaactggtaatgaattataaaaggtgtactgtcaaaggaagttagtagtgttcggagtacactaccaatcttctgaggaaaactcataaaaacagccattgctcataaagctagtgttttgtgaatacaagccccaataaattcattcagagaactattacttcagaagtaagtactattacttacagcgtaccattacttcagaagaggatattttaatgtttgctatctgagaataccaaagctacagttaaaaaaattcattaattttttatatttacattatgctgatcataacttctagataaaagttgaataggctgtctctggttttcatgggaattagacaaaaacaatgaaggatctgataaattgattcaggagagaaggagctttttagctgccacttttccttctccatgctattatctatgaagtattttagagatatttattttacaattaatcagggtaatggagaatgtcatagctattttaatgttcaaaattgtttacctattctgaattcttcttcctctgcagttggagagttgatcactacgaagtcctttcataaatattcctgacttttgctggcagaattgtctccagcattagccactgataaattcttatgataccttctgtatgcttgtgactatttaatgaaataatgctaatgatggacatgctaacagaaatacatcagctatccactgctttattgggtgagtttgctccacttgcaaaatagtgacaatttcacatcattgtcatgcattagagaaaccatctacttaatattttacttggatgggataaatctgaggtagggctagtcctaatggtataggacaactctcttacacccaaaggacatctaactggaccttcctgtcctgaaaaggcagttctacaaatggagtggggcaaatagggagtagatgaagctaatttggtagtaaagttgtgtcttttcatggcagttatgtgcttctctcatcatgtctttctcttgttagtttgtcccgtttaagttgtaattccatttagccgaaatcacggccattttaaaaaagtgtttcaaattctaacaagggcttataattgaaatagaaaataaatgttctatttttttaacctcaaaatttttaaggatcctccctattccatcctcattagcacatcttttttttttttttttttttttttttttttgtgatggagtctcgctctttcgcccaggccggagggcagtggtgctaactcggctcactgcaagctccacctcctgggttcattccattctcctgcttcagcctcccgcgtagctgggactacaggtgcctgccaccacacctggctaattttctgtattttttttttttagtacagacggggtttcactgtattagccaggatggtctcgatctcctgagctcgtgatccgcccgcctcggcctcccaaagtgctgggattacaggcatgagccaccgcaccaggccccacatcttgatttaaaatacttagtgttcttctgattgcacttttatattggccatgcatattgctttttcagaccacactcttggccctaccagaaaagttacatggagcaaaagttttaaaccatttgtcttcttggtgttggaaaagaaaataattttggggaaaagaataagtaaaactaaatttgtgctaagtgcttgaagttgttttctttggtttgtctcctttcgcctgaagaaagcctactgaaagaattgtgtcttatgtcaacataaatcttaaaggaggaagagtatgtgactatgactcttatgtctccagagataataagcagatttggatattgattctggatttagttttgctttctctagtaaaattcctgtgtcagccggtaaaatcactcttacattttaattctacatatccaggaaagaattaacctataatcaaatgaattctgagttaaatcatacttcaagtaatattcaattggagtttttggggagtcctttttgctttatatcagaatcaatttggaagttatcacatctaatggtaaactttcaagtgataatgtttgcataaagacattcagaaaatacgtattttcacatattctccacaattttagaattaaatagaacctgaagagccactcaaataaacttttgccttgaagaaaatgaaatgaaagcctagaaatatgaagccaagggttaaagattacagcaagtggcaaagctagggtagatccaattttctcgcttccagttaagaattttttgcctctattgctttgtatttaaaatataagaagggttatgtaaataactccaactaacattatgcatccaagagagatcataatggaattgatgctgttctttaagggatagtaacagtaatattctgccacagaaccaacagctgctttattacaaatgacttgtaaagaaagatgagttaatatattaaattgattgtttctgactatttgattaattgacatggccttacttagcagttaatctaagattatcaaattactgtgacaaagacagaagaagggaggttagagactaaattaaaactctagttgatatagtgtttgatttacagagtatttgcatttgctgtagtaccaagaaataagatgttatcgctaaatactattgtattggatgaatatgacattattggccatattgcctacagaaactagattgctatcagtattttgattgattatatacaataattgaaaagcagaattttatttagttgcaaatgcattttacaactacttttgaaaattgtatatccattggaagaaattattattatggaacatgaagagcaggaaaatggggaagagggctaaatagttattgtaagagcttttcctataatgtttaatttcccatattatttcctctgcctggtttatctctttgtgtcttaatgaaactatacttttcagactgacttaaccatctttatcattttctgtttttaatgtattgccacctcctccttggtataaagtcagagacattttctcatttttttcttctgcctttttttcttaatgaaacattttcctaaactatgagctagaatgtcttttaaactttacttaggtggaagtacatttttctttacttttctagtgacccttaatatcattacttccagatataaagaatgaaagcatacataagacatatagtgaagtcagggaacaaatgtcttcataaaaggtggaaaactaacattttagaggaaatatgtaggttgagtaaacaaaacataggttgtcattgcaaattaatttttcatagtagcctaacccaaaacaaggagatctgtctcgtacctcataagatgttagaaatagtctggagatatatcacagcaaagaagatggtgaccaaagagaagtgacttcttcagtgtcacaatagaactctcacaaaataacaaaaaataaaatgtaggccttatatctcccaaatctatgttttccttccattattccagatttacagtcttttcttaataacaaaaaagacataaatgatctcctgctttgatctgcttcttgatttttgaaattctatttaaatttatactttttagctgttgcaatgcataatggtagcatatttttgtcactatggttaaattattctctctcacttaaaaaattcactatgtaaggtgacacagtttctcttatatttatacagattgcttcaaagccagcactggaaaggacaagcattaaaatctggtgcttcctgtgacacattaccagaagcaaggtggctcccagggctacgcaaaaaagaatgggtccagtgaggtccgtttcattcataatgctgccatctactggcttcattgggtttaacactgtcaaagttttttgccatatgtgatcaaaatggattccaagttctgtaaaaaggaaaaaagataaataatatgataacataaatatagaaaaataaaaataagttacactctttaaaggttaacatatctgattaatttacttagcattttaatctgattgttctatcataccttctaaagttctatgttctgtattacacagaaactcaagttctatgtaacatataataatcttaaaaaacaaactaaaaaataatttggcttccaaagaatgacttaaaataaatatattagagaaacatttccatcaaggaaaacattccctgatttatgcagcaaatacaagctttaaatctaattgaaaattgggaagttggcaatatacagtaaaaaataaaattgtagctaacagatcaaaactttcatcctattgtccatctagatatttccttttcctgcattttctgtttcttttttatttctttttcgaggcagggtttccctctgtcacccatgctggagtgcagtggcacgatctcagctcctccgcctcctgggttcaagcaatcctcctggctcagcctcttgagtagctgagactataggcatgcaccaccacacctggttaatcttttttcttccatagtggcgaggtctcactatgttgcccaggctggtctagagctcctgggctccagggagcctcctgcctcggcctcccaaagtgctgggattacagaccttagccaccacacctggcccttttcctgtattttcaattgctgacacttctgaaatcctgtcatattggccatggcataatttttcaattagcagtactataatgaactaatgagacttagtccaagtctgggtttttacttccactatgcctaatgagaagagcaattttatgctaaatgcttgaaactacacagaggggaaaagggctctttctgtaagtaaaagtgatcatgatgtgcatgcatatttttgtaaggtcaatgtactgtgaagttgagtctatgcattcaaagattaaattcttgagacgagttaacctttctcttttatacatggtagtattcaaataaaatatccaaaatcaatgaggttcagtgttcatgagtccaaatccatttagaaacttctgattttttttctccaattcccatttttaaaatacttctgactgctgcctcataggtccttctgctagaatctgcttctcttattactataaagcaaatacttagccatttgacatcccctgaacatagaaataaatatcgataccagatcagtttcttttctcaccgcttctgtagagatgaactaagatgtatctagggtagagaaagcgaatattcaaagagaagagtatgacttgactatttagggaccagcaatcaaattggttatcctccttctataatttcagaatatcagtaagggtgaggtggaggctaggaagaatgaaagctaaaatttactgagtgtttgctatggactccacaagatttacatacatcggtcttataaatacacaatcaatcagttactattattttatccctactttatgcatcagatatataaggctttgacagattaatttgtctgaagacacaaagcagtagtagaaaacttgggtttcaatgctgcacaatctgactcaagaaagcacatgtttaaccatagatttgtggtcaggtcaatgttcatctactctcataatggttgtattttgtttttaaatgagcccaattcttccatgtgaaggactgtcttcctaaatgtatttatatgtggcactcaaccacccttccaagctttagtaaccctgtttggtcagatacaggggtatagctcaacttattttacagaggcacgtatcatctaaataccttgaaaagttgacttttctgtacacagactacaacatggacttctaataatccctatgacacagaggacccttattctaacaactcagaaactttcagagggtcagctagacactggtctaaaccaaaaaataaagttctactcatttcatgcccagaatgacatctgttattttaagcttgaaaaaaaattgaatgtaaattaatagcaaataatttacatttctgcttccttgtttcatccttgatttgcacagtgcaattatatatttattaatgaacgtatgctttgaagaatatgagcagttcaccaagcttaaaaggaggttagaatgtctaacgtaatttttgaaagagaagaagactttaaaaattgagacatactacatattttaaattaattaattttaaattaatttcaccagaaatttatgcgctcaaactttattttttaattttggcatgtatgctaaaaatatgttttcagtatttaccacaataaaatggtatttaattccaaataccttttcctcagaaaatataattagtttggaagaaattcagatgaaaatgcttcacacgacatcacactgatgtcaaccatgtatttaatggcataactaactcctgctcatattttaacgtcaaaccatgaggcagtaaatgaacataagcccatacaaatattttcataataataaagattgtatgtgctttctactgaaatagatctctataatattgtggtttttatttattataaggtatgtgagtgattataactattaattgtagatactctaatataacatcttattgtacaaaataaaagaagataaaactgctgtgaaattttaatgcaaaatttattgttttgctgtcatctagtggtagtaaagtatatgatacatatgctataaaagtgaattaagatccctactttctacgcaaattgtggcattggcctttcatatggaagtctcgagctacgctataaatacaaaataccaaatatcagtaatttttcgtatctgacagacttgaatttattattattcttgaaaatgcatttgttaacatattgattttacattaacaaagagcaaaatttatcattcttacataaaaccaaacaaatattttagacaacaaaatatttaagaaataaagtaggacacttttgaaacaacacatttttgtgcatagtattatagcttcataattttataggccattctgttggattgtcaataaaaactagtaaatgttatttaatgcgttatcctagaaattgtattttttttatatctgaaaaagacataccctggcctttttcatatctttagacaaaagaggcttgaggctttcacaagtcactcagcttgaagaacacattggatccaaaatccagatatttcatagattcaaagcacaaaattatattaggtactctatcttctaatacaggtgtccccaatccccgggccgtggacccatatctacctgcccatggcctgttaggaaccgggccgcacagcaggaggtggaggtgagcagtgggcagtgggcgaacaagtattatcaccttagctccgcctcctgccagatgagctgcattagtttctcataggagcgtgaaccctattatgaactgtgcatgcaaaggatctaggctgcacgcttgttatgagaatctaactaatgcctgatgatctgaagtggaagagtttcatctcaaaatcatctccccaacctggctgtggaaaaattgtcttccacaaaactgttccctggtgccaaaaaggttggggactgctgttctaatacactatgtattttggggaaattaactctgagctgtataaaatggaaataaaaatctattacatattttctattcaaattgaaagacatgttagaggaggatgtatagaaagtggtaaattaatgcaacaatagagacatttcagatagtagaaaagattactttcaacaaatgctgcaggaaaaaaattagttaagcagcacagaaaaaataaataaatccttacttcacatattaagcttaaacaactattgaataaaaaatttcaatataaaacaaaaaacataaaaggataattttaaaatgtgagcatctataaggagatagaggcagtacttagagctggagaaatagactctaaacaaagaacaattggaaagaaatgttactagaaaagatatgctgggtttaaaaaattaatatcacatttttaatatgtcccaaagacccataaacaaattaggtggcaaacacaagctaggaaaaaaaaagtttaaaatgcacattctaggcaataattaatatggttactatataaaatccctaaaaaataaacgaggaaagaaaactctttagattctatagaaatctgaacaaaaaaacccatgaaaaataaaaagtcaatacatatatgagaaatgtcaaaatttttttagtaacccagaggtacaaagtattcctttttccttttttcctacaaaattgacaaagacatgtcatattctactctggaagtggagtagaacaccatttttgagatcagttgacagtgtcagtacctttaacccagcaatcccactgttatgggtacatcctaaggacagactctataaaggtcaaagatggtttcctatgatggtcaacaaagcattacttgctataaggaataacctttaaggcgtgtttaaattacggttatgttatatgatagaactctgtgaaaccattataaattgttttcaaataatatttaatgactttaaagaatgcttgcatagaagtgctcgtgacaggctgggcacagtggctcatgcccgtaatcccagcattttgggaggctgaagcgggtggatcacccaaagtcaggaggtcgagactagccttgacaacatggcaaagccctgtctctactaaaaacacaaaaattagccatgcacggtggtgtgcacctgtagtctcaactactcaggaggctgagggggaggatcgcttgaacccgggaggcagaggttgcagagagctgagattgggccactgcactccagcctcggcaacagagtaagactccatctcaaaaagaaaaaaaatactcgtgacataaagtaaataaaaagaatataatacttaagtactcagatgcatatatattcattgaaaaaatagtattttactttaaagtatgcatgtatattcatacataatacatatacacaggcatttataggaaaatagaataaaggctagaagaaaatacatcaaattgttaatgatagtcatgtctttgagacaagaattgaagtaatttttatatttttattcttatgtttctatgttttccaaattctgaagacaattagggagagatattggcaaagtcaaggaaaatgtttaacaagaataacttgtaacttctaggtgtttattacttgtagaggcaaaactgaatgaactggttaaagataactgatccagaaacttgactggcttctaaagagccaatagatcgattatataaatctctgttctgttctgaacagtttaaatctttcatgtttttatatttttaaggaaaagaaagaagaatgtggctggttgtgttcatgtgaggcaaacacctttacatcttgtgatgtaaaatactggaaattttaatctattccttttcacttgactacatgcaaaggacttggagtagttaaccagtgactatttctgcttggttctccaatttaaatccacttgggttttagcgtcttaacgcctatgtttccagcattgtattaacattgtttaagagcaaaaacagcacatacagactggctacatatgaaaaaaaaaaatcaatggatggaacaactccgaaatcccctaagtaccttcagttccaagaatgtctggatttccttcccaccagcagcattatttactggatttatgttcttcctcacctacccatgccaagctgatatgaaagggcttgtatgagtcaggaaagaaaaaaaactggcttgtctccatgtcaacaatgacaacaaaaaatattaatttgagaaaatatccactttgctcccaggaaaacatagcagaaaataaaatacgctgttatgaagtgcttcattaacagggtgggaagggtggtcactttgatgtaactactctgccaaaagatgtcttcatttttttctattcttggccaaggagttcgaatttaagaaagagtgaaggagcatttaataggtgcagcaatatcacagaatatctcatatctgcacccaatttcccctatgcaaacatgcaacaaacttccaatggtttaagggttttggttcagcaaactcttgttatatgtgaaacaatcaaacataagacactgtacactgcaggctgacagcacacattaagtgctaattattgctattattcttctagctgtacacacattaataacacttccttaacttatcttctagcaaaggaggctcttcatcaaaactgtcaatgtaaggagattgtgaataataatctgagttggatgctggctgaaaaaattgtcctgcgtaacccgatgacatgagcatctctgatggaacaaaggaggcaggctgaggctgctcaccagcttgttgtctagaaaaagaaaaatacaaacatttacatgtctaagaaaaaggtatcatgacaaaggaggaaaattacaattttacttacatgaattcatgtagtttttatgagtatttactcatgaaagaaacaacttacttaaaatttaactttagtccaaaaatgtaaaataactggtcatctaaagccttctagaaaaataatccacgccaataaacattaattgagcatggacaacatgctgaatgcttcccctaatcttttctcagttaaaactctataaggtaaaagctgtatttctaatcccattttacagaaaaagacatagaatttcacagagactaaacgacttgtccagtaacacaaaataacattgcaggtgctggactctggtgtgaagctttctgagcagtgatctgctcgccacacactgatgctttttaacttatcttcagggacagtctccagccatgaagcccctccaaatatgtggaagcagccaggaaaaaatataattttaatagtatagtcaactgataggaaaaataaatacatacactaattgctgtgcataaggaaatacacttcagttgtagccattccaagacagtcattgccagtagaattgtctctgagttcctagctaaatgtattatctagttggctttagtgtctctttattttatttgtacaaatttatggggtacgtataaaattttgttacatgcatagattgtgtagtggtcaaattagagcttttagggtatccaaaacccaaataacattcattatatgcattaactaatttatcatcactcctctcctaccccctcacccttccaagtatcaattgccaatgattctactctctacttccatgtgtacgtatttttagcacgtttatgagtaaaaacatgtgatatttgattttctgtgcctggtttgtttcacttaagatagtgatttccatttccatctatattgttgtaaataacatgattttattcttttcatggctgaatggtatttcattgtatatataccacattttctttattcattcatccattggtggatactaggttaatttcatatctttgctattgtgagtagtgcttcaataaacatatgagtgcaggtatctttttgatatattgacttcttttcctttggatatatacccagtagtgggattgcttgataaaatagtcattctatttttagttctttgagaaatcttcatactgttttccatagaggctaataatttacattcccaccaacagtgtgtaagagttcccttttctctacatcctcatcaacatctgttactttttgtcattttaataagagccattctgactgggggaagatgatatctcactgttgttttaattttcatttctctgatgattagtgatgttgagcattgtttcatatacttgttggccattcgtatgtcttcttttgaaaaatgtctattcatattcttgcccacttttttcttttttaaaaaaattttgtatttccataggttttgggggaacaggtggtatttggttacatgagtaagttctttactggtgatttatgagattttggtgtacccatcacctgagaagtatacactgaacccaatttgtagtcttctattcctcacacccctcccatcctttctctcgagtccccaaagcccattgtattattcttatgcccttgcattctcatagcttagctcctacttataagagagaacatacaatgtttggttttccattcttgagttacttcacttagaataatagtctccagttccatctaggttgctgcaaatgccattaactcgttcctttttatggctgaatagtattcaaaagtgactaatatccagaatccacaaggaactcaaacaaattatcaagaaaaaaattcccatcaaaaagtggggtaaggacataaacagacaattctcaaaagaagatatataaatggccaagaaacgtgaaaaaatgctcaacgtcaccaataatcagggaaatgcaaatcaaaaccatgatgcgataccaccttactccttgcccacttttcaatgggattgtttcagggttttttggctgttgagtttcaggatttttttttttttttttttggctgtttgttggctgtttttattgccgattcaatcttgaatcattattggctgggggccaaagccagatggagctggactaggcaagcttgcactcaggcccgccagtcatgagtgcatgtaccagccatgacaggtgagggcaaaacagtccatcaaaaagtaggctaaggacataaacacaattctcaaaagaagatatacaaatgaccaacaaacatatgaaaaaatgctcagcatcactaatgatcagggaaatgcaaatcaaaaccatgatgcaataccaccttactccttgtccactttttaatgggattgtttcagggtttttggctgttgaattcagttccttgtatatctggtttttagtcccctgtcaaatgaatattctccaaatattttctcccattctactggctgtctctttactctgttgattatttcttttgctgtgcagaagtttttaattaaatcccatttgtctatttttgtttttgtttcctatgcttttgaggtcttagtcataaattctttgcctagaccagtgtccaaaagttttccctatgttttattcaagcatttttatagtttaaggttttatgtttaagtctttaatccatcttgagtttatttttgtatatggtgggagatagaggtccagtttaattcttctgcaaatggcaatccaattgtcccagcaccatttattgaaaagagtgtcctttttccaacttatgttgttgtcagctttgtcaatgactagttagctataaatatgtgaccttatttacatgttttctattatgttccattgatctatatgtctatttttatagcagtaccatgctgttctggttactatagccttgtaatataatttcaggtcaggtaatgagatgcctccaggtttgttcatttttctcagaattgctttggctattcaggcttttttctccttctgtatgaattttaggatagtttttttctaattctgttaaaaaatgctgctggtattttgatagtgattgcattgaatctatagattgctttgggccttatggtcatttaaacaatattaattctttcaatccatgagcatgagatgtttttccatttgtttgtgtcatgcacaatattttttcatcattgtttgtcattttccttgtagatatctttcacctccttggctaataaatgtattcctaaattttgcttgtaattattgtaaatgagattgccctcttgatttctttctcagctagacagttattgctgtatagaaatgctactgattttgtatgttgattttatatatgtatgtattttatacatatgtattttatatatgtatgttgaattcatttattaactctaagaggttttggtgaattctttaggtttttctagaaataagatcatatcatccaattaccaatttggatggcttttatttttctctcttgcctgatttctctagataagatttccactactatgttgaacaggaatggtgagagtgagcattcttgtcttgtttcattttttcttagaaaaaaatgctttcaacttttcacattcagcatgatgttatctgtggatttgtcctaaatagactttattattttgaggtacatttcttatattcctagtttgttgagggtttttattatgaaaggatgttgaattttatcaaatgcttttctgcatccattgagataatcatatgttttttgtccttggctctgtttatgtgatttatcacatttattgctttacatgtattaaatcatcctttcatcccttgtataaaacctactaaatcatggcatattattttttgatgtgctgttgcatttggtttgctagtattttgttgaggatatttgcatctatgttcatcagaactattggtctagtttttgttgttgttgtgtccttgtctggttttggtatcaggtgttactggccttgtagaatgacttagagaaaactccctccatctgaatttttgggaacagtttcaagaggattagtattatttcttttttgtacatttggtagaattcgactgtgaattcatgtggtccaggccttttctttgttgacagactctttattgctgattcaattttgtcacttatcattggttgagggccaaagccagatggagctggactgggcaagcttacactcaggactcccagtcacgagtgcatgcactggccatgacaggttggggagaaacagtcctcaggcctctggtggaattcttgggtaaagtgtagtcaccactgcactgaggtccttccatgggaagggtgggaccagtcccagtggccttagccttggccagtgagtaagagacttgcttccttcttacagcccccagtccagacaggtgtcatagccaacccaactgttgcccctcagttcatgctcatggcccataggagtctccacttagctcaacactaagccttcatggcaactctcatcctgctcaagtaggaggagcagtacctgcttcctgcactggtggctgcagcccatgccacactagcttcttagtcttggttgttagggccagcccctagttcacaccccggttctgcaaacaccagcctaagtttccctaatgcctaggactggaattctcaggacttcacacagtctgttaagggctaagatctagaatggtgtcttactttagctgcttgggtttcagaaagagcatggaacccaaggcatgctccctccctaaagcagttccttctcacagtttcctggttgctttctaagttagatctagggtttgagagagtcaaggtgctctcccataacctgaattatgcaattccccagcaggaaagtggaccacgtatagactctcactcaccctctcctgtactggagagtcattcctggttcttggctggtcttggccatgtatgctgcctattttccttccccttcctagcttttggtgttttctgtcactttcctgttgaattccaatgttctgccttggataatatattagaagtgtgattgtctacacaccattttgcttcttctaagtggataaaacatgcttgaaatgcttcaagtcagccatcttgaataaaaaaaagagtccctttttgaaaatgggcaattcaactttgccaagccataatacctctttgacatgtttttgctttttatttttattcattttaagttgtttttaccttaaagaatggaaagaaacatagagctgcccagtaacacgttttaagtttctttcataaaagcccttggggtaaactgaatgtacagtccaaggttctgaacttggtaactccttgtgatttctttatgataaaatatttacaaaatggcctttagtactttccttcgaatgttaatcttaatatgaaatctaagaataacatattcgacctcctttatgtgagtaagcctgaccaagagaataacttatttaggaaaagaaagccacagatatagaggggggagatatacacttaatcatttactaactcaaatgtatgctcattaagagcaagagcctggtgtaataatatttgaacctgccagaatgtatggtgattacctgctattattgttcacttagccatatgtaatattcctaatctattttccagcaaaataggcacatcatcaaaaacactggtagaaacaaattagcaataggaatccgaatggcttttttattgataaaaatcccccaatacctatttttttaatgtaagcctttccagaaaaatgaaagggacacacaaagatgactaaatggaccaatgtctaagtaagactatgtcattgccatacttgtctggcctcaccataactcatgtcaggtgctactaatcaggcttgagtaaacataaccttcactgttattagctgcaaagcaacctctgtgaatgagtggactatttcaggtagtaactttgaccatcctcttcaaagagaaacaaaattttacagaaaaaaattctcaggagcttggattccattgtccttattgtaatggggttataatactaaaattcctctaccacttatttaagaaagtaaaatgttaaaatttgtcccataaaggaaaacacataattattcataaaattaccatgctcacctttgataactatctaaatttaaattatagctttctttatcttatatctttgtataccatcactgtaatattaaatgtttcatctcaataaaaaaaagcataaccaataccaaaagaatcacattattagtccaaagtatgatccaaaaaatctgtaaatgatatagtttggatctgtgtccccacccaaatctcatgttgaaatgtaatccccaatgctggaggtggggcctagtgggaggtgattgaattatgggggcaatttctcatgaatggtttaccaccatccccctagggctgttctcatgatagagttctcatgagatctgattgtttaaaagtgtgtagcacttcccacctctctctcgatcctgctcctgccctgtgagatgacgctcctgtgccttccaccatgagtaaaagctccctgtgacctccccaggagcagctgtcgccatgcttcctgttcagcctgtggaaccatgagtcaattaaacctcttttctttataaattatccagtctcaggtattcctttatagtagtgtaagaatggcctaatacaagaaattggtactgaggagtgggggcattgctatacagatacttggaaatgtggaagtggttttggaactgggtaacaggtagatgtcagaagagtgtggagggctcagaagaagacaggaagatgaggaaaaatttggaacttcctaaagacttgttaaattgttatgaccaaaatgctgacggtgatatggacaatgaagtctaggctgagatctcagagggagatgagaaatttagtgggaactggagtaaaagtcactttttctatgctttagcaaagagactgggtgcattgtgcccccttctctagggaagtgtgaaattttaaaagttagaatgatggtttagggcatctactggaagaaatttctaagcagtaaagccttcaagatatgacctggctgcttctaacaatctatgtttatatatgtgagcaaagaaatgatctgaaacttgaaattatatttaaaaatgaaccagagtgtaaaagttaggaagatttgcagaatggccaaatgatagaaaagaaaagcccattttcaagggaggaattcaagcaggctacaaacaattgcataagttaaaaaaaagagccatgtgctattagtcaagaaaacaggaaaaggactcaaaggcctttgtgtcagtccttcccattacaggctcagaggcctaggaaggaagaatggtttcatgggccaggcccaggacccctcttcccttcatagcctcaggacattgctccctgcattctggccactccagctccagccttggggcaaatgagcccagttacagctcactgcttcagaggatgcaagctataagtcttggtggcttctgcatagtgtaaagcctgcaggggcacagagtgcaagagttgaggctttgaagctccacctagattccagaggatttatggaaaagcctggatgtccaagcagaagcctgctgcaggggtggagccctcatggaacacctctactagggaagtgtggaatgaaaaagaggggttgaagcccccacacagagtctccacacagagtccctcacagtgcagctgtgagaagagggccatcatcatccagaccccagaatggtagatcccccagaaacttgcaacctgcatctagaaaagcctcagacattcatcaccagaacatggtgtgccctgcaaagccacagggttgatgctgcccaaggccttgggagcctacctcttgcatcagtgtgacctggatgtaggacatgaagtcaaatgaaattattttgaagctttaacacaggggtgtccaatcttttggcttccctgggccacactggaaatagaagaattgtgtagggccacacataaaatatgctaacactaatgatagcggatgagctgaaaaaattgcaaaagtatctcataatgttttaagaaagtttatgaatttgtgttgggccacattaaagccaccatgggctgcacacagcctgtgggctgtgggttggacaaatttgctttaagatttaatgactgcactgctgggttttaaacttgcatgggacattccctttttttggccaatttatcccttttagaatgcctacacctctattgtaacttggaagttactaatttgtttttgattttacaggatcataggcagaagggagtagccttgtgtcaggtgagactttggacttggacttttgagttaatgctggagtgagttaagactttggggaactgttgggaaggcttaatttgaactttgaaatgtgaggacatgagatttgggagggtccaggggtacaaggatatggtctggatctgtgtccccacccaaatctcacattgaaatgaaatccccagctggaggtggggcctagagggaggtgattggatcatggaggtggtttctcatagatggtttagcaccatcccccatttctgctctttgataaagttatcatgatatctggttgtttaaagatgtgcagcacctccccactctctcttggttctgctcctgccatctgagactcctgctcttgctttgccttctgccaagagtaaaagctccctgaggcctcctcagaagcagctgctgccatgcttcctctacagcctgtgggactatgagccaattaaacctctttgctttataaattacccagtctcgagaatttcttcatagcagttgtgggaatggcctgatacagtaaataacccaattcttatgttttagggtttttttctaaaaatttatatgaacaactttaattttaaacacatattatgaatttacatttagtcccctatgtcttctggtattttcctttttttactaagtggcaccaactctgaatggctatgccaatgagttttcatatattcttagagacatctttcaagcctacaatatcctttcatgaaaaaagtctctgagataatggatctggacacttcactatttgctctattaagcctatagtccttgacgattaacctagtagaggtaatgtaataagtcagattaatatgctcaatatttaagatgtcaacgttatatatttgtacctcacacacaataagacttttgcagaatatgccaagaaaatgtaactcttctcctgtattatgcaatatctccattagctctattggaagataaatactgaaattgtgataatttcaaattcagcacactattacagatgaaataaatgttaactgaattagatcaaaagaaacattgaactctggctcattgaatttaaactttagctttgttagtaaacgtctcctcttcctttaaaaatcacttcaaactaccgagaagtgactgtagggctcctttagaacaatcagcaaatttcatttataagtactcataaatacatatacattcattgaaaaatagcattttatttttaaatatatataatatacacattcataggaaaatagaataaaggcagcaaggaggtacaccaaattgttaataatagtcatgtcttggagacaagatttgaagtgattttaatattttattcatatgcttctatattttccaaattctatactggatacaattagatatcttatagttttctaaaagcagagatgttggtggagtcaaggaaaatgtttaacaagaacagctcagaactttttggtgtttattaattccagaggcaacatagaattaactagttaaacataactgattcaaaaccttatctgtgtaacttacctatgtaaatttccgattaagcttgtaaactcaggcaatctaagtgcccttggtaagaccttatcaaataggatgagtttggtggtagcatgagtcagggagtggtagctgggatagttggcttctgcaacattcctatactctggttggtctagctgggtacacagtaatgccttaactgtgtttgaaatactagaagatcaggtctgaggattcagaaaagatgatgattcaatatttacctgttaaggtcctaccaaaccactcaaagggatttttccagttgttcacacctttctgcaacagtatctatttcttttttccacataatatgaatagatttcacatttcaaaaggtggaaaaatatagcctcagtgactacctatagatggttggaaattatccctatctgaatggctgaataattatgtttttaaaaagataatgatcctactgttcattctaaaataagaaaacttgtttttaaatataaatatcttcaccgtcttagtgagcacagtcacccagctttcagatcaatacaccattgagccaaacaggctttttaaaatgagctctcgtatactgtggacaggcgtgaaggaagagagagagtgaaagaggcaaagacagagacagaggaaacagaagctgaatgactgattataactattctctaggttcccacatattttgccaggatgatcatcatcttgttctgatatggggtatattttaattgaactattcatggtatgaataaaagatcaaatctctggatttcctttgacgtacatagtaaatcactgacctgactccatgttttacgtacctcataaaactaccacagctactatgccctttcctaattcctgagatgcacagtgtgaatcggaatttaaatgttgctgcatccaaatcaggacttagatttaaatgctaagcatctgaagcagggaaggccgtcaacctggtactgtaaaattatgagctttcctcatctggctacattaatttccatctctttgtcattttgatttctaggaaatgttcagtcaaatggaaaaagaaaattggagtgcgtggggtgggtggataaagccgcggtccatgagtccttgcttagggagaaagttttttctctcttattgtgcattttagtttaatttaatctgaaaatatcaatgctacccaaataccaatcttatctggaaaagagggttgagaaaagaaacagaaggtttaaggcaactagttcctttctacaaaacagaacagagcttaaaaatcttagtagatatctttcattgtggattgcaaatttagagtgaccacctttgtataccttagtgctcaaactactccctgtgcctcaaacattttcctgttttttttcaccttccaaagtgtaaatcataaaaggcagcctgactagtgctaggcaggatagcataggagtgtgaattagatacaattccagatattcaacttttccagcctaaaaaaaattatatctcaatacctttccctatcatgaaagcagcatctatttgcttacacctgtaggagtgatcagtctgtaaaaagagagtccatttttttctgggcagagtaggaacagaagactccccactgcctgttatatgtattctgtcttttcctctttctatctggagcttttaaggtgtgtgtgtggatgtgtgtgtgtataacaaagcttcaaaaattaatacatttgaaatataccacatatcctaatttatggaacagtttattcttattatcccaacattattataatagcactaattttacatttaaaaagtctttattttataataagtcatatgctcacactagttatagcactaatcaaacaaccttgagctaaaatcctaaccccatttcttactagatgtgtaaccttgagaaaatctcttaatttctctgtgtgtctgtcttctcatgcaaaatggggatgatagtgcaagttgagtatcctttatctgaaatgtttgggaccaaagtgttttagatttcagatttttatggatttttgaatatttacagaacacatactggttgagcatccttaatctgaaaactagaaatccgaaatgctccactgagcatttcccttgagcacatgtcagtgttcaaaaagttttggatttggggacatttcagattctgatttgggatttgggatgctcaacctgtagtgcctaattcatatggtgctccaatgagttaatgtatataattgaggatccaatgaattaatttatataatttcagaacagttcctaacatataataaaaactcaatatattgtatagttatcatgaaagttgaagagtctgactcttcttgccctctaacctagacccaagaaaaaaattccaagaatgcaactatttaacaaaatacagtatacttcagtgactttaggtaacaaagtgtcaattgcttttgtaagtcacatttatatgaataaatactgtttatatagtggttttactttaacacacactttcctacatattatcataatttttttcataacaattccattaagtaggtattattaatatccttattttccagattaagacagtcagagaagttaagtcataccaatatcacagacagaaaatgccaaagccagaatttgaaccaaattcttcttactctaaatgccatattttgccgctatcaaattcttaatcattttgtttcattttcaactcaagttgaatttttacttcaaataactatcatattttaacgtgtttaccttgattccgtcatggcatttttcatactttaaattgcatatttaattgcccaattcttcaacataaaattgcatgagagaaaaaactatgaatttcatcgttatatttggatttgcagtgcccttcttaatttctgaaacacaagcagaatctcaataaatgtttattaaattaatgaaatctggttctcaagaagtgccctggaaaatattaggcaaaaggaaaatggtttctgtttgcccagtgcctgtatcccagctctctgttaagtgatagtttgaaaagaggagacaagcctttcacttggctcaggctgaggtgataaaggggattcatggagaacttgatgaatttctctgccatttcctgacatgtattcttgggcaatttactgagatatgttgaggcaaatgttggcttttcccaaggaaacctccctctctagaaatccctgccataatattaagacttcttaaaacaagaacaatacagctcagtgcggttgttaatgcttataatccaaacactttgggaggcccagcggggcggatcacttgagctcatgagctccaggccagtctgggcaacatggccaaatctcgtctctactaaacattaaaaaaaaaaaaaaatagccaggcatggtggcacacgcctataatcctagctacatgcgaggctgaggcacagaatcgcttgaacccaggaggcagagacagcagtgagccaagattgcaccactgcactccactgcactccagccttacaaaagcaattgacactttgttgcctaaagttacttaagtatactgtattttgttaattagttgctttcttggattttttttgtgggtctagtttagagggcaagaaagatcagacccttcaactttcataataactacaatatattgaatttttacaatatgtgggtgacagagtgagactctgtcaaaaaaaaaaaaagaaaaatattaagtacttactttctagatccataaagatttccataggcattagagtcattaccactctgctcctggttatcaatagtaaaattagattggtaaaaatcagagtcaaattgtgccaagtttgacatcctgaaaaataagagtatgtttttaataagttcatgagtcaataaaacttagtttgagatatttacaaacatcaaatgacaatgtgattatggctgaattcctatcagaaaaaaagatgtcctttgaatggggtcaataaagtattgggggaagggtatagaaatatatgctagaaagttatttacagaatgtgttatcttcaactactttttctgaagttttcgcaccctggactgtggcttttaataacttgactttaattcatctgaaagaactaatcttctccaaatatcttattcttagtaatttaagagaaaaagcttaaaacttaggacacatctagaaggatttccctaaaacgatgttcttcattttaagcaggcgcacacacatgcgcgcgcgcgcgcacacacacacacacacacacacacttgtaccaaggattattatctgcaaatggctgataataataatactccttcccaaagcaaaaccaaaaccctacaaacccatttccttgttctacttggcaattcttaaaaagtgtttggaatattttcgtttttcttttgctctggatactgcacctgggcttctggctgagtcagagagaaaaagactcaatcctgctaagggaagtctttgttctatacattctctctatagtttccactcacttctaggagtaaagaggaatgattgtttttgaattagacctaatggccaggaataccagagggaaaaataaagaactgagagaaggaagaggtatgggagaagaggacattagagaggtaatagtggctctttggataaaaagtagagaatagagaagcgactcttttcaactggacaaatgtggttattcaactcaacatttaattctttatttttctttgaaaaccttgttattttaaaagagtggatttaaaaatcaccaggagtaatccatatgcttataataatctatggaatactacttataaaaatatcaaatgaaattgcataaacagcctcaactctaaaggcatcattaatcagaaatattcaagtaacagttgtcaaatatatcaaatttgttcagttcaatgaaaacacaaaaagcttctctaaaattagatgcagcgattcatacatctgatgcaataaatcaagatttttcattagtaatgtgtataaaagtagctatgaattatgtaaactgaaatcaggacttagtgataaatcttttaacaatttataatttaaagaaattacaatgtaatagcataactttctcaacacatgaaaatatggtattataaagcatagagagtaatttattgagaatacactaaattttcataacatgcaaagctttatgtaacatgactattggtactacagtccttacataaccgagctttgtattttgtttaaatgccaagtcttttagaaggatcagacacatacctctgtttattttttatagaaagatcctccagtaaatgtagctttgtgtgagaaattttaagcaaatccattggtgaaaagatgacat

SEQ ID NO: 1742 - DNA, 129649 bp, Homo sapiens
attacaatgctcagggtgaaaactgagtattttatttaataataaaacttacatataagaacaattcagtgaaatataaaacaaacctttttcccccttattttcaactgtcctttctaatacccatagggaggaagagatgaaaaacaaaaaacctgctagtctgtaacttaaggtccagaaagaaatatttacctattagccatcgtttcactcaagggattgtgaaatgcaaaagcacacatcaatttattcattagttgtcaagtgaggaggtaaacccctctttcagcatctctctgcatatcttagtttggatggtgaatgaagaaggaaactctctaaaatgtcaaataaggaaaagaccacctagaaatgagtgacagtaattcacagggatactaaaaataagaatcaagttgtaatatctgtactcagtgacacaaggtatcaacacaccttcccaatctaatcattttatcgtgtctacatggatcttccttatagcatgcttttttcataaattgtggaatattttttgagaaaagagagtgtaggtcactgaggccatttgttcttgtagctctctggctggcggggatccaagtgtgtatgaagatgagtgacagtgtgtggccagctttttcgctgctggtctttctatctgcagaagctttgagtgcatttatcagaagccaaaccatgccaactcttttgatattaggtctttgggtggagctttcaaaatcattctttgttccacttttcctagattgtcaaactgcgcccagtaggtggttgagagtgtgaatttcaaacatgtgcttttaatacgcccaaaactgttgctgcaaagaagggggaaaaacccacattaattgaatcctcacccactcttactcataatgtcatgattgtattttctatatcctaaaacaatctgaaatgatttgcaaaactatgttaaatcctcaggtgaataagcttacaggtttttaaatatatattcttattaaaagtaattattttctcacaacaattcaacaaaacccacccagagtaagtataggtcaacaattaaaaaatgataatattgtaatctttgctttcatttaccctagccttcctattggaatactaatgatcattagcaacattacgatatctgtagacactacatattttaacatttcttcgcaattctctttagaatatttttcttacaaatatcttttggaaggtcactattattcccattttatagatgtcatatgaagattgtaacagtatctaccgtcaaaggatcacttcagggattctcataagatcatgcacattaagtacacagagtatttggcactattagttattgagtgctcaaaacatgttagctattgttaatatgcaaaagtattagcaactatattaaagttaacagaagtccattttaagtaggccaatttagtttgagtcttcctctagcactagacagttcttccaaacaatgcaggtatgactgtttcatatgctgacccatctgccaggactgctcttgcctactcactcccgattcctcacccctctacctagctattccttagtggctagagattgacatagatggtatttctccaggggtgagcagtcactaaccttgcccacatctagctgatatatatagtggggcactcctcctacccgcttcaaccatattgtaatttctgcttctttgtctgcatccccttaacactaaatctgcatgagggcagggatcgtgtctacctttgtataccacattcttagtacaatgacaaactcaatgtcagaacataatgggtgctcagtaaatatctgctgtatgaagacacctggtatctgaaatcagcctggctggtgactgaaagaaagctttttgattagtgtaagtgatgctgcccacctaagagataagtagcagttagttacggggccagttgaggatgagggtgctaaaatgggatgtgccactgtggaagctctgagtagaagcagaggggtgggcaatcagtgctaggggagatcagattccacctggtcaccgtcaaactagcacagtcccattcagcttcactggttctggatatcgagacaccagccctgcagcatgaggagcgagagcatgggttgactgcacctccttttcactcatcagggtagagagactcagaatcaagctcttaggtcccagccttccaaccagagtagcaacaacaaatgcaggtcaggggtttctgctggctggagtgaaagggtccaatctgatccatggacccctggaaacttaccagacagttgggatgtgtagtgcacgtctggcccaacccagaagtgcagtgccgagggagaagctttgagaccgggggcatggctgaaggtaaatgaattgaaatgttctgatttgttacagcagttgcatcgtaggaaggggtgactttagaataatatctgacagtatgcaaggaattcagagacagcgctgcactggaaatgtgagttttatatggatcaccaatagcattctctgaggcggagcttgatggaactttaatgagaaagaaaacaaatatgggtcagtatccacaattctgtaattcagaacgactgttattcgacataaactgcccgctatttcatttcctcacattacaaatctgtactacctgctacacccgaatgctgatggaaaaacaaagtgaactttctaattgtgacatttagtgcaatacacacactataaattagtgttcatgtacattaaaagacaggttttatagaagcagaagatccctgtgccttctgatgtatgtgaatgtgcacgtcaatcaaaattgactctctctgaagcaaggaagaaggttggaaagaacaactccattcagcagaatggtttatatcatcatatagctatattctacatggtaactagaagaaaaaaaattgaatatataatattaacaatgtaatctcaaataataccatcaatatttattttctactggacattaataatattgaaagtaaaataatataatggtatgtctactttaaatacaaatgtatctgaaatgtttgtggaaaaataatttaagcaactgtatacagagatttatgaaaaagaacagaaaaaggcaagctgataaggttaaaacatgtctgtgttacagatcaggctcagcacagaaaccctgggaccttgggtgatcatttaacttctctagccttcaacttcctgatgcgggtagtgaaagcgaaatttggaagacttaactgattgcaacttctctgatcctctttccaaaacaatttggcaacatgcattaagagcctatacatacattcacgttctctgttctctaagtcacccatcacactcttccaggaacccattatactcttccaggaatccagtccaaggaaaagtccaaaatacagaaaacttcatatatgggaaaatatttcctatcatatgatgtaaaaaatcactctctccccaaactgcaaatgctaaatgtagcgactggaaaatggctaagaaaattactctacccttgataaatgattaaaactattaaaatggtgatgagtgatgcataacaacaaatatacatatgtatgacacaaagttaagtaaaaaaattcaagaaacaaaatgggatatccaatgattactactatagaaaaatatatctggaagaagacttgaaggaaatacattaaaaaatgaacacggtgattatcttatccaggttagtaaaggatcggcactggttttcaaacgcaaaaatgtatttacatcaaataaaaatggcagttttgactccttaaccttcaaggcctcctagggtttgaacctaccacaggtctattcctagcatatctctggcttcccaagattggtctccttaggggaggcagtgtcttgaaatgctggggcatagaaaggcctgaactcgctgccacgaaaataatgtttcagagtttctgcaggacataaatagtattgtatgtacaaaaaaataacattgacaggcatatgcctgtggcctgatctctatctgatttaatctaagctgatttaatcattccatgtcacattcagccactgctacttatggcaatttttttttcttctcctctcttctctcctctaagttgggagaaaagtctaaactgactaaaataacaccctgaggcttctttggtgatatgaagaatcagggctgggttctatctgggggtccctgctcttttgactttagacactatgctgcataaccttcatttgttcccatggcttccgccacatccccatctgtgcatggttcctctactacagcacttacaagactgtctgggccataatttcttttgtgaccctttctaccactaagttgtgagctccataagaacaagaactgccttttattcatctttgtgtccccatctttgaggcagggacatttaagctgagaactagggatggacttggtactaactagcgcaggtgagggaggaaggacattcctggtacaagggaggtgcttggtgagagcagagcctgttggaggaagtcagaagtgtcatctaggactgagaggctgaggagagaggcagtcctgtcatctagcgtctaacatttaggtcaagaggtccataccttcctggtttctagacggagagtaactttatcttcaggaatactaaaagtcacaaactgctagctgtgttcttttcctctatttttttccatcttgttatttcaggtacacgggcatgtctaggcttatacggcacatataacaaaaatgcctcccagcgggaaagcatttgttccacaatgaatattcacataatgagatttcttgagcccctcctgtatgttggtcattgttctaggtactagaaatacagcaatgaataaaaccagccaaaaaattccctgccttcatggaggtgacattctaatggaagataggcaacaaacaaaacacacaagtaaagaatagcagaaggcagtgagtgctatcaagacaaatacagcagagaaagtggctgagaagatctctttgagaggtgacatgcaagcaaaggcatgaaggaggtaaataaatatgttaaatgctcaggacacagtcagtcctgaaattatacgaatacttcccctcccctgagattctattcatattataaacaaagtcaccagtgtgcttatcatctatcaacagaatgagctttctggtaattacggtcaattttgagcccagtttctggcataacactatttaaacaactgtagccaccttgtgtacctgaggctgacaataccagaaggactcatcagctctcctggattccctggttatggtggtgaatgcacaggagcctgggggtttgcagggcagggcaggtccccctctaagtggcacagatgctaggagaagctcacctctcacagcttcatccaaggagctctctgcatcaggagtggagcacccattccagcacgtattagtcaggaattggagccctctctcaggggagtaagtgctcatcacactgttttcccttgaaaggacagaaaaaattatttgcacatttttcaaggaaaacaatgtggacactgctgagttcaattgcccttttatcattcaagttctaaaaacactgataaagcctcaactatggattatttacatatgagcaaagacacatgacccacgataattccttaggatgtgcaggaatgatgtgctttttctccagtttctctttgtttacatattctgatcaatctagagaagaaagtaatcatttgggaagtcacattttgcactaatgacctgctttaagcaccactaattgaaatagggctggacagctccagggcccgagacctctccacaatggaggaacaccagaagccatcacgtccctgctggaccaccaccatccctacactcacaagggagaaagccccattttaagaacctcagaaataatgaaaggagaagcaagggtgagtcacatgatgaaaaaaccatggacctgagaatattacctgtgtttatcactgcaacgaaatgatacacatcggcaattagaaaagttcgctgacccttaataagcccctgcactttcactgtggatagcagtttttgtgtacatatttagcatcaacatgggaggaaaataactagcagacttcagattcgcaaaagcccttatcataccgctgtgccatgacagtgcctgggagagacagctcaatgggtgtttgttgtttcttacaaaacctcatgttgctctgaagtgcttctgtaatctaaaaaacacagaaatatatttaggtagataccgacatttttacatagatacaaagacacatactttccaatgataaaaaattaaaagaagtaaaattgtagtattaaagcatgtctataaggataaaattcaaagctttgggagtcaaatacctgggccataacggctggagagattttctcccggatatatttcacataatcaactgttgcctcaagaactgaagccgcatcattctttctcccttttacatacggcaagagagtacgcagctgctcacagcaatatttgattctttccctggacacagaattgcaatacataaagaataattagtctcattgtcttcattgtacccaaagacaaacaacacttcctcctgggtatgtttgtaaaggaaccatcccctccctatatagtctccatttcagagaaaggctgtgtccccacaagccagcagccctcacagcccctgaaatcacagcttcctggggcacccacgcatactgctacacaaagaaccactgcccaagtgcactgtgtgtgccgatggcagccccagctctctcacctcaggcctgctgcagagcgcaggatgcccagtcaccgaggaaagcacccttcccaccccctgctgcctacggaaatgtgcagaccactctgccctccgagcagagaattgtacatgatataaaaatccttttgcgattcacactagaagcctagaaggcaaagagcagtcaggaccttcatgtcactgggacctagaccacatttccaacaacagatcagctagcatcttgtaccacatgacttcatggcctgagcaaaaagaaaatcagaaggctgcttcctttacatgaggtaggtacagacagaacgagcagaccaggatgcaggtatcagaaagaaactaacctgtctttcacagctctgaagggggataggaaatgtagatctaactgacttaagcccttggtggcttcatttatccatgtgttcctttaataaacatctttaagcacctgttttgtgctgaatactaccttgacatctacagggttgaatggtggctctgctattactaactggaaccttaggcaagttactaaacctctgtaaacaccagaatggcagagaaattatatttaaaaacctagtttgacatacggccaatgaataactcaaatattctacatcagtggtgttctcactgagctctgaggaactctgggggctctgcgggggtgtctcgggaactattctgggaagggaaggatagaagagtcaacaatttgacaacgtgtgtgaagggctttgaaacttttcacagcctttgacatggttcttccacttacaaggatccgtcctgaggagtgaatctaaaacacagagcacagtatgtatacacagaaacccattagagcaatatattagtaaaatatagaaaacaacacataacataggaggatgccttaagtaagctgctgtacattattagttcagtagaatgtcacctggcagtggaagtgagatgttataaagcttattggggaaaagtaggccacaaaacagcatataaaatataatccaagccactaaacaaagtagaagtgaagcctaggaaaaaagactgaaggcaaaaacatccagtacagttatttctggatggctggatgatggatcatttttattccctttattttctacattttccaaatattttttgctaggcatatgtcacattcagaattgaaactattgaaatgctattaaaattttccaacattagaaaaatgttcgaacatagagaaaatttgaaagaattatacagtgaacacctatacacttaccacttaagagtctacagttaacatttactgtacaggttgagtatccctccccataatgcctggggaagtgtttaagatttcagacttttttggattttggaatatttgcatagacataataagatagcttggggatgggacccaaggtttaatacaaaactcatttatgttttataatatatatatatagcctgaaggaaattttatacaatatttgtacctgaaacaaagtttgtacacactgaaccatcagaaagaaaaggtgccactatctcatgtcagtgctgaaaaagtttgattttggaacatttcagatttcagattttcagattagagatgctcaactagtatctgctttattatatatgtgtcatcccactattcatacattaacatatttacatatattaaagcaaggtaagttgtagacataagcacattacactcctaaatgtatcagtagctcaaattactttattttcaggtaaacactacataaaacaaaaatgcacaatgagtcccattctatgagtttggacaaatacatacaactgtatgtatttgaaatatatatgtaacgaaaatcctaatcacacatgaaaatccattatcacaaacccagaaaggcccttgtttcttcccagtcaataccatcccctaaccccataaagcaactacaattctagtattttttttccataccacatcacttttgcctgtcctcaaatagcatataaataaaatcttacagcatgtattcttttgtaaagcttctttcactcagctttaatgtttctgggatttatctatggggctaaccatatcagcagtttgctccttttcactgagcaacagtattcaaaaatatataaatatgccacagcttacttatccattctcttattgatgaacacttgggctgttaccagttttgggttattacaaataaggatgctagaacattctagatgtctttttatgaatgcatggttttatttctcttgggtaatatctaggaatagaaatgatgggccattttataagtttataaaaacaggcagaactcttaccacaccaagggagtaccattttacacttccaccatcaatgtatcagacctcttgttccaaatctttgatgatatttaatatcatcagtagttttcattttagcattttggcctttctggggcatacacagtagtatccattatgttttaatctgcatttccctgacagctaatgatgttgagcactttttcctgtgtcttttgggcacttgtatagcttcctttgtcaagcgtccatgcagatattttacctacattttaattgaattgcaggtctttttattttttagttttagcaattctttacatatcttggataccaggatttgtcagatatctgtttggcaaatattttctcccaatctgcggctttcgtatttattttcttaaaactttttgatagcaaaagttttaaattttgataaatccaatttatttactctctctctctcatggttattgctttctatgtcctgtctaaagaacatctgcgtactctcagctcatgaagacattctattttcttgtagaactgtaatgtccaatacagtagtcaatagacgtgagtctatttaaatataataaatataaattaatattacatatattaaaaattcttttcctaagttgcaatagccacatttcgaatactcaataaccacatgttgctagtggctactgtatgagatgatgaagatataatttttaacacagcagaagattcaactgaatagtgtcatcctagaagctctataattttagctttatagtacagctctgagtatgctccatcttgaaataattttttatatggtgtgaagtaaggggtcaaggttgattctctttccagatggatatctagttgttccagcatcatttattaaaaagattttctgtcccaaaatatttgctttggtgcttttgttgaaaatcaaatgactataaatatgtggatccagtgctgggctattgtgttccattgatctatttgtcaacttttatgccagttacctactggtgattgtagctttagggtaagtcttgaagtcaagatagtttaagtccttctactttgttgtacttttgcaaaattgctttggatattctaagtccttttcatacattgtaaaatcatcttgtcaatttttatggaaaaaaacttgctgggattatgatttggattcaaataaagttatgtttcaatttggtgagaactgagatcttaacaatagtgagtctttcaattcataattatggtataattcatgatttagtttttatttaacttttcatagtaacattttgaatgatcaatgtacagatcatttgtttttttttttttgcatatttgttcctaagtatcctaaagctattttattctactttaaatgtcataatatttatattttcattttataattatttgctgttaatatataaaataccattgatttttgtaccttatcttctgtaaccctgttatagtcattctttggttccagtagctgttttgtaaacgtcttaggactttgactttatacccaatcatgccatctacatatagtaagccagttttccttcttcctttctaatgtgtatgtctatttctttatcttgcctaattgcaatggctaggattatttatttgataatgaacagaaatggtaagaatgggcacccttagtttgttcctgatctttttaaggagcagtcaacatgttatcactaagtacaatgttagttataagttttttatagatgccttttaacaaattgaggaagttatcttccacatctatttgctgaaagatatttgttttttaatgataatggtatattgagcattgtcaaatattttttcagaatttgttaatcacatggtttttctcctttattctgttaatgtggtgaatttcattggtttgctttgtttttgaggcagagtctcactctatcatccaggctggagtgcagtggcaccatctcagctcactgcaacctctgcctactgggctcaagtgattctcatgcctcagcctcacgagtagcggagattacaggtgtgtgccaccaaacctggctaatttttttattttttttttgtagaggcgaggttttgccatgttggcctggtcggtcttgaactcctggcctcaagtgatccacctgcctcagcctcccaaaatgctggaattacaggtatgagccaccatgccaagcccaattggttgatttttgaatgtcataccagtcttgcttttctaggatgaacccctgatgtggtcatattatatctttatatatttcttgatttaatttgctaaaattatgttaagtgtttttgtttttatgttcatgagggatactggtctgtaattttctttataaataatgtctttgtcaggcttagggttatgttgttcccatgaaaggggttaggaagtattccctcctcccacttctgtaagaacgtgtttaagattagtattacttctttaaatgcttgctgaaattcattggtaaaaccacctgagtgttttctctttggtaaggttttgataacaagttcaattttgttaaacatagagctattccgactttctgcttcatctggtatcagttttgataaattgtgattttcaagaatttatccagtacatctaggttgtagaatctactggcataaaattgttcaaagtatactcttttgtatttaaatatttagagtagctatcatgatcatccctctttcattcatgattgtgatatattgtgtctgtctcccagcctcctcccccttcaccaccccacttatttgggtttattttgttttactttgtcttgcttcctaagatggaaccttatattactgatttttaggccttttgccttatctaatataagcatttaaagccacagtgttttccctaaactttgttgtagtttacttaaaaactttgatatattgcattctctttttttaaatttaaagttccaggatacatgtgcagtacatgcaggtttgttacatagctagacgtgtgccatagtggtttgctgatatattttgttctcaatagattcactttgaaatattttctaatttttcttgtgattttttttttttgttttacccatggattacttagaagtttttttttttttaatttccatatatttaagacttccctttaaatcttactcttactgatttctaatttaatttcgttgtggtcagggaacacatctttattaattcaactcttttgaatgttttgaagcttcttatatccccaccggtatgcagtctatctaagtgactgtaccatgtgccactgagaaggagtcttctgctgcagttgttgggagtgttactctataaatattcatgagattgaggtggttagcggtgttcacatcttctagagcttactgattttctggtgtccagttgtataaattgctgagagaggagtgttaaatctccagcaattgttttaaaattatctatttgtccatttaattctgtaaatttttgatccaaatattttgaagttcttatcacatgctatttgtgattttaatatcattctgaaaagttgacgcttgtatcattataaattgcccctctttaccgcaggtaatactgtttgtcttcaagtctactttatttgatattaaaatagcctatctgactttcttatacttcctgtttccacaatggatatatttctattaatttatttttttatatttaaagcttctctgttacagacagtagatagctgggtcttaggttttgtttgtttttatctattctgaaaacttctgcctataagttggatatagttggataaaggtctaccatacctttttttccctctgtagtctcttttgcttttttattcttctgttcctcctttccttccttcattttaaaatatttttaaaaatccaattttaatttatcttttggcttcacagcaatgcattttgcctatctctttagggttgctctagggattacaatatatatctgaagttttcatagtctagagttaatactttatgacatcacataaaatgtataactgcagaagttatgcaagtgcatttatcccactcattcttcatgtaatagtcatatgtactatagctacatatgttataaaccccatgatacattgctataattcttgcttataacagttttaagtattttaaatagtttaaaatgaaaaatgtttgtttttgctcagacatttatcatttctggtgctatgtagtccttctagtgattcgagtttccatttgttattatttcccttccgcctgaagaatttccttcagctttcttactctgcaggtccactggtgtcaaaatatctaagttgtcttttatctgaaaatgtctttatcttacatgaagataaagggaaataatatctgatggaaatatgatttgcacaaacaagtgaagagtctaagacatgataaatatggtggcatacattaaagggtagttttctaatttattaatgttttaaaaaccaatagtatatatttatttgacaggcctagagcagctgtatactgctaagatttctactacagaggcaagaaaaaagtgtccttgtactttatgtccctttgattgtggcagccaagactgagtggggaaatgcaggagcaaaagatggtaatacagggaaattcatggggagagaatttttgcaactcagacaaaatcttgtatacagtgaagagcctgttctactgcaaacaagaatctgaaatttgggttaaaaagataagagttaagattaaagtcactgaaaattacttatttctccaacaaagagtcagggtccatttcctctcctcttgaatcttcactggcctgtgcctgctttaatcaaaagatatctggagagtgactctatgacagttctgggaccagcatttcagaagatgtagctttcacactggtctcatggaatcctaagccttcatgtaagaggtccttctagcttgctggagataccatgtggagaagtgatgagaccacagggaagaacagcccatttgagcacaacctgcagccacacccaccagaagaccacatgtgtggatgacgctgcgctggaatctccagacaggccagttttgctggctgaacatcacggagtgccatggttaacaccacactgagaagaatcacagagccaagctctgcccaaactggtgactcacaaaatcatgagatatgataaacagtttgttgatttccactaccaagtttcagagtaatctgttgtacagtattagataactgggcgacagcttactgtttaagcaaaacaaataacaatgctgggttgataactgatgtggcttggatgttttgtcccctccaaatcttatggtgaaatgtgatgcccaatgttggaggtggaacctggtgggaggtgttaaatcatgggggcactctagggcttagcttagcgccatccccttggtgatgagtgagttctcactcagttcatgcaagatctggtggtttaaaagagtttggggcctctcctttctctctctcttgctcctcctcttgctatgtgacacattggctccactttgcctcctgccatgattgtaagcttcctgagggctcaccagaaacagaagctgctatgcttcctgtacagcctgcagaatcacgagtcaattaaacctcttttctttataaattactcagtctctggtatttctttatagcaacacaagaatggactaacacaataacatatgtaaaagtaaaatgtatgacaacaataagaaaaaatgaaagaaggtaaatagaaatatgctgttgtattttaagggcataatatcaattcaaggtagattatgataagttaaagatgcatatcataatccctagagcaaccaataaaaaatagttacagctaaaaagtcaatgaaagagataaaaagaaatgctaaagtatacctgataaatccaaaggaaggcaggtaatgagaataaaaggaaaaagaaaatagattagactaatgaacacaaatagaaaaattgtgaacctaaaaccgcacttaacagtaagtatattatatgaaaacgaacaacagagattgtcagaatgagtaaaaaataacaacaagattcaacgacatgctatttacaagggacactctttaaatataaagacatatacaggttagaaaaaaaccatgcaaacactaatcacaagaaagctatattaatatcaaagtagattttttaagacagggagtactagcatagaaaaattagcattatcatttccttaggataagtgggtcaattcagcaagaagacaggcatctaacaacagaatctcaaactacatgaagcaaaaactctcaggaagaaagggaaaaagagttgtcactgaaaaacttaaccctcaaaaaatcagtaagggagcagaatatatgaaaaacactattgactaattctacctcattaatatttatagaatactacaccccccaaacagaagaatacagtcttttcaaatgcatatagaacattcatcaagggagaacatgctttgggccataaaacaagtttcagaaaataacaaaggacagaaactttacaaagcatgttttcagatgacagcataattaaattataaatcaatacctagaaagtctccaaacattcaagttaagttatacacttctaaacagtgaaaagacttactagtgaaaagaaaaaaatcacaagggatatgagaaaatattttgaactgaatgatagtggaaatatatcaaagttgatgagatgcagctgaagcaatgcttagagaaaaacttttataaaggaaaagttttagctttaagtgcttatattagaaaagaagaaaaggttaaaatcaatgatggaagtttctacctacaaagacctttttttttttttttttttgagacggagtcttgctcttgcccaggctggagtacagtggcgctatctcggctcactgcaagctccgcctcccgggttcacgccattctccttcctcagcctcccgagtagctgggactacaggcgcctgccaccacacccagctaactttttgtattttagtagagacagggtttcaccgtgttagctaggatggtctcgatctcctgacctcgtgatccacccgccttggcctcccaaagtgctgggattacaggcgtgagccactgcacccgctctactttttaaatacttcaagttctgggatacatgtgcagaacgtgtaggtttgttacatatgcatacatgtgccatggtggtttgctccacccatcaacccgttatctaggtctttaagccccgcatgcattaggtatttgtcctaatgctctccctcccctttcccctcaaccccccgacaggccctggtgtgcaatattcccctccctgtgtccacgggttctcattgttcaactcccacttatgagtgagaccatgcggtatttggttttctattcctgtgttagtttgctgagaatgctggtttccagcttcatctacgtccctgcaaaggacatgaactcattctttgttatggctacatagtattgtgtggtgtatatgtgccacattttcaaagactttttttttaaaaagcaaagtatagaggccgggcacgatggctcatgcctgtaatcccagcactttgggaggccgaggtgggcggatcacgaggtcaggagtttgagatcagcctggccaacatggtgaaaccccatctctactaaaaatacaaaaattagccaggtgtggtggtggacacctgtaattccagctgcttgggaggctgaggcaggagaattgcttgaacccgggaggcagaagttgcagcgagccaagattataccactgcactccagcctgggtgacagagcaagactctgtctcaaaacaaacaaacacacaaacaaacaaaaaacccacaaagtatagaaagacaaagagcagaaatcaatgaaataaaaaaatgagctaatatagaaaatcaatgaatcaaaatctgcttcactgaaaaaaaatcgataaaactgacaaacctttttttgctagactgatcaagaaacaaggcagaaaacacaatttatcaataccgggaatgaaaaaagccatcatcacagacctgtagatgttaaaacgataataagatcatgttgttaaacaaatgtgacacttaagattaaatggacaaatttcttgaaagacataaattaaccaaactgacacagaaaaaaacagccaaaaggaaaaaatagggaatttagtcctataataattacagaaattgaatatgtaattaaaattttcccacgaagaaaattccaagcctagatgacttcaccgttgaatcctatcaaacataacatttctacacaaattgtttcagaaaacagaaggttttccatttcattttatatgaccagtatgagataaagacattgtaagaaaactgcaaaccaatatctttcataaacacagatgcaaaaattgttaacaaaatattagcaaatataatccagcaataaacaaaaattatctacaccttaagacaaagtgaagttttgcatttaaaaaaatcagtcataatcaccacattaacaaacaagaggagaaattatcatcttactagatagagaaaaaaagactgacaaaattttacatccattcatgataaaatcctaaactaagactagaaggaaacatttttttaagctgataaaaaagcatgcacaaaaggccacagcttacatcatatgtgatggtaaaagacttaacattttccctctaagatctgaaacaaggcacggatgtctacttggggctctcctctgtataaatgtgtctcaaacaaacaaggactcacagggaaaggtatctgggccagatacaacttggaaccctctgagaactgcctgttctacctttcttgaatctttaagacttgtctagtcctggaaaagtcttcatttgtgggacactatggcaaagctcaacatttcccttcttctcaagtgaatagacacccccaaaattattacaccaccatcatgtcagactcatgggtacacaaaaatgtgatgacatcatttggagaatacacactttacaagataaaaacatgtttatgtatttataaatatataatgaatgggatttcaccaagaatataagaattagctaattttgattaatatgttctaataagaatgcgagtatcagagaaaaaaatttcccaagtgcaaaaatattggccagaaccatcgtttccttaacattagcaaacatcatgttgccctactgcttaaaaacaaacaaaaacccaaaaccatatgtaaagcaggtgagtggaagaggaggaggaagaaaggaaacagactagaagcaacgatttcagattcacaggcatggtcagaagggttaagagggaaagacaaaaactaatcagggatggtgtttacctcctgggagctcccaggcaaatctctaaagagaaagggggaggtccttgtcacagctcttctttttgagaaacaaagatttctagtccttcaaataatgccacagatgtgaacaaccccaaagcatcttttcagtctactagatgagtggttttagattttagttttcatcaaccattaaaattttaaaaagaaaactaacacgtaactttgggggaccaataaaggattcccaccattagatctggacatgaaaaataatgaaaaaacaaggaataaatgtttcctcgcatcatttcattataatcatttgctaatatcaacattattttaacatcaaataaagtatggagaatacaatcttaggatatcaattgtataatatgtagctttaaaaaatactcagtgcactgtatttttctcatttggcttcagatgaatgagatctatgggacagcactggccagcgggccctaagtcttgacctagcaaggcagcagtcatgggaatgaagccctttagagccagagtagcctatccaccatcccatcccatcaagcccaaaccccatcatcttcccactaatcttcagcagatggagggggaccattcagcaaagaacttgctcaacttcctccctgatcgggccccatcgaaaaattcatgtgaattcacattgagcctaaactcctcctctccattttccatggaagagacattcttccacccggttctggattcccttgccttctgcctcctcagggatgctcactccatcaccaacacctcctcatcagctgcgggggattaaaattatttgaccttcctcccactgacaggtggggtctatgtgcctccccttggatctgggtagaccctgtgatggctctgaccactagcatatggtagaagtggcctgggcccaggcctgaagagactggcagcgtccccttcctgtctcttgaaacactctctctaggagccctaagccaccatgaaagaagtccaatgacactaaaactactctgctggaaaggcttcagttgacagcccccgctgagctcagacttccaacccatgctggcaaaagtccagatacgcaatgtcttggaccctcctgactggaccatccaccagctgaaaactatgagtacctcagttaatgtcatgtaggcagaagaattgcttggctgagccctgctcgaactgctaacccataaaaacatagttacaataaaatggtggttgtttcaagccagtaaatcttgttttaatttttatgcaaccacagataactagaatatgaggatcttcaaaacttctttctctctctcagctgcttcttttgtaacataagcatattaaagtctggcctcttatcaaaatctcgtactttaccctcagtccctttgtaaatacttcacaccttcatttcatctgtgttcctgtctttctttctgcaatggtgcttcttctctaaccataccaatgaaattatttttgccaagatcaatgacatctaggtctggctcaatacaaatagtcagttaccagctcttaaccttacttgatctctctgcatcacatgatactcctgagcacctgttcctttaggaaattcctctcccctggtctgctcaataccactgcctcttggtattcttcttatctccttagtaactctttgtgttccccatggattccttctctgctgcctgtaccttaaatactgagaatctttctaaggttcttttctccactagtcccttctctacgtgcttcccacaatcatcctatatccatccctatgtccactgcttcaaagaaatgctgtgtcctcattcctctgagcctgtatttctaagcctagacctttctctagaatcaaagggccaactctgcactccaagaggtattcaaacctagaagtattcaagctcaacaagagtaaaaataaaaatatatttacctcacactgccattctactgtccttcttcgtcagtggatggtgtcaccatccacttgggagttacacctcacttatccttagccatgctcatgctgattcttcctagttaatacatctagaattggcttattcctctctatctcattgctaacaccatagctcaggaaattatcatttcttattatagactacttctggcctccggatgcaattcactgtgttacatcctattagagtgttcattctaaggtataaatctcatcataacactcctttgctaaaatcctttagcaactgcccaacagactaggttataatttgaatttcatagcatgaaatacccagcccctacttactacctctcatcttttgcctcttcccccttgtgacctgatggccaaccatatggacatacatgcagttccataaattcactggactctctaagactgccagcctctgtacctattattccctccatataaaatacccttccctgatttccaaaccaaattaattgcaacgtgtggaaagctcaatttagctactgccatctcaagaaaacttttactgtccccttactctgtcttagaaaactttcctagtgtccttattttgtgttctcatcatgacatgtattaaaaagcataattttctacttaatagcctatttaaaagtctgtctgagcactagactcagaacacctttgaaggcagggacttactttttatatcagttctccaatccttctttggcatgcactgcagactcagaaacatttattgaatgactacaaggctgaatgagtgagtggcatctatttgtttgctaagtttactagtttcacttatacttttaataatactacaaaaaattataaaattcattaatttctccctacaaaagaataatgcttaaaaagtgctatattaaaattcaccttcttagtttttccttgcttgaatgaagaagagagatctttttgtttttctcgaactctgacaacgaagcatttaattcaagcccattgccattccttaaagattcagagctagaaacaagagaaaatcacaccatacattaaaggggaaaattgtcgggcaaaattaaataatacgcaccaatacactaaacaaaggatgcttctctaagtctcttgcttcatacaaaggggcaataagtgtcaaaacaccatatcttagacatttggtgcagaatgtttatttcaaaatttcaaaagaatatattatcaaaatcatcctaaattcaatgactgatcaaaattctaaaataaattgttaacaatacatacaagcaggattaaaacattctgaccttatcaattatgactacaccatattatatgactatgcacccttcagaaggaaaggtacattacaggaaaaaagcataaaggattagaaggacaagatacaccctaggccaacccaaccagcaaagcgcaggttccctccattttaaaatttgtcatttaatggacattttctggctctactatttttgcagaacttcttcaggcattctgattgatttaaaaatacattaatctaagaaacttgcaaactaatcctatttcctctatcctaagagatataacttgatttgaaaattttatttacagtggtaggatactgagggaagacagaaggattcaagatgagtagagatcaaaaagcacatgcatactatgtagtcataaaaacttttttaaaaagaaaagcagttgcaagtaatataagaaaattaagaccttccaaaacctttcccaaccccatatcctagataagggttaatacggcaagcctctttaagattaaaatgttaaataagaccaagaaagctgttgatatctctgcgttaccaaagtcagctttggtttaaccacacttactgactgccaagtccctttcttgttcaaaacagtagatggccacattctacaaattctggaagtgactaacttaaaattctcaccatcatcagtacgcatgccctcagcagttatgtccattctttgtatccctaggctctacttaaaacctccttggaaatcagcttaaagtgaagggaagaaattcacaaaaattgaattttataagcatactagcattggaaggaagggtctgatccccagttcaactgcctacccaatccaggtttgaatgccagttctaatgtctatgagagagagagagacagagaaacacaaggagacacagagacacacactaaaacttgccttgtataccaaacaagaagattccaaaagctacatgaggtacgtaaaagatactaaatcctttttaaagggagattttcaataactgggtggataggttcatgagttcgagaaagacaatgggaagaagcagagtagtaggtgtataacaggtgaggctgctcttgtctgtttaaatattggggttccatgtaaaatttttgtttgaggaatttcactgtttttatgaagtttaaataccactgcgctatttaactttgcttagtgataacatagactctaatactgatcatattccccaatgatggggaactcactaccttacaatttgacctgttcccctgtggtcaagtctaattgtttatgaagtatttccttatattaagttgaatacttctgtaatgtgtacccacagtgccagctcaggattcttaagtacagcaaatgctgcacccctcttccacaaaatagccacaatcaataagttctctaaaaatattgctattatgaaaaagaacaaaaaactaaccaggcaaatagatcagtaggaaaatatcccaggtgttcgctgtaggacctctgcaggggcaatccaagttcttcaggcccagttgcgttttcagtcttaactgaaagttttgagaggggaactatttatttctgaagtcacttaaggagatgacgctaatcaaacacacaagccccaatccttaatgcagttgtcttttactcaatagattttacaaagcagtatttttaaaactgaaagcaatttatagatttctgtgaaatataaaaccacctaggttagaaagcaaaaactaaaatactctatattatttaccccgggatacctttaagccagattctagtcacttagtgacaggtgtgcttaaaacacattcgactgagttatttatcaagttcctatttataggtaaatgtcaggagacaaaaaacacgcatgagtcttcaacaagcagctgcactgtcgaaatatagcatctgaaaaaaattttttccttttttgcagctgctcatccttagagcaaagacgagacaactggaagcagacatggtcatgaccaacagaggggcatgggcaggtgacgagcagctgctctatttcactgagaaccaaataagaagaggttgcaaaagccctcggtcaccaaagttagccatttccaggaagaaccacaagggctgggagccactggaatgtcacaaacagactcactcatctgaatatttaaaaagaacattaaaaaaggactgttaaagtaaatctcatataatcattatcaggagaatccagaaaatgtctttcaggcccattttaagaaaaaatcatcttaattttgccagctttattaaagtataattgacaattcgaaattgtacatatttaaggtgtacaacttgagttgataatatacatatatattgtgaaataatcaccacaatcaagttaattgacatatctatcacgtcacatcgttaccttttctggtgatgagaacacgtaagatctaccctctcagcaaatttcaagtagacaatacagtattgttaactatagtcacactgtgtatattagacccccagaatttgttcatcttatataaccaaaaccttgtaccccttgaccaacaatagtcccaatttaacatcatcttaattttaaaagatttcttatttagtatcccaggccgagaaagaccaaaaatagtcactgaccaataatgattccagtagaatttaatttccgtaattggagtctgtcctttcacaagccaaatgaaagctagtttaattaaagtgtttagatactggtgatatgcttaatataataggcaaagagtttagaaatgtgaggtctaattgaagcattgacattaatcctctgcatctaaaatctgaaacagaaagggcaaccaccctattaactttaagaagtaaaataatttctatgcaagtgttttgcaaagaagaaagcacaatacaattgtaggttagggcccctggcttttagataatcacacaatgacacagcacagttaattccattttaatgagtaagaaattatggtagctaggctaccaaaaaagaaagaaaaacagtaacacaatgctgcttcaaccccccacccaaaaccctgtgcctaccgcagcactgtatttgcccttgggcaacacattctaaacctctgaagatgtagtttttttctttccaggtaaagaatacatatttctccctttattttatttatgcttgtttttgtcagaatatatgagcagagttttcaaagattttaattcaaattttgaaacctttggaaattttttactcaccagtgtttgagggacatgttgtccagtattttaccacattactcattttttccattgtcagtggttcagttaaagcaatatccattccatgccctgaaatacaacctaagaatctttatattaaatattgaccttatagtttctatttagagaaaaaacaaatactatatttagcaggtacatacctttaaaattttcagggattataaaaacaaacagtgaatgtgtatttttctttttgccaaatctgagagaggaaagaaaatgttaaaatgaagcaaaatcattattcaaaaaattgagattcaggagtttagcttattaggaactaactacagtgattttcttcatttctttagaatttaaaataatatcattaatatggaaatttagtaaaagtagcatctcaaatcagtgaggaaagagatgaatcactttttcttaaaaatgaaaaaaaaaagcctaaactttatccaaatttttggtcagatcatcagtttacaagaattttgtggaaagaaacattttaaagaacatcatgggaatgaaacaagcagaatctagaatggggggaattctgtaagacaaatgactccttttaaatatatatataattaaagaacaagacaagaaaaaggaaagttgaatcctgatttgtataaactcacagtttaaaaaaaatcataaggataagcagggaaatttgaatgctaatgggatatttgacaatactaagaagtgattactaattttcaggtataatatgggttttgtggttattctctgagtcctcaccttagagaggtaccaattaaagtatttatggatgaaataaaacagtattttagatttgtcttaaaataatccactggtgggcaggggtgggaaggtagggagaaacatgatgagccagatgtgggtaaccgctgaggctacattatgggtgtattattatactctctccccttttatttcttgaaatttttcaaataaaacttttttcttaaagtggcattatagttcactaaactcagtacagtaagtctggaattcgataattggatggatactgagccttggcattagccaaaatgaaatgatttgcagggagaatgtgactgtgaaagagattttaaagagaacagtttaaaactacctaagaaaagcaaactattctcaaatactttaaaacatcatttattagcatgtggttacatatggttattatttatttattaaaatgagaactgggatcacccccactgtataacattgttagtttatcttacatatgcatttggaagtaagtatacattctatatttcaaattacattatatattaatataaatttatatatctgagtcatatatattgagaacctcttatgtgccagctctgtgctaggctctgggggatatcatggtaaacagacagacaaggttcctgctctcacacagctggaggtcttggggcaaaaagacattaaacgaatcattatagataattttatggctgaaaatgtgtccaatgccaggaaggaaaaccaaaagggccaagaggagtccacgtctgggcaccaacctgcctcagcagccttggggaaggcttccaggcagacaacccttggtgctggctagacacagaaaaggctggggagagggggagggcagaaagcagatgtgcagcacagaacactctgggcaaaaggcacagcatatgcaggagccctggggtggtcgagaacaggtgagtttgagaaggtacaagatgtccaggaaagctctggcacagggcatctgaggaagaaaagcataagtggagaccaaagagcgagggagggctgggctctgctcacagaaggcctgttaggccacaggaaaggtttggtattgaagaaaaatgggcaacggaaagctatgaagctcaggagcaaccaacacaattacatttgcattttagaaagaccactctgcctatgatgggatgcgctgataggggtgacacaggtggactggaaagaccctagggcagtgatccaggcaagagctgatggtaaggaaagcgggcatacccgtgaacctttggtaaagttaaatatttcagagtatttactaaattaattacttcagactagcaggattattaagaaaatgtgacaccacattgacatccattcagacttgattctgtgctatgaattctggggagtttaggctgagagagaggaaaggaaagaatatatggtttctatgaggaaatgagaaactcagaatattatcatcaaaataggcatatgcaggagggaggatagagtttgcctggccaaccaaatgtggaggtaagaaaggcacttcctacactggtgtaggtggtgtggtgacacagagggaatagggggatcagaatgatgcctgccaggatgtcagcatttcatatatatatgaaaataaatatatacattttagacagacagaaagatagatagatagatagatagatagataattttttttttttttttgagacaaggtcttgctttgtcactcaggcgggagtgcagtggcgtggtcaaggctcactacagcctcaccctcccaagctcaagcgatcctgtacctcagcctcccaggtagctgggactacaggtgtgtgccattacacttggctatttttttgtatttttagtagagatgggttctcactatgttgcccaggctggtctcaaactcctggcctcaggcaatcttcccgcttcaacctcccaaagtgctgagattacaggcaagagccactatgcctagcctcgtatacatatttttaggtgatgagaaagtgtggattataacggaggtacagacaacagaatgaggaaagagaggtgaaagggaataatggactgagcagatgggactgaaagaaaattattgggtagtttaaatgttgaaataaaaaatactgcatagtggattcaaaaaagtaaattatcctaagttaaatacagttaaatgattttttaaaaacaggttgtttgcttttagaaatcttcctatgtccatttttgaaaacccgacttttcaaaaatttgaaaattaattttactgacacaaaaatatgtaagatatggatatatggatttatatgccctgatgactttcaaatttcaagctttacatcagacaaaggtgggattcttggacttttgttattagcacagaatcaattaccaaacacacactccccctgctatatagggaactcctgcaatcgataagagttcccagaatccaatactctggtcttaagctcagctgttcattcacattccctacaaatcaataagctaaaagagtttctagtttctaggatcaaccagaaaatgttctctttttttgtgaatgaatattccttgaaacaaaactaagcaatgcaaaaacaaaccaaaataaaaatcacttttatccacaccaactgatagtacttcctcttctatataccaaaatcaaactgtaggctctgagaccttctcaattaatgtctcttgtgtttgcaatttatttggggacaatccattttccctcatgtttcacgattacgctgtttaaatgtcatgatgtttcctgaggctacacctcacttttgagattggatactgatattctgggttccattcctatgcctgcctgcagtgccctctagaactggagccagcatcgctcaacctgcagcagtacccacccactgtcttgcccccatccccggatctgtctctggtagctgaaaaaacaaagatcatatacaagtgttttgagctgagttgtacactctgctgatcaaagggtctcaggaaagccctggcctctgaaatctatcatctaagagggccaaagggtgttataagtccctatgaagcctgcggaaatttctacctttacttctcttagagccataaggatttccagggacaaaagccagtatcatctttgggttgtggttttcttgagtacagttacccactattctgtccgtgggctaaatgcggccaaactaacctggtatgacctacatgggacttgtaacaaataatgttctttgttaattacttaattaagctctgatagtttattctggctaatagtgaagagtggtgtgccctgttcccactcggctctcccacagagctcctgctgcaacattcaccatgtgacatggtgctagaagttataaagacctggagttgtcttcagttcctattcacttcctccaccaattcgtaggacaaaggttttagtaaagctacttagatgttttgctgttactgtgtttattgtcgaatattcagaggagtaggtcatgtaaactacctagtaagatttaatgagttacattgtcaagtcaaggatgtcttggagacataaaaggacaacttgttagatctccgtggctcacaagattgggttttcttagtgatcagttagctggtcagacaattaaagctacatggggaagaaatgaaatcagattcaaacttgatttgttgacggagcagatggagccacatcctgcgttccttttctgttgctaaactgctctgagctcatgagaatcacagaattttaactgcggaaccatttcattgagaagaaaaccgcaactccccatatactgacgagtttaaaacatatttaaactttctgtacctgtctttggaagataagtatcaggatgtgtctgaattatcaagtatctgccctttgagtatcctcaattgtgaaaacttatccaagccaagagtgaaatatccctggaattctggagctaagcatacgaatcctaagattatcttaaaatatgtcaccactaggtagtgtctgagttcatctgctcaataaaaatatactctttcaatacattcttgagatgaaaacaaattaggcagtactatcaggaacgttaacctataagtgagatgtgccataattcttgagaaagtctgtaaagtactgatattttatgcatgattaaagtcagtgaatgattagcacctagcttaaaacatagttttgtaagattaaatttaagaatcttttaaggaagctgctttcattttattctaaaataaatctaatattatagctaacaggctaaacttcattcttattttcaataaaaatctatatgtcttacagatgtatagatttgtgatcatgtgctctaatactgaacatatatatggccactttcattctatcatcaattcctcattcattgacaggagacataaagcacccagagaaacaagagtaaggtacgtagttgtacattttcctagacctacatagcttttgaaatattaccagacaacaacaaagatctaaagagaaaaatttaaaatacagcagaagaaaagtagagccaggcttttcattttggtttagtcattaaatattagcccaaactcaaaagatgtagtgctttaggatagatgaaggtttaaactccttacaaatggggcagtacatgtacaagactcattaccataagaaaaactataggttgaaaactggaaacatcctctacaggggtttaaacaattcataaactcataacaattctgagggcaggaaaggcaacttcagagacattcatagcctctgaggacagcaccatgaaagcaaagcttacacaccctcacacacacacacacacacataaccaaacgactctgtccccttgcagagaggagcaaaaaagctagaaggcattgcctgcctaggatggcgcttctcccacccatccatacaggcattcactggagctacagcaaggcagataacacctgctggtagtcaagaccttcactgggtgttgggaatagtgcaacaggagacaaacaaggaatacaagtccaggtgtattccacaaattatttgttttctttcaaacaaatgatttcttttaaggcaaaataacagaactaccgtttgcatagctatacacttggtaccttcatctactttcttttctctgctaagaaatcttaagctatgttactcagggcaataaaagctgctgaagtgagtatcagacaagaaattctctcctctaaccttctaggttttaatatctgcagctaaacataaagctggttcttaaacagaacttcactcttatcttgttcaaaaggtggctctgatagtgagcaaatgcaaagctttactccattcagagaggcatagctagggtcctaatcttggaatgaagagagagaccagccatattgaattgtctggggctctttcaaaaccatatctatgtttgatatacacccagcttggcacatactgaacctcacaggtgaaaaagaggtggtttcaatacaaaagtcaattaattacagacttctagaaagaaaatgaagggaagagtagagttctcatctagttttgtaaaaatgagccatgtggtcttaggcaagtcacttcagcctcagttttctcatctgtcaagtaaggacaataaaatcctgctccacctgcctcatgtagctgctgtaaaaaattttaaaatatgatataaatgaagtattatgatgagttcccagccaagggaactccctttttttaaggcttgtaataaaataagcatattctcagaagtaggatagtttacaacaggttttagaagtggaattcactttgaggtagatagtttgcctgatgtgtctagagttcatataccttgtagaaagccaaaagaaatgcagaccagttgttctaagaaaccccaagagtagtatctgtctgtctgtctctctgtttaataagtaacttgatggcttgggcttctcatttcaacctttcttttcccttaacatactttgcttgcctgtttattcagggatcaaaatattgtctctgaattttttagccaaaaaagaggcttatcttgtaatgcagagaagctctcatatgttccaatataattgacaattccactttatctattaagtatttcatggaaggagaacaaatttgctctgatctaaccctatctaaatacatcctaagtggcagggaagaatctaactctcccaccactgggctccaattttctagagctggagtgggttaaaaagaagcagaacttggctaggcatggtggctcacccctgtaatcccagcactttgggaggcctaggtgggtggatcacgaggtcaggagtttgagaccagcctgaccaatatggtaaaaccccacctctactaaaaatacaaaaattagccaggcgtggtggcacctgcctgtcatcccagttactcaggagactgaggcaggagaatcacttgaacccgggaggtgcaggttgcagtgagccgagatggcgccactgcactccagcctgggcaacagaacgagactctgcctcaaaaaaaaaaaaaaaaaaaaaaagaaaagaaaagaagcagaacttatgtggaactgcaagacgaaacaagaacactggaggtggtggtttctggacccagtgaatccagaaggccccatggctccaggagacacctcagtccccagctaacaggacagagagctaagagtgctcacttccttattagtgtctgccactacaattaatgaactctggaaagatgtaccattttaatgatacagttattaaaaaggagtatgtgtgggaataatgtaagcattgcatactaaataaatttctatgacaaattgattcttacattctaatccgtacctattttcaagttaaaataattccttataataaaataccacaaactggaaataaaaacaacatgtacatagactctccccatgaaaatatccctcattttttttttttagaaatagcatctcactctgtcgtccaggttagagtacagtgacatgatcatagttcattgcagccttaaactcctgaacaatcctcccacctcagtcctcccagtaactggaactataggtgcatgtcaccatgcccggctaattttttaaaattttttgtagagacagaggtctcactatgttgcccaggcaggtctggaactcccgggttaaagcaatcatcccacatcggcctctcaaagtgccaggattacacgcatgagccaatccctggcccctcaatttgaaaagtaaaatagaaatatatcatctttttaggagtttttaaaaaatgggtttttaaaaaaatgattctaaagatacagcatcaaggcttttgaagtttacctaattaacttgatggcttccagctcctcggcacttagtgaagaaggcaccttcaagagaaccatgttgaatatgcaatcatccaaaagcgctgctgcctccttcgtgtcactgatggtgatggtgacttctgctatgtttgcaaatagtttctgtacagtatcagccaggtagcccacagtgacatctccaactaataagatgtctatttttgcctgaaagagaaggaagcagaggcgtcacataattattgcctaggcatagggaaaatgtcatgtatgagaggataagataaataaagctcacaaataacacaacaattgactccatatctagtctgactggctagatggtcaactataagcagctcaaggacaggaactactaatttcacatcttcagtacctagactagtgattagatctgaaggtcaccctgtttttaaacattttgcctaccaatgctattctacttcagtttttctgcaaatttctctctcatcctattaaatgatagagttcttatgactcagttttccaaaagtctttcctgctggaaaatctgtttattgctgaaaggatcaaagtcatgactctcccacatgatttattttggtgaaacacacattccagggaacagagaaagatttaaattcctaaatcataagaaacactgaaataaagtcctttcaatggaatatatgtgctattcaaacctcaatattaggaaccaaaaaggccatttgcatttggagatattttcaagtatattcaattaggaaaaagagcattcccaacttcatgttttatttctgtatgttttattctctacagctaatgaactcaacccactgaaaatgccaaagaatggggatgcttaaattaatggaaatagaagacaattggaaatgccaggccatagacatctgtatgagaaaacagatttgggaggtgattagagttgaagctaagagtgagggaaggggctggaaatacttgtacaaagagaaaggcagcttggcaaagaagcaactccacagggcaggatgctggtgtaagtggccccgtggggcttccttctcttttcagcctggtttcctgagggttgcaagaaagaacaggtgaggtgcaagaaactaggcaatagtaaagtaagcaaagctttggcacttccacctgctcacctaattttcttccttttttttataaaatagtcaaccttcctttaccatctctcatatcctaattcaatcccttctctgaaaggaactgctgtcaagagtctggtgtctatccttccagatgatttttgtgtcaaacatataagtacgatacacacatacatagcttttcataaatgggctgttagtattttttgaagtgagttgcttttttcatttaacaatatagttcaacaattcctcaaaatttctgattcactgggaacattctcattttccaggcggttatagatttattctcataaaaatacgttttctattatttgttgggatcaggggtaaatgtgctcatctgtcatcttgatccagtcttccttattttcgatgatgacaattgattgagacattctcccagtgttgggttttgatgttattacggtgccatgatgaatacatttataaatacatctgtgtgcaaataagcatatatcctcgaatccaaactagaaaatcagaaagtaaacttttacttgttttgcatactccaaaggatacaaaaatttatatccccgtaagcagtatatatgagtactcatttccccaaacccttaataagactgattattcttaacctttaaaaaaattttgtattgtgagcaaaaaatcttatcctttttattggcattttttgaatgaatggagtaccttttcattttagtggcaatttgcattttattatcacatatttatcatgcatgcccatttactccctttgctcaccttcctatttgtggtttgtatttttcttattgctttgtgggagtttatacagtctggatattagtcaaccacttttttttccagtctgtcactctgcctttaattctttttttttgtttttttttttttttttgaggagtctcactctgtcgtccaggctggagtgcagtggcgtgatctcggctcactgtaacctctgcctcctgggttcaagagattctcctgcttcagcctcctgagtagctgggattacaggtgcccaccaccatgcctggctgatttttttatttttagtagagatgaggtttcaccatgttggccaggctagtctcgaactcctgacctcgggtgatccgcccaccttggcctcccaaagtgctgggattacgggtgtgagccaccgtgcccagccctttaattctgattataaggtctcttgtcactaataaatatttaatatttagtaacaaatctactgtttcctttatggctttggtgaattttatcttgctttcaaagccatctccatttatgttaaaatatgctttggtagagtattctaatacttttaagggtttatttttgcatttagctttttatcccagctggagtttatttggtgatgaatatgaggtaggtatctgctttcagttttcttttttaaatgcagaactaattgacccaacaggattactgaacagactaaccttctctcagtgttttcaagagcgaagttttcacaatgccaggtaggggtgtgtgggggtgtgtgtgtgtttctggacttcattctgatccactgatctatttgcctattcctggttaataccacactgcttaattactagctctttatagtgtgttttgatatttgacagagcatgtttccctgttatttttcaattcagttattatatattttccaacaatttctcttccaacagaaatcggcatcagtttgtcaaggaaccttgttaaagttttaattatggtggcctctattttaacagttaattagaaaatattgttgctatattaaatctccgtatttaggaagtatgcatcttagagaatttgggtctattatgatcttcagttttatggactttcatatcgattttgcatgtgtcctagcatgtattcccagatatgtcctacgtattcccagatatttcaacctttggaggtcactgtgaaggggatctcttcttactcactacattttctgattgattatagctgacatatagaagcgctattgatttctgtataaggaacttgcttcaagtaatgcactttatagtactctctgttcagttccaatacatttccattgattattctcaatttcctaggtaggcaatcctaccgccttcaaaaaattacactttttttctctatttccagaacttatgccttttatttgactttaaagcattggctagaacatccaaaacaaaggtgaataacaggagtgacagtaggtgttcctgtcttgttcctgactttagtgggaatatttcaaatcattttactactaaatatgatacttactgaagatttctgatcaatatcctttatcagttaaaaaagtttctatttggaagctaagaattttacatcagaaaagggtgttgatatttattaaatgctttttcagtataacatgatttttttttaattctttgatctgttaggcagtgaatcatattaatagatttcctaatgtcaagccatcacagtattgctgggataaacctattcataatgtgtaatgaattcaatgccttcacctttagatttttgcatctatgttcataaatgaatcttgatataattttgttttattgtattgccttatcttgtttaggtatcagggttatgccagccttgaagaataaaatattgttctatggtcttgaatagtttataaaacacagaaattatctgcatcttaagtttaggtaaaacatgtctagaaaatctggttctgaagacatttatagagctggatcttacatttcattttatagttccttattgattaatggtaaattgaagtttctcaccttctcttaaatgaattttgttcatatacattttacaaatccatttcatatggagtttttatattgtttaatgttttaattttaaaatatatatataatacctattactggtgttgagttcattttgcttcttaactataaatgtttatttttttctttttctggtaatgctttattgagaatatagaactgtgtagtccaatacagtagccacatgcggctatttaaacttatgttaattaaaattaattaaagtttgaaattcagttcagttgcactagccatatttcacattctcaacatcctcatgtggtaagtgtggattatcagacggtataattacacaacattttcatcattgtggaaagttctattgggcagcaaagtagaggatctaaattttcctcctagtggcattttgttgtaccccacacatttttatatatagtgagttcatgttcattcattgctaattagtttataatttcagttgatagttccattttaatctaagacttttattaaatacctatataaaggtgtttttaattttcaaggcaatagtatgtttggttttttatttttttgactatttgttagttgctcatttcttatttcagtgcattgtcaacaatgaatgtgtcctgcatgacatctactttttaaaatttgttgacattttcttcatagcctaatacacagtttttgttaatcgtccatgggtacttgaaaacaatacctgttttctgttgtgcataaagttctatatatcttttagaacaaaattgttaattctttctttgcttatattaggtctacttgatctttccgtttatgaaagaagagtatcaaaatctccttaattatggttttgtcaatccatcaatttctctaatcataggttatatttataattatgggttaagtacataaaggttcatgataatgatattatataaatatataactataatatttaacaacatatgtaatctatgtttacatagtatgttattagtgtatatatatagatgattctatatagcaaatactactatataaaacatacctccttgccctttaatgtttttcacctcaaattttatttttctgatatacagcttagttcttcatacccccttattttaaacttttctttatcatcttttctgtgacttttgtaaatagcttttaattgaatttacagtttttacaagctgatctttcagtttttaatgtatgaatttaagtaattacattactgacattaactagtgtacattaacttcattaatgtaatgtaatgaattagctaatatcaattaattgtgaacatttacaatttaatgtgaaatgaccttattccctttcatttattatttcaggcttcctatttactgtaattttttttttccatagctactcttaggctgatcaaattttcatttttccatcctgttgttcctataatgctttgggagtgaaatccctaatttttataccttaagtgcttaattgtctttttatttggaattaatttgacttacagaagagttgcagagagggtatggtgagttctcataaacatctgactcagcttccccaaatattaacatcttacaatcatagtatgtttatcaaaactaagaaattgtgagaaagaaaaccctaagaaattaatattagcatagtactattagctaaactacagactttatttgaatttcaccaatttttccactgatagcctttttctgtcccaggatcccatctggataataggttgcacttagtcctcgtgtctcctagtttcttctaatatgcaatggtttctcagtttttactggcttttgaggagtgctggtcaggtattttgtagagtgtcccactacttggatttgtctgacgttttctcataattagactggaactatagattttgggtagaataccatggacatgagcgcccccttcttatggtgtcatatatcaatgagagatttccagggaggttcaccttggtcgcttggttaagatggcgtctgcaaggtttctccactgttaagtcacttgtttatcctttccacattcttgttttcagaaggcagtcactaagtctggccacactcaatggaaagggactaaagtaccacctcttggagggaggaatatcaaacaattgtggatgtacgttaaaaccatcacagtaattaataaatatgttagtggagatggtttgaggctttgcaaatatcccatttctcctgaaagttataccctctgttcctgccctttatttgtggatcttgcctgtagcaattattactatgacattccattggtgattttctatttccttccatctacatttatgatttggaaatcttatgtaaggaggatatgttccttttccctcatttacttatttagtcaattgtttatttaaatcagtaaggacatatttattttattctttgggttacaatccaatactatcatttattttgttactcaaattactccactttggccgccaaaatttcagaaatacttaattattagtaagtatacatagccattttcaattaagatgtagagttaatctaaatctacagcctctctccaaacaaggcagcatccttaacatgcctccctccaccccatatacttcccaaaccatgactatctggaattttagttccaatcattattaaatatttacatttttattaacatttacacttaattttttgtttctctgagtctcacagtttcttgtatctcatatttgcttctttcttggattcattttactgaattgccgtacaggctcagaaaattatttaaagaccgtctgatagcatcagagtcctaccaagtctgaaaacatcttcactgtgctctcacaattcagtgcaagttttacccagcaaatacttataaggtcaaaatcactttgtctctgaattttccttctggaatccaagttgctaatgaaaagaataagctgcttcgttcctttggatgcttttctcctctttttcctctgcattctgatagtttctaggctgtgtttaagtatatatcttattcatcctacttggcacacagtagctctgaaaattttcttctcttatttctttatttcctcctttctgttgtctttgtctctccttgtaaatcttctaagagatgctggatgtcttaaattgatcctacatgccttgacttctctctcagagatttcttcatttttcagattaccagcttagtcttcactccttctaagtatttttttatataatttcaatccatttaatgtgaattactaatttctaagattttttgggtaatttttcataacctgctatttttaggatgtgatattctctctacagatacaaattcaaattttagaagttttttttttttctattcccttatgtcctagtttattcaagctgctataacaaaagactataaactgagtggcttataaacaacagaaatttatttctcagctcagaggttgggaagtccaagatcacagcactggcagattaaatgtctggtgatggcacaatttctagttcatagatggcaatttatttgtgttctcacatggtggagaagcaagggatctttcttgggcctcttttataaggcactaatcccattcacaagggctcctcccttatgacctaatcacctcccaaagaccccacctgctaacgccatcaccttagcagttaagatttcaacatatgaattcggtagagggcacaaacattcagactacagcaccttaaaaatctgtctcttcaatcgttcagtgtgtgcattcgtctagttctgttaatgtctgtcaatcctttgtttccaaacataaatatgaatcaagaactaagtgggtgtgaacaggcagtttctcctgcagctgaggtggtgtttcctcagtgggggcctcctttaatgggacaactgactatgggtttggtgagagtgagcaggatgagtgaaagcaaaggctggagagcagaaaggctggcgccagctaattgtcaaaatcaaggtgggctctactctgaagaccaagtatgttagtttattttcctcctggaaagaactgcctttcctttcctctttcagttacagagatcgggaaattactcataccaggagtcctcatctcatgtatagttcattttctttagagaatagttcctgagttttatccttaagttaaaggcaccattgctcctgctttagtaggagtgagctgggagagtccacagggtaaatccagggggccaacctggcctgggagttctgtacccagctaattcaaaccaggtgagcaccctttgggctactttcatctttgtttctgtcaacattgagcctggactatcactaaaattgttttatcactgcatttcttctctttgtgtcttttaagctgtggattttctacttttgttttaggtgtaattggaccccatttgctttctaaatgtcacattttactgtgtatttttttttttaacgttcagagagaagttgctttgttcaaaccaagatcccattaagaactatgcattgcatttggttgttgtatctccttgatcttttaatttggaatacctgccttcttatttttccatgatatttacttgaaggaatcatcacattttgaaaacatctgctctggagtttggggtagatggggaggttgacctgtgtgctcaatcatcatgagccaatctccttcacctgcagtaccctactctaaacaggataccaatttaaactccttagcatggtgtttcatagcctgctaccaacctacttcaaacttatttccttctacttccctcaatactctatattccaagaacacagcacaacacttttaaatgagctttgaaatatgtaatttctacagtagagagcgttggggccctactagtgtgtttccttttcattttataaacactcctcatttccagcagcactttaggagcagcatgggactctaagcctttgtgatgcctgtgagcgcagattgtttgcgaatctccaccatagcatgtgatttcttctatgcaaatatattctttgtgaacccaaagccaaacaatgaaacagtcattaacaagtgatcacaacaggagcaattatagttttgttttttaattaacctgattaattgaagcgaatatgaatgcccaaaaataacctatctaatacgatcagggtgtatggccatataattgatcttccaaactgaggctcttttgagaatgaaaggaggtgccattaataattacactaaaataacacatataaactagggtgtcctgggatatagtttgtaaaactttctattagtaaggtttattttttcttttaaaatatcctgccactttatgtctctgcttaaatatgcttgatgtttattctctccatagatatttattgagcccttactatagggcagacacagggctgggcgctaggagcacaaggtgaacaaacaagacaaggtccttgccctcatggggcttacattctaatagcccttttctctgctgataagaaagcatggcattcaatccttggaatataggaagaatagagtatgaccagttctactaagggtgttatcttttttcaacagcttgatgcagtgggaagggagcaaagccatttgaggcagacagaccacagtcctgtcacttagttcaactatttaccagtggctttgaataagacacttaagtgaccctcgtctgaaggatcaaaatgcttacgttgcaagaatgttatgagaagtgtttgtatagtgccctgcaggtggtagttattgccatgtttttgcaagtaataccgaactgagcacaaagaacacagaaaacgtcaaatcaacctagcaggggaaggaccaggggagagaggaaaatgtgtccatgctgggctctgcactgtttgaatcacagtgctcaggaaacagggcctcctgcagagcataagctttaaaataatagaaatcaactgcctagcttgagcctttccctagctagcacatggcattctgactgcactatcctccccttagaggctcagttccagtgtccccagaatctctcggccttttggggggaaaaaaagtcaagaaagagttatgaagggcagaacatgcatagtgggaagtcgggagaaatctgagggtaggtaggaagatgatctggaaagggatgaggagaaacaagcaccactaacccaccgttctgtgcaggagtctgaagtttttgcatagcatcttgcaccatggcacagagcgggtatgacataaagcagctctggaaagaactgatttgctcttttgccaaatgcttctttctctgctttacaaaatcagtgccatagcacacttggaatgttaatggacaaatcagaacactgctcaagtccactatcccagttccataactcaaattaacagaatagtttataatcaacataaatctgaatatttatttagtttaaaatatgttgttgacaatgtaatatgaacacaggcgataaaaaagatctattgacaaaaagaaaaaggaataaatgtttctagtatattctgcttggaaaactgccttttagtacatctaagattttcacctgcaagcagtaatctgaaccagtgttaggcttcgtttgatgaaatatctttttctgtttgaattgcttactacacctttgtaaacgaaagtaacatgtattcactgggaaacactaaaaaattcaaaaaagaaaataaagtgtaattccaccactcagggtaagccctattaacaccttggtacataccctttaagtgtgggtggttttaataacacgacatcattgtcaccaagacacttcatccactgtttcatttctgtgatcacagtaacatgcagggcactctagtctctacaatttttaaaacactggatttccatttgcaatctgtggcaggctaaacccttaattagtaacagcaggtgctgaagtgcttaaagcaaatcactcctacattttagtgagttgttatttatgtcactcttatcaccaggagcagagcagcccacaatcagcagcagctgcagggctgaggctctcatggggcaattgcgggccttcagtttcctcaggagtcaagggatttaaacagctctatctggagaaactgagcaagcggcttttctcacaaaggcacacaaaggggtcagttggggcttcacactctcttaaggggaggaaaccacaattatttatgttctactagataatcagatatttcattcagaattcattttgtgcagctttgcctaatcctgcaccataaaatactatttttccttagagtttaaataggttcctctatcttgaaaaattaagaaaacctgttaaacgggtccacttcaaagtgatcctaattccatttcagaaagcttgctcttaagaagagatgaaattaagtttgcagagcattctaagaggtaataagactacactcagcacaaaagattgctctctcctatttatcaagatgcggaaaatactaagatgaaagcccccctccccagctggccttgctttctggcgtggggaggtttcgcctacgctttcctcctagtggggtaatcatcacctttcacttttatcgaaaacagttacaaaagtgattttgtgctttgctaaaggggctgaaaaataaggtgctttcaagagaggccagcgggctttttgatttccatggaggtggcaaatgcgtgcagagcaggtcccgttcccaccacggctttggttccacacaaagttgcctgtttggggggaagctccacgaaggacactttgggatgccacgccagtgcccaaactgaaaataagcatgcccagctgtgcagagacgggaatgcaggaaaataacgcgcctaaataaactttcttatattaaaaataaaaatcatcgttcacatttttgtccagccaccagccccagagtgcctactaaattgtgtttctaggtagctaacttcacaagtggccttctgctcgaaaaataagttggggaaacgtcaagggctaagattttttttttttttttttagttggagaattcacatttattgagtaattgatgtgatgcaatctgcaatttttggattcaagataattttcactgaacatttcatcagttaatgggttttctttataacacgattcagttctctttcttccttggcctcctctcccgagataaatcagccccgtcccccaacctcaggccccaagggcctggtggcacccgggggcaccctcagaagccgggtcggcgcttccccagctcggggcgccgggggagagtggactcgcgtcctggaaggggcccttcctgctattcgctccccacagttccccgacaatgagagctccccaggccgggctttgagggccgaggggaccaccgacctagggcccgcccgcgaggttataaacgcagctgcctccccttccacagcctcttacctggcccgagatctggcagtgctcctggcagataattgaggaagccatggccgctgcgcacgtgctgggtcctggggcagcctcccagcaggaggagctccacagccgctgcgtcccgggcccgccccctgcactaatggctcctggccgcagctgagggcgagcacgccccaggcgcccttaaagtggccctgtcgccagttctggcgcgtgggggagcagcaggccgctctgaggggtcaacgcggaacccgggtcgggggcctgcccgcgggggctactcaagctgtcctgggggcccttaggagaccgcgtcactagctgactgcgcactccaagtccccttcccagggcagctctcacgacactaagccccgcgtactcactcccactgcgccgcctggggaggcgggaggcaaggcgtcatctcaagatggtctaaaaattttaagaagtcttttcttacgggcagtctttccagtttaaatgttaggaattagcaaacacttgggtttgttttgctcttttctaaacaaacataaacagaggataggaaaggcgagtacttctatggtgatttctttccaaaccactaagaaatttaaaatgttaggccgggcgcggtggctcacgcctgttaatcctagcactttgggaggccaaggcgggtggatcacttgagctcaggagttcgagaccagccaagccaacatggtgaaaacccgtctctactaaaaatacaaaaattagccaggcatggtgatgggagcctgtaatcccagctatctgggaggctgaggcacaagaatcgcttgaacccggaaggcggaggttgcagtgagccaagatcgcccactgcactccagcctgggcgacggggcgtgatttcgtctcaaaaaaaaaaattaaaaatattagaaacacttcatttttgtgccgtgatttaacaaatactgtccctattttctcaacggaaacaatgaggcgataaaattttctcgtgactgctgctatgtaaactcctctactcaaccttcactgaacattttactgagacctattgggcgtcagacccgcggaggatccttcctcggatgtgtcttgactactgtgccatgatttttcactgctgtaagtgtggtggttattgtggatgactgcagactctggatctcactagagcatataacacagaggagctctccggggaaccatctctgcaggcggtccctgggcaagtctcctggttcctgagcagctggtgctgtgtcctgggggtccgatttagatcccgggggcatgcaaaaatacagctgtgatactctacagttctgatgggaagaaaaggagcagatgaacttctgatgggatcattctgcattacttttggaagtgtacacgtcttaatagagtgtaataaatttcacttctattgcttttccaattaatcaggaactgacagtatccacatcaatatctgtgcgggaagtggtttgctcaccaatgtaagacagaggtgaagtccttcccaggcattggtgtagggtgtgaattgaggcagctttgagcatttcgtcctgaatgcgcaagcaccagatttccattgctccagaggtctagactagcaagtctaactctaatagacaaagacaatgttgaaagagaaacggactcatttgcttttaagtaaaaaaaaaagcccctaagattatgtgagaggaagtcatcactactgtgttgaaggaagaaaaaaaagataataaacttctcctgtatctagaatatgagtccaagcttcctaagaactaacttagatatttttgtttccaatctcctttaaaaaaaaaaaaaaaaaaaaaaaaaaggtcaggtgtagtggtggctcgtgtccataattccagcactttgggaggccgaggtgagatcacttgaggtcactagttcctgagagccaggacacccctgtctctacaaaaactaaaaaaaattagcctggcgtggtggcacacacttgtggtcccagctactccagaggctgtggtgcgaggattgcctgagcttgggagtttgaggctgcaatgatctgtgattacaccactgctctccaggctggggaacagagggagaccctgtctcgcaaaaacaaacaaacaaacaaacaaaaaactttctttgtaaatgaacagacatctactctaaaacaacatctcttcccagggaagattttgccctccaagggacatttggcaatgcctgaagacgtttttcattatcatcactggtggtgcactagcttctagccagtagagttcagggacgctgctaaacatcctacaatgcccaggacagcgctctacaacagagaattatgtggcccaaaatggcattcgtgctgaggttgagaaaccctactattaatataacccctccaaattataacatagagtgtaagccatttaatttctttggcatctttcacattcttgaatcttgtgtagtggaaaggaaaagatgacgtttggaggaaaggaagaaatattacacacaccaaaatggcaaactcagtatttcaaagccagaactggtgtaaattgtgttgctggttgcatggggaaaaggaaaggtcagttttaatcgtgtcctttccctatttgaaaacgtacaagggtttctctgcttattacaattaagtcccattcctctgtgtggcattagggccacattaccttgtcccattctggctttctagacttaccttcaaatcaagtgactagattagtttctattccctaatagtgtcctgaggtccccccaagagtccccagtataagatttgcacaagcagatagagtaacttctttctttggaattgtagtattgataggataagtcatctgaagcctagaggagccccaagctgccttaaagaatagcacttgccatcacaacagtgtaagcacagtttattggtttgggaactgccctgaatctaggttctgatccttcccagctgctaattcacttatttgattctgagctctgcctgaaaaacatttcctgtcccattatccctgcatcaaagaggcttccacttctgctgcgtgcatgccttctttctgcctctccctcagtcctcctaacctgaaagcacagttctgacacctgcgttgtctgaggtttagcacacctgcttacccctgaatgttatacttgtgcttgcttgggtttctcccacacaacaggctgactcacacttttgttctgtggttagtctgagaagacaacgaaaaattttcaaagtagtactaattccatctgctaaagatttaatattgatgtccccccaaaattcatatttgaaatctagcccccaggtaatagtattaagaggtgggatctttggaaggtaataggtcatgggggaggagccctcataaactggattagtgcccttgtaaaagaagcccgcgagagatccctcaccccttctaccacgtgaggacacagtgagaagatgccatctatgaaccaggaagtgggccttccccagatattgaatctgctgctgccttgatcttggacttcacagcctccagaactgtgagaataaatttctgttgtttgtaagccacccagtatgtattttgttatagcactttaaatagactaacactgtctcacacctctgctcaacaattatgacttgattttagcagcatggtaaggcggagactgtttattagatttcatatcctagtatttagtatacatacagaaggtgataataaatacatgtttttcccaatgagtttagaaccactgcccttaggtagtaacacaggtcaaagaatagtgccaacttctaatgatgccctgcgttagattgcaataagacttgacagttttctcatcattcagtatgttcactttttaaaaccggatttagttctactaaatctgcctcattttaatcacaagtctttgctaggaaatgtagagctaaaccaaagtaacactataaccatggaggagggactgtgtcacacaaagtccacagtgggcctgtgcgatcccacattgattcattttgagtgcatccccccatggtagtcattggttatagctctatggtctgaggagatcacaaagttacaaatgaactcttttacctttagccacagtgacagccaactgcagctgtatgaagtcatgaggaatttctttagcacaaaaatgtcaggccaccttcaaggagagaagcttcttgtttgtaaaggtgagggataagcgggagtggaaaaaatgtcattcacactttactcgtgaatatgttcatgtatactaatatggtttaaaagtcagctgagaggcctggtataggtggctcacacttgtaatccaaacactttgggagtccgagccaggaggaatgcttgaggccaggagttcaagactagcctgggcaacacggcaaaatatcatttctaccaaaaattttaaaaaaaaaaaattaggtgtggtggcacacacctgagaggctgagcccaggaatttgaggctgcagtgagctatgatcatgcaactgcactcaatcctgggaaacagagcaagaccttgtctcaaaaaaaaaaaaaaaagttatctgaagtaattttaatttttttattttgaaaatttcatacatacccgagtatatttattacatatgtattatttaaagtataataatatggatgtgtatgtacctaccactcagcctaacagacactatcaataattttaaaataccttatgtgtgtctctcattcacatttccctgtctccccagatataaatactattttgttatttatttagttttacttcttttcactgctgaagccagaatggattgtgatgtgtgagagaaagaaatctttgtgttaagcctctaaagtctgagttattttttatagtcataatagagagattaataacttgaatttaggtgctgcctaaacaaaatactaatatgtgtggcattaacttagcaggtctgcagtgagaggcacagaaagaaatatgggaggttggaagcctgggatccctgttatgccatagcagaccaagtgcttactaagactgtaggtcaaaggaaggatgttgggaaaacaacgaataataatgtgttgatatggtttggctatgtccctacccaaatctcatcttgaattgtagttcccataatccccacatgtctgggagggacctagtggggagtaaatgaatcatattggaggttacccccatgctgctgttctcatgataagagtgagtgagttctcataagaactgacagttatataaggggcttttcccacttttgcttggcacttttctttcttgctgccatgtgaagaaggacgtgtttgcttccccttctgccatgattttaagttttcagaggcctccccagccatgctggaactgtgagtcaattaaacctctttcctttataaattacccagtctcaggtatgtctttattagcagcatgagaatggactactaaatgtgtactaaatgttactggctgcctttggtaagagagaataaattgatgagcttgcaatatagctaactagtttgtaaggagaaataaaagggaatagagagagtctaggaaagaatctagaaatttggggcattgaagggcattaaagagttggaaaggccaactatttctaggtcccaaaaagaaagagataaggctgagaaaagtcaagccacaaaaggccactaatactcagccttgtggcaaggatcagattatggataggtgttaacttcacatcaccttaatcaattagttaaataacctgcatggtagctgccattaggcagagagaggtatgggccaaagaaacaaatcatgctctgaaattatattatacatagaactggctactattttgatggaatttatataaactaggactaaaaagcctttgaactgtaaaatcagctttagacacccaattttgttcaaacagattatgagctctgaaagctatgcatccccaatagagggcataacctcatcatccacttcgaatgtgggcaagaagatgaaaaaggaagaaactcccacggactggagccagtggctactaagaaaaaatggacaagaacattcctcccaagagcagagtcagagcccaagaaaggaaccgaccccattcccagtgaagagggctttcaccatatcttcccaatgggattttataaatgctgtggatgagtgatgctgtgcgttcttcctcatctgagcaaaggttattatgggcatccttccatgctcacacactgactgctacattccacagttgtttgggcccagcaagtatttgcctatcagattttacagtatttgtactaaggcttgaaagaacagcatcctagaaagacattgatggaaatgcaaaaagattgtttagttaaaaaaaatcattgttttagttatgttcagcagacttgaaaatataccaagttagaatcaattttaaaataccaattgagattcaagaacctgattcagtgatgcagcaggccaggagccatcaccatcaatgaatagctcaatttctctctcatgtagttgccaagaaagatattatctactgaagaaaacctaaatacctgtaagtcttactaaaaatattgtttgatacaagtgagcataggctgactgcttcaaccagtaaaacctaaatctcagtgtcttaatacacacagaaacatacaaaaggatttccttttctctcacataaaaaccaaatgaggattaacaaagtgagaggaatggatgtgctacatgaagtgattcggggacccaattttcttctaccttgtggatctgctatccctgaggccttggaatttgcttttagaccctctatatccacccataacacaatttttttttaaagaaaaagcacaaacaagaaggatcacctgggacgttttaatgggctagtcacagaaacgacatgtatcacttatgtctaggttatattggcctgaagtcagtcgcagggtcacacctaagtgcacacagtgtttcacacgcctatctctaaacacagtagcatacataccacacactaccaaacagtgtttcatgcatatatcactaagcaaagaagtatgtgtgcatcatcacacactggcaaacaaagtgtttaacacatacactttgttatgtatgtgtagcctagttctgtgtcccatagaaaaagcctagttctgtgtcccatagaaaaagaaaacagtttggtgagtgcatagcaacagtttttgccacagtccatcaatttgatcaccaaataaatagcttttgctctttcttcccagaatatacttacctccttgccaaggtaagacaaagccccatccagtcattttatccagtgcaaatttcattgattaaggtgagaaaaatatatttaggtgataacataaaaaaaagttacagatgcatagcaaaatggatttttatattagattttaaaatattttctttgcttttattttaatgctttatcctttacttctggctttgagagtaacaggggaaagatttagcttcttactgtgaagaaacagaaaattagtcaaaaatatatgaaacaactgcagatattgacatgcaccttaagactatgacccctgagaggaatgaagtgaggcccatccatcattctagatttctacctgcaggcacagacctcagagcagggtaggggatcccaaacaaagcatggtggtttcatgtagttgagaagacagaggctggagttcagggaggctgaagtggctgaagttgcagagcagagtaccagagagctaacagatatgtaaaaacagaattccagaaatctgcataggagccccttgagaggtggctggatattaagacatgtaagcctagagcaaaactctacgaggtcaagcagagtgccacacaggcctgtgaggcatctgaggtccaactagccagtgttgagtgtcccagctgatcactcacagaattttctagtgatcccacaatagctatgccttagaaatggtgttaaactctctgtggggtgaagctcactctatacttaccctaacaaaggcttgaaaagaagaaactgaactgcaattaatttaactgcctataagaataaatctataaccaacaatgtgaaatcatcaatgcctggcatctaatataaaattagtagatattacaagaagcagaaaatgaaacccgaaaccaggagaaaaatcagtcaccagaaacagactgagaaatgaaaaagatactgtgtaagtatgctaaaagtcattatatgcctatccaattacttaaaggaaaacataaatacagtgacagaagatataaaaaaagaaccaaaaggaacaatatcaagtggtttacaacaggctgtaattaaagtcccaggaggacaggaaagggcagaaaaataatacaaaaatggcccaaaattttccacatttgatgaaaactacagatataagctcattgaacaccatgcaatataaacacaaaaccaccctaataaaactgattttgttagttattagctaatggcaaaacgtttttgaaagctcatatttatagtctatatgtatacaacctatatggtataatcaacatatattttatggagttatttttgtctcatgttttgttgtgtgataaatgagcagggaattacagaatgttagtatcagaaggcacactgacagcaatcaaatacacacctccaccactgcaggaatccttcgtatactattcctgaggaatggtcacctaatctctgcttaagcaatttcaacgatgataaacttacgactgggtagttctccagatagtaatattttctgtatttctgtagctgagttggcaaattgctttaataaagttaaatgaactctacaaattcaagatttttctaattcatagtcagattaattgaatgttaacctgtaaaaataatgccctactgtcaaatatatgatatgagctcatatttatgtagtgctttattatcttaaaggtactttttcataattcaattatatgtagtgatttcaataccagttttcaatattctggtatactctgccctttttaaataccaaaatcccagcactgttgttacagtttggttattctgatatttaaaatcaacaatctaaattttttaaatattaaattagtatctataactcaattacctaatttatgaacaaaattaatacaatgtacatagtatagaagtctagacaggtcctcacctgtgcacacagcaaaaagcaatcaaatagtgttactgataagcttctgttgcaagaataattcttagttccaaataagtaatttcttatccagtagaatatgaaaataatagtactaaaattgatataggtaactctgctttggaatctcctatacatgctaaaactaattcagatgaagaaaaggtaggaataatttatttgaaatcaatactatatagctctttataaattttttaaaaatccagccccagtcaaaaatcaaaaggtgttttataaatatctccacaaggtcattaagtaaaaaaattggattatttaaatttaaataagtcaaaggaaaatattgggaattagcatgtaatgctctcatcattattgttttgacatcttggttggaaaattctccccaaaatagctattttctattcaacatagtactggaagtgctagccagagcaatcagacaagagaaagaaaaaaaaaaggcatctacatatgaaaagaattcaaactatctctcttcaaggataatatgaccctatacatagaaaaccctacagactctgccaaaagggtcctggaattgataaacaacttcggtaaagtttcaggatacaaaatcaatgtacaaaaaatcaataacatttctatacaccaacaacattcaagctaagagccaaatcgagaatgcaatccaatctacaatagccacatacacaaagacatacacaaaaacccctaggaatatatctaaccaaggaggtgaaagatctctataaggagaactataaaacaccaccaaaagaaatcagacaacataaacaaatggtaaaacattccatattcatggggtggaagaatcaatattgttaaaatagtcatactgcccaaagcaatctacagattcaatgctattcctatcaaactactaacatcatttttcacagaactagaaaaactattctaaaattcatgtggaagtaaaaaggagcccgaatagccagagcaatcttaatcaaaaaggaaaaagccagtggcaacacattaccagacttcaaactatactgtaaagctacagtaatcaaaacagcatggtactggcacaaaaacagacacagagaccaatggaacagaataaagaacccaggaaaaaaaagccacatacctacagccatctgatcttcaacagtcaacaaaaataggcaataaggaaaggactccctattcaacaaatggtgctggaatagctggctagccatatacagaaggatgaaactggacccctacctttcaccatatgcaaaaattacctcaagatgaattaaagatttaaatgtaagccctcaaactataagaatcctagaagaaacctaggaaacactttttttttttttgagacagggtttcattcagttgcctagccttaagtgtagtggcatgatcacagctcactgcagccttgacttgccaggctcaagtgatcctcccacctcagcctcccaagcagctgagaccataggcatgcaccaccatgcctggctaattttttactttttgtagagatggcagtctcactatgttgcccaggctggtctcaaactcctgggctcaagcaatcctcatgccttggccttccaaagtgttgggattacaggcatgaactactaggcctggcccctggaaacaccattctggatgtcggccttgcaaaagaatttatgagtaagtcgcaaaagcaattgcaaccaaaacaaaaactgacaaatgggacctaattaaagagcttatgcacagcaaaagaaactagcgatggagtaaacagaaaacctacagaatgggagaaaatatccatgaactatgcatctgacaaaggtctaatatccagaaactgtaagaaactgaaacaactcagcaagcaaaaaataaccccattaaaaaaaatgggcaaaagacacgaacagacacttatcaaaagaagacatacaagtggccaacaaacatgaaaaaaatgctctacatcactaatcatcagagaaatgcaaatcaaaaccaccataagatgccatctaacaccagtctgaatggctattattgaaaagtaaaaaagcaacagatgctggtgagactgtggagaaaagggaacacttagacactgttggtgggaatgtgaattagttcagccactgtggaaagcagtctgaagatttcttaaagaacttaaaactaccatttgacccagcaatcttattactgggtatatatccaaaaaaacacaaatctttctactaaaaagacagatgcacttgcatgttcatcgcagcactattcacaatagtaaagatacagaatcagcctaggtgcccatcaacagtggactgagtaaagaaaatgtgctacatatacaccagcagttcccaacccttttgacaccaagggctggtttcatggaaaacaatttttccacggactgtattttggggaggggatggttttgggatgaaactgtttcagattaatcattagttaaattctcatctggcattagagtctcataaggagtatgcaacctagatcctccacatgcacaattcacaagagttcgtgctcctatgaggatttaatgctgctgctgatctgacaggaggtggagttcaggtggtaatgcttgctcacctgcagctcacctcctgctgggcagcccaattcctaacaggccatggatgggtaacagtccacggccagaggctggggactcctgatacacaccatggaatactacacagtcataaaagaaatgaaatcatgtcctttgtaacaatatggatgcagctggaggccattttcctatgcaaattaacacagaagcaggaaaccaaatactgcatgttctcgcttacaagtgatagccaaacactgggtactcatggacataaagacagcaacaatagacactggggaccactagagggtggaggaagaaaggagagcaaacattgacaaataactttcggctactatgctcagtccctgggtgatgggattatttgtgccccaaatctcagcattatacaatataccacgatagcaaacctgcacaggtacctctgaatctaaaataaaaattgaaataaataacaacgaagaaaaaataaaatccttatctctcactgtaaaaaagtaaaaataaaaagaccaaggtgaagtcagctcgaggagagttggaagaagtttcattcagtttgagagatgaagccacactaaaccagcagagtgggtcccaatcttttctgtacaatttcctgggggaggcttaaagaaatacatgtgagatcacaatcctgggggtggtgcacatgtctgagtattttacttttagctcttcaggtgagtctgacacacagccaaggttgaggacccatgtaagcaggcgggccagagtgctttttgtccgaggcatgtcctattctctggtccagccacacctgcagcactgaaacccaatgtctccaagcagctgacctttaaagggtccaattcttcttttaagaggaggctgtttgaagagatgtgaatagaacatgaataaggacagcgaaggtacaaatatgctaataaagcagatattccaaccagtttattgtatttttacacacacacacacatatacacaaaaataaataaataaataaaagctctatacccagtgatagcactagtgatgatgcacttttgtatttttaggatcatattattgagaaagatcaaataatatttcattaacatttatctactaatattaaaatgttaatgtatatttaacatttttacaacaactttactgaggtataaatcacaaaacatacaattaacccacttagagtatacaatagttttcattagtttcacagagttgtgcaactgtcactgcaatcaattttagaacattttcatccctccaaaaaagaatcctgtacctattagcagtcattctccatcaccgaccttcccccaaccctcagcaactattgatctattttctgtctctatggatttgcctatttgggacatttcatataaatggaattatgcaatatatggtcttttgttattccattatttcacttaggataatgtttccaaggtttacccatgttgcagcatatatcagcatttcattcctttctactgccaaataatatccattgttggaatatactacattttatttacccaatcatcagctgatgaacatttgagttgtttcgacttcttgactatttgaataatggtgccacaaaccttcctgtacatgtttttacgtggacatgggtttccatttttcttgggcatataccgaagagacttgctgtgtcatatagtaactctatgtttaaccttttgaggaactgacagttttccaaagtggctgtatcactttatatccccaccagcaacatatgagggttccaggtttttcacactcatgtcaatactcatgatctgtcttttttattatggcaatatttgtttttaaaaatggtatgtcttgatattttgtaatacatttagatatcttaaattttttaatatatattgttttactgatggttttgctttatgaattctgaactttccaatgaaagaaaacaactactgaagtcaatacatatttgagtatcaaagaccctaaactgtcatttttgctgtggttattgcaacaaataattggatttttttttctttttctttgagacagggtcttactctgttgcccacgctggagtgcagtggctcattgcagcctcaacctcctggcctggctcaagtgatcctcccacctcagccttctgagtactaggctacaggcacgtgtcaccacaactggttaatttttgtattttttgtagagatggagttttgccatgttgctcaggctggtctggaactcctgggctcaagcaattcacccgcctcaccctcccaaagtgacagggggtgtgagccaccatgtccagccagtaattgcattttctttatgacaaaattattttcagagcttagaactggataaaactttttctctacttgtatattccttctacaaaggaaagcagtcattgcttctttgcactgactggtagaaagcttaaaactaaaacttttcttggttggaaattcttgctaaattttaatttttattttcatcttttatcttgtaggtattttttgatacctctatattagtaaaagctaattcacatcccttctagtgggaaagagactataaagaagtaaagaaataaatatgtggtaagtacccttgatctgcacagcaatctcaaggcagtaattataaaggataaaactgaggatatgagaagttatttaccaaagtcagaagcttataagtggcaaaactggtattagaatacagatcttggagtccctcatttcagttctttatactctctcaacattccatcattctgtttaatacagacattttatggtatctgaaaagtatcccaaagtagctcctgcagaaccaacacttaaatgtaatagagtccctgtgataagatgttcaactgatattttatcccagtgattgagataactttaaatgttcctcaatagtccccacaatagcttagctctgtaaggaaaaaatgtgtttatttttcattgataattataattattataataatgtttttttttttttttgagacagagtcttgctctgtctcccaagctggagtgcagtggcatgatctcagttcactgcaacctctgcctcccgggttcaagtgattctcatgccccagcctcctgagtagctgggactataggcatgcacaaccactccaggctaactgtattttttgtatttttagtagagacaagttttgccatgttggccaggctggtctcaaactcctggactcaagtgatctgcctgccttggcctcccaaagtactaggattacaggtgtgagccaccacacctggcctataattattatttaaattattaattttctactaatgctgagaaagatggtataagacataaaaatctaatgtttgtctaatgatatgggtcaaggcacctaatattaatagttagctaaagaataggggaaaatatttacaaataattccaatgtagaatgatttatagaaagttactttatatttttccacattacattttaaagttacttaaaatatttttggctacatgaaatttatatattcttccttaaggaaagaaaataaacttttatagaagaagttacagaaatgcacttggtattcattactggtgatacataatagaatttaggtttagtgccagatatagggtgagaacaccattagctggaaactatacttacctctaggtgatttctataaatctgaagtccaatgatttcacttattaaagtggacaaataagttatatgttccggacctaggtgacagttacaaaaactatctaaaagacaaaaacagtctaaccatgaatgagaggattcaatacattttataaatgcctcaaaagaactcttttcttatcctcattctatctccacatctggacttgagtattgtgaacaattgcagtttggtctaaagaattagtccatcactatgaattaccacacatcacaaaatgacttaaatcaccagtgttaagtaagtggtaggaccttatgattgaataaatattggttttctagaattgtaaaaacctcagaaagtgtatagttttgcttcaatcattttacaggtgtgggaaataaacatgaggtgaagggacttgcccaagatctcctaagttcatggcagagtggagactacaaacaagtttatttaagattgaaggttgttctacgataccataatatttcaagtcaaaacttaaaatggacttgattttcggctttgtttaaacctgcaatttaaaaaactgagcaagatccagcccaaaatggcaaaaaggttttatgaatacacactttttgctaacagtcaactagaaaccaaatagaatagcaacgttactatcagagcagatcatgggtatattattgaaagcaagtgtaatgatgccagccttcagattccctaggatattttaaaactctcaagcacttctattacatagtttagggtcactggagaaaattacttttatgcagacaaaggaacacacgtctggaaaaggaactaaagaaaaatgtggcagttcttatctattttattccctgaagaaatgtgctgaccattaactttataacttgaatattataaatggaaaaaaaaaggaagaaatagaaatccatccagttctggaatcatggatggagttctggaagatggtttggtcttgtaatcttttttactggtcctctcttggcactcactgtcttctgcttagctggattatatcttccactgaaataaataagtgttaatcataatttttcagtcaccattatgtacaacaaaaacattataggccacacaggaagaaatgtatattgcaccttgttccccccaacagaccttcacacggaaaccttcctgtgaatagtttctgcttacagtgcaaatcttaggcagccttctgttatagcacatcatctccaccgctacagaggcatacagcttaagggcaggtaattcaaaggctggaagcagcatgtcaggtgccctaatgtggaaagttctgtctaatgaggataagacagatccgtgaattccttttcttagatttccatgagatcctttttccattaatgacttatgtggcactaaaaagccaaccttccttacactctgacttgagagagttaaaggccacttcaatttcctaaaaactttcttagggggtgatggcagcaaaatgacagagtcatttaaagtctttctctattaagtctaacatctggacttcctcagggaaagtgtttatttgttgctttttttcttgtataagagccatgttttcttgtctcttctcatatattgtaattttgttttgaaaactggatgttttaaaatatgtaacatgtaagaacttgtcattttctcctcattaaaatgaaggataaaattctctcctccataaaagtgatgacaaattggcaatatggttagaagcaactttatcaaaaccctggaaattaacgaaagtgttgcaacaatcctggagaatttataaaataacaacaacagcaacaaacggctgaaacttcgaacactgagctttgtagcattttaacttgccctatgcctatccactgttcccctgactttcatccccagctccatggtagccttgaaaaccaacagcgcacaattgcagtgaaaactcagtagcctggtggacaccataagaggtggaatagggttggagatcctttaacacctatttcattccaagaggaatttcattatttaaacagtctggtgattacttgaaagaccacttacaaagctatctttatttgacctgacatggagatggtccagtgtaaatagccttttccctaggggcatttgctggaacaataagaaaccactgtttaatttcagagctgccagaggtagtagataacaattgaggcaaaaaataggctaaccaggaagcttaaaaggaaaagctgagaggccaggctcagtggctctcacctgtaatcccagcactttgggaggctaagggaggcaggtggatcacttgaggccaggagtttgagaccagcctggccagtatgatgaaaccccacttgtactaagaatacaaaaaaagatgagccgagattgcgccactgcagtccgcagtccggcctgggcgacagagcgagactccgtctcaaaaaaaaaaaagaatacaaaaaaagaaaaaaaaattagccaggcatggtgctgcatgcctataatctcagctagttgggaggctgagacatgagaatcacttgagcctgaggcagaggttgcagtgagccgagatcagcctaggcaacagagtgagactctgtctctaaaaaaaaggaaaagctgagaaatgagtgttaataagctccattatatttcttggaatctagaagcccatacacatgtgtaactgtgggtatgcataggactgtgtgcatactcaggaaaggcctgaaaaggccctaagctcttgcctctggctgaccttgaggctctgcacaagcaggaagtaaagaataaggtagagttgtaatttgcctggccgactgttgaaggcatgctccaacacacacacacagagcccatcagcaaaggctaggagatttattgatgctaggcatttaaataaatctgttcaatcattagctgacccctaagctaactcagcagagacttcagtgtccaccccaacaaagaatacagattttacataattattttagaaaagtcactaaacaagcagcagcaaaaacagtgacaacaacaaaccctggggaggggaaagaaactaatatacagagtggccatgttacatattttaaaacatccagttttcaaaacaaaattacaatatatgagaagagacaagaaaacatggctcttatacaagaaaaaaagcaacaaataaacactttccctgaggaagtccagatgttagacttaatagagaaagactttaaatctactattttaaagaactaaaggaaatcatatctatagaggaaattatgagaatgatgtctcaccaaatcaagaatactaataagagatagaaattatttaaaaagaaccaaataggcattctggagttgaaaaagaatataaatgcaatgaagaattcactagaagagctcaacggcagattggagcagacacaagagtcaatgaagttaaagatttgtcaattaagatcgtctggtttgagcaagagataacaaagaataaagtgaaggaaattaaaatattttcccccaaaatatatttctttgacatattttaaaatgtcagtctcttggccagcaggcagaaatggccttacaaagctgtcttaagtgggaaagtttgcattaatgtggagaatctccactaatgcaactgtgccacctctcctttctatgcttttccccagatctaggagagactgaaagtctgacacatttaaaagtctgagaagaaacatttaccatctattctctctgagggtggcttcatctacataaaaagtccacctttgttcgccaaaccttttctccctgctcccaaaaccttttttaaaatcagaatctaagcccccactctttctgtaacctcaaaatggtatataagtttctataactcattgggaagttgggtcttcattctgaagactcccatgtatacatattaaataaatctgtgtgccttttctcctattaataaatatgattcatgtctgtgatttttagcaaacttcaggggcgaagagcctatggcggcccccactaaagaaaactgaacagtctcagagacctgtaaaacactatcaactataccaacatatgtataatgagtgtcccagaaggagaggggaaagaaaaggacagatagaatatttgaaaaataatagctaaaaatttcccaaatttcattaaaaatattgatctacaaatttaagaagcctaacaaattccaagatgaatatccagacacatcataataaaactatcaaaagccaatacaaacagggaatcttgaaagcagctagaatgaagcaactcactctgtaaaagggatcttcaataggagtaacaactgatttctcatcagaaactatgaaggcctgaagacagggagatgaaatatttaaagtgctataaggaaaaagactttcaactaagaattctatatgcaacaaaactatccttctaaaataaaagaaaaattaaacatttccagataagcaaaaacagaaggaattaatcatcagcaaacctgccctataaaaaaatagtagagacttttgtgttgaaataaaaggacatttgatagaagtgtaaattcacatgaagaaataaagaaaactggcaaagataactacataggtaaacataaaaataggataaatgtagtttttgtttgtaattcttctttttaaatctcctaactgattaagaaaataactgcatgagcaataattgtaaatctgttgatggaaacaaaatgtataaacttgtaatttgtatgacaataacagcacaaagaaggtgaagggaatggagctacataggaaagaacttttggtacactattgaaattaagttgttttgaacctaaagtagattgttataaattaatatcttaattgtaattcccaggcaaccactgagaccaagaccagatggcttcgctggtaaattctaccacatattaaatcatacatatataaaaccaatccttcacacgcacttcataaaaatgaaataggagagaacaccttccaacttattttatgaggcaaatattactcttattttcttctttctgcttatttggggtttagtttgctcctctttttcaagtttcttaaggtaaaagatttgattttttatttgaaatgatttatttaaaaatatatttacggccataaatttctctctaagcactaaacctgataaagaaaatctatgaacaaaatttacagctaacattatatttaatgtaaaaaccaaaagctttctctctaagataaggaacaagttaaggatgttcactattaccacttctattcaacattgtataggaggttccagccagggcaattaggcaagaaaaatagataaaaggcatccaaattagaagaaaaaaaaaagaagtaaaacaatctctatttaggtgacatgttcttatatatagaaaatactaaggcatacacattcacatacagacacagacacatacatgcatttatgagatctaataagttcctcagggtttctggatttaagatcaatatgcaaaaatcaactgtatttctagacaccagcaatatacagtcctaaaatgaaatttaaaacttaattctgtttcaaactgcatcaaaaagaatacagttttaggaataaatttagccaaagaattgcaagatttgtacactaaaatctataaaatatctatgaaagaaattaaagaagatctaaatgaatagaaagaaattcatgttcttggattagaagacttaatattgttaagatggcaacactacccaaagtgatctacagattcaacatactctctccatcaaaacaccagctatattttgtgaagaaattgacaagtggatcctaaatccacatggaaataaaagggactctgaataaccaaaacaatcttgaaaaagaacaataaaattggagtactcgcacttcttgattttaaactcactaaaaagttagtcatccagacagtatggtattggcataaggatagagttatagatcaatgaaacacaactgggagtctaagagtaaacccatatgttacggtcaattgtttttttacaagagtgccaagagcatttaattggcaaaggatagtgtcttcaacctatggtgttaggacaactgaataaatacaggcaaaagagtgaaactggacgcctacctcacatcatatacaaaaatgaactcaaaatgggtgaaaagggagctaaaactataaaactcttagaagaaaacataggttaggcaatgacttcttatgtatgacacctaacacacaagcaagcaagaaaaagtagatgatggtctttatcaaaattgagaacttttgtgtttctaaagatatcatcaagaaaataaaaataccatccatagaatgggaaaaaattataaatcttttatctgataaggtctcatactcagaatataaaatgctctcaatgcaatataatagagacaaacaaaccaatttaataataggcaaaggacttgaatagacatttctccaaagaagatacagttgtccctctacatccaagggtgattggttccaggacccccatggataccaaaattcacagatgctcaagtcccttacataaaacggtgtcatatttccacataatgtacacacataatccagtatactttaaatcatctctagattacttaacattagattacattaacacaaaagtaaatgctatataaatagatgttatactttgttgggtttttaaaaattatttattattattgtattattattattattattttccccaattttttttgatccacagttggttgaattcatggatgcagaatttgtggatatggaaggctatctgtatagaaatggccaacaagtacaagaaaagatttcaacatcattagtcattaggaaagtgcaaatcaaaaccacagtaagatatcacttcacatccactaggatggttaaatttttttaaataaaggacaacatgtgttgataaggatgtggagaaattggaaccctgatacacagctaatgggaatataaaatggtacagccactatagaaaatagcttggcagttcctcaaaaagataaacaaaatggaattaacccagcaattccacttctaggcatgcaccaaagagaattaaaaatatttgcacacaaaacttgtacagggatgttcatagtagcattattcataatagtgaagaggtgtaaacatgtaaatgttcatcagctgatgattcggtaaataaaatgtggcatatccaaaaactggaatattactctgtcacagaaaggaataaggaattcgtatatgttccaacatggatgaaccatgaaaatgttatattaagcagcagaaggtaaacacccaaattcacatattgtatgctcccatttacagttggaaatgtgccacataacatttcagtcagcaatggactgcatatatgacagtattcctgtaagattataatactgtatttgtactgtaccttttctatgtttagatacacaaatacttaccattgtgttacaattgtcagagtgttccctacagtaatatgctgtacaggtttgtaacttaggagcaagaggctataccatatagctaggtgtgaagtaggatctaccatctaggtttttgtaagcgcactctgatgtttgcacaatgacaaaattgccttatgacacacttctcacaacatgtccccatcattaagggacacatgactgactgtatatgaaataacaagaccagagaaaaccataaaaacagaaagcagattagtaattgccaggagtttagtggaagggggtttgggaactaactgctcattcatacaggctttctttttggggtgatgaaaatgttctggaatcagttagtggtgatgcttgcatgaccccatgaatatacgaaaaatcactgagttgtacactttattatttttattttaaaaaagtttttaaatggggtctggctctgttgcccaagctgcaatgcagtggcacgaacatagctcacggcagccttcaactcctgggctcaagtgattgtcctgccttggccttccaaagtgctaaggatacagagctgtaggctaaaaggataatttttttggtatgtgaataatatctcaattaaaaaatttttttaaatgtgctttgggaataatccatttcctgttaaaattttctttagtttattaatcatgtttaaaaatgatttcttctggtgaaatatggaattaaccacaatcattcaattattatgtctaattaatatagctcattatagatatttattatttatagtactaaatgattttctattacactaaggatgttttgagtagcttccaaaatatggcccatttctaaaagatctaactaacatgatgacacaagtgtctgaataataactaactaatgacactaatgatgaagctgaggtacttcactggtaaaagatatttaatcactgtcttttagagcagtgttttccaaactgcagaatgcaactcattagtggattgatttactgaattacaatagcaatataaaaataacagaaaaggaaacagaacagaagaggaaaaagaacatatattaataaaaagaacagaaaaggggccaggtgcagtgattcatgcctgtaatcccagcactttaggaggccaaggtgggagattgcttgagcccaggagattaataccagcctgaaaaaacatggcaagaccctgtccatattctctacagaaaatcaaaaaatgagctggacatggtggctcatgcctatagtcctagctactcaggaggctgaggcagggggatctcttgagcctgggagtttagggttaaagtgagcaatcattgtaccactgcactgtagctggggcaacagcacaagacctgtctctttaaaaaaaagaaaaaaaaaaaaacagaaaaagaagtatcaatatgcatcacacatagtaagagaaaatattctttcataaactgtaaaatatgtgaatatatatgtgggtatagggatcacaatatggtgtcagtcatggtcaacacagtttggaaaccattctatgctcctgagtattatgatttttaaataaataatagtggttaagcctccagcaagtttatgttattaatagcaaaacagacacttgcagttccaaattattgtcatatgtatttttctgtcctcacaaatcaatacattgttactctgctgattctttatattcagtaaagcactatagtaatgataatagttagtgtttgttgaattagggatttttaaaaataatctctaattctcataccaatcattcattttgggtttcatctcttcatcttatgggggagaaaatggaatctgagagtggttacttatataaagtcacattaaataataagaaatggaggcaaaaattgattggtctatctgctccaaagtcagtgccgattttcatttacacttgtcccccctttatccatggttttactttccagtttcagtttcctgtggtcagccatggtcccaaaataggtgattatggtacaataagctattttgagagagagagagacaccacattcatataacttttattacagtatgctgttataattaagttgtattattagttactgctaatctcttcctatgcctaaattgtaaatttaattttatcatagatatctatgtatgtaaaaaaacttagcatacacagggtgcagtactatccatggttttggtatccactggtggtctttggaatgtatctctcttgggtaagagaggactactgtaccaccttgcttctcactatttttttaaacactgtactgtattagttacacagtatttatactgctattatgacttaagaatttccatagtctatctggactatctcttgacttttctcttttaatataaaattatttaaaataattataaagtatacatattcttatataaaacctaagaggcataaatataaatcatccacaattttactaacctattttgtactataatttttgtttactattataggtaagcgtttttctatgtcagctatgtactctcctagaatgtaatttttgcaacttcctaatatcaacagagttattgacttactcttttaatgttggatattttggttgtgttatctctactgtagctgctttttaaaaaaatcagaatcagaaggatacgcccctaacaatctgtctcttaccaagtcctagtatcaatttccctcaggttcttttgctccagggtaccaatggctccttagttattttcttcctttagggcttttagtcactttaaaactgttcataagcagaaaaaaatgaggtttcacactaaagaaaaaaataaactttagttttctatttttaggaactattcctgtggtatcagttttgagctccttgctttcgggaatatgatttttcatagttaatacacaccatgggcgacagtcaataaagttacctattgacttgtctagacttttttggcaacttacaaaacttatactaaaaagactgtttctcctatttaatcttaaagagacttttgtccaattgatatatgtaaagatctctagaatacatccttcaacagcagtatagatatcttgttcatttgtggtcataatacatagtattatgtctacacagtaggactataatagctaatattaaatctacatagtctatatagtaggactataatagttaatattatatcaggcactatccctttctgctagatttttaaaagagaatttcacattcatatgggtattttctaatgttctgatttgttctgaatgttaggaaaaatgggtaagtcaatattttaatattagtacatatgagaatatcaaccaaagcaaacattaaaagccatggagacttgattaaaagttcacaaatcataaatgtaccaatccataaattataataaagcaaatactgatgtaaccacaacttaggtcaagcactagaatattatcatcatactggaagatgccatcatgtcacaattattattcacttcttcctttccattggtattaataattactagcctgtgttctgacatcacagtttacttttgtctgtctttgaactttaaatgaatgggatcacattgtacatattcttttatttctgacctacttcactcaatactgagaattatccataatgttgtatgagttatagtttgtttttattgctgttattttcatatatgtatatataattttcatccattccattactgatggacatttaagctgtattcagttttgaactgtcaagaataaagctgctatgaacattcttgttcttttggtgtaaatgtatgcaccattctatttgatatattactggaattgttgggttatagagaaggtatatgatcagctaaatatagaaaataatgctaaaatgtatttgatatggtttggccctttgtccccaacccaaatctcatgttgaattgtaatccctggtgctgggggagtgacccagtgggagataatttgatcctgggggcggacctcccccttagtgtcctggtgatagtgggttctcacgaaatctggttgtttgaaaatgtgtagcacttccccattcactctctcttctgctctgccatgtgaagaaggcacttgcttccccttcgcccttccaccatggttgtaagtttcctgaggcctccccaaacatgtttcctacacagcttgcgggactgtgattcaattaaacttcttttcttcataaattatccagtctcaggtagttctttatagcagtgtgaaaacaaactaatacaatattccaaagtggttatataaatgtatactcctactagcaatgtatgagaatcccctattcctccacatccttgacaacacttggaatcatcaatcttcaaaatttgtggctgtatcttgtaattttaatttgcattctgctgatgagtaatggtgttgagtctctcttcacatgtcctttggccatttggatatcccattctgtgaggtgcctaataccgtgacttcctttaaagactcaaatttgagtcatcaacaaaaggaggatactaacttccagagttaagccagtaagaaaaacaatattttgaggtagtaccaattatatatacctaatttggatgattagagagatatttctatgtttctattagatgagtgatttgcattgtttatagtttcagagagtgaacgggttttttttttccatttgaccatttatttagtcataaattcattcaaaaattattaaacaccaatttatgccaggcactctattcaacattaagtttcatcagagatggaagtgattgatctgggatcaagcacaagcagtgctggagggcacaaagcagctgaatgggcaggtataccagaccatgccacctacctcgatgcaccagcaccttaagctcagttcagacctgtggtgtggagggcctcacagacaacctgatctcagcctgattcatagctgctgctacataagggggtggggaggaatgagtttggcacccaggtgatctacttggttgtcctttggtagtaacttgcccaattctgacagtaagtggacaagtatcttagccatgacttggaaaggacatgataaacagaagttcagattccccagggataagagtctgggtcatcctgccagaggaagaaaaggcccatacttgagtcatggataaatcagcttggtacatgggactgcagctgcgctatagccctactccctctgcccaaacctggttcctagccttcccccacaggtgttgatcctaagaactctcgctaataaacttcctggccaggtgcagtggctcatgcctgtaatctcagcactttgggaggccaaggcgggaggatcttttgaggtcaggagttcgagaccagcctggccaacatggcgaaaccctgtctctactaaaagtacaaaaattagccaggaatggtggcacacacctgtaatctcagctatttgggaggctgaggcagaataataatttgaatccaggaggcagaatttgcagtgagcagagagattgcaccactgcacttcaacctgggtgacagagcaagactccatctcaaaataaatacataaatacataaggccaggcacggtggctcatgcctgtaatcccagcaccttggaaggccaaggcaggcggatcacctgaggtcggaagttcgagaccagcctgatcaacatgaagaaaccctgtctctactaaaaatacaaaattagccaagcacagtggcatgtgtctgtaatcccagctactcgggaggctgagacaggagaatcacttgaacccaggaggcagaggttgcagtgagccaagatcgcgccatggcactacagcctgggcaacaagagctaaactccatctcaataaataaataaataagtaaaataaacttcctacatgctgattcctatttcagagtctactccctgagagatccaactcccagtaatattcaatggaaaaccaaactgccctcgtagacctacattctggtgacacacatatgtgtatgtgctaacatatgattagaataaagaagtttaactttcattttcgaaatattcccctcttcactatttaagcaaatttgaataacagaggtaatatatttttagaacagatatgaattggaaaataaacctgaactgcaagatattaataaaaatatttagggtggttgtgcagaaaagtcaacatagcaggctttaggctactgtctttggaaaagcccacttgcgaggttggcccttggctggtatctggaaacttactggtaaacagttccctacacagatataaaccttttcccaaatgaaaagaatgattcactgtgcctatgctgtttgtacaaacaatgtggtttatattgaacacctgttttccttctgggagtctggaattttggtgcatgccaggcagaagaagcctatgtgatctgctcccaatagaaacattagatgctaagtatctaacgagcttctctggtaggtaaaacttcatgtactgtcatacctgttgttgcaattttttgctggaggaattaagtatttcttatgtgaccctaacttggagaaaactttcggaagcttgagcctagttttctgagaattcatcccatgtgccttatgcctttgttgattttgctttgtattccttagctataaattccctgtgaggtacatggattagagaaagaaagaaaaaaagaaagaaagagaggaaggaaagaaggaaggaaggaaggaaggaagggaggaaggaaatatatattagccataagtacaaatatatgccaatccttatgaattcttctagtgcatcattgaatatggcagtggtcttggggactctgacagtatagaattcttctagtgaaccactgaatatggatgggagtggtcttggggactctgacacagtggcgtaatagtttttccagggaagtcctttgtcagaatttattttaatacttaaactacattatatttccaataatgaaaatgtataaagataataaataataatttaaagaatttgactattcaagaaagaatatactttatctagccaaatattggacaaaatgttgctacctcattaatctccaccaaggaaatttgctatacttgagtggctcttaccttgacctatatataaaaaggatgctgacttatagctgattcacatgttggcttaattttttatagggttaagttatatattaatgtttttccctacatgggataaagttactcagacaaggattacctgagtaattcttctgtatttagtacaggaccagggaaaattgtgtgtagacataaccttgtaaactcacaaaacattcctgtgtttttgttttttttttcttaagagacagtgtcttgctctgctgaccaggctggattgcagtggtgcaatcgtggctcactgcagccttgaactcctgggctcaggtgatcctcctgtctcagcctcccaagcagctgggactacagtgcacaccatcacacccagtcaatttttctaattttttgtagagacagtcttgccatgtttcccaagttggtcttgaacttgaggcctcaagcaatcctcccgcctcagcctcccaaaatgttgtatgataggcatgagccactgcaccaagccctctgttctttatctatcttaaattggttttatttacatagaaaaaacagtttaaactgcactgtcacctacgtttattttggtgtccactccagtgaacatatttcctgactaaaaagggtagggctgatgctgtaattattcaggcataccttgtcttattatgcttcactttattgtgcttcaaagatactgcattttttacaaattgaagatttgtggcacccctgtgttaagcaagtctatcagcactatttttccaatggcatatgttcatttcctatctgcatcatattttggtaattctcacaatatttcaaacttttaaattattactatatccgttaatggtgatcagtgatctttgatgttactactgtaattgttttggggagccataaaccaagcccatataaaacagcaaactgtttaataaaggtatgtatgttctgactgctctaccaaccagccattcctgggtctctctccctctctttgggcttctctattcattgagacacaacactattgaaattaggccaattaataaccctactatggtgttgaagtagaaggaagagttgcacatctctcactttaatttggctagaaatgataagcttagtcatttagtgaggaaggtatgttgaaagctgagacaggctgaaagctaggcctcttgtgccaaacagttaagccaaggcataaatgcaaagggaagattcttaaaagaaattaaaagcaccactctagtgaacacacaaatgataaggaagcaaaacagctttcttgctgatatggaaaaagtgtgagtggtctggatagaagaccaaagaaaccacaatattctcttaagccaaaacctaatcaagagtaagaccctaaatcctttcaattctatgaaggctgagagaagtgagaaagctgcagaagaaaagctggaagccagcagaggatggttcatgaggtttaaggaaagaagcccccttcataacataaaaatgccaagtgaagcagtaagtgctgatgtcacacctgttgctgcaattttttgctggaggaattaaatatgtcttatgtgttgcagcaagttacccagaactagctaagatcactgatgaaggtgattacactaaccaacagattttcaatgtacacaaaacagccttctgttggaaaaagatgcaagctgagaaaagtgggaaattctggccttctccattattatcaagcctctaaagattctggagatacccctatctcagccccacagtccatgtgacttttaaaaaaatatatatggaggaaactgtgaaagccatatcacccagacattcctagctagagaggagaagacaatgcctcgcttcaaagcatcaaaaaacaggttgacttgtctaatgcagccagtgagtttatgttgaagctaatgctcaattaccattctgaaaatcctaggaattatgctaaacctactcttcctgtactctatacatgaaacaacaaagcccagatgacagcacaagagtttagagtttacagcatggtttattgaatattttaagcccagtgttgagacctactgctcagaaaataagattcctttcaaaatattactactttttgagaatgtacctggttacatccaagaactctgtgggagatacacaagaagataaatgctgtttaaatgcctgctaacataacatctattctgctgcccatggatcaaggagtaattttagctttcaagtcttattatttaagaaatacatttcataagtttatacctgccatagatagtgattcctctgatgggtctggaagaaaaccttctggaaaggattcatcattctagatgccactaagaacatttgtgatttatgggaggaggtagaaaaatgtcaacattaaaagaagtttggaagaagttgattccaaccctcacagatgactatgaggggtgcaagacttcagtggaggaagtactgtagatgttttggaaacagcaagagaactagaattagaagtagagcctgaagaggtgactgacttgctgcaatctcatgataaaatttgaatggatgaggagttgcttcttacagatgagcaaagaaagtggtctcttagatgaaatctgctcctggtaaagatgctgtgatgtcatttttgaaatgacagcaaaggatttagaatattctatggacttggttgataaatcagcagcagagtttgaaaggactatgccaattttgaaagaatttctactgtgggtaaaatgctatcaaaccacaacacatatgacagagacatctttcataaaagagtcaatcggtgcagcaaacttcgttgttgccctattttcaaaatttgccacaggcacttcagctttcagcaaccaccaccctgatccatcaggagccatcaacattgaggcaagaccctccaccagcaaaaagattataactcactgaaggctcaaatgatcaatagcatttttcagcataaaatcttttaaaagtaaggtatttacattgtttttagacataatgctattgcatacttaatagactacagtaatggtataaaaaaaacttttatatatactaagaaaccccaaaatttgtgtaactcacttcatcgtgatacttgcttcattacagtgatccggaaccaaacccataatatctccaaggtatgcctgtgtttatgttgttgttaatggtgtagttttaagttctcctaggtacatattattttagtttaaaaaataatataataatatattatcgtgcttgaggaccaaaaatgtatctgggatctaaaaaaaatgtgtataaatagtggaacagatcacaacttctttaagttctcttaccatatgcaattttatattgttgctataaaacctagaagttcagcttccaaaatatagtggacacctgttttgtcagtggcatttatgtgcaaatgtaacgaattagaaagaaaatatatagctagacttacgttttcactagattctcttgcatcctaggcagttgatccacctgttgccttttagaaacttgatgtaaaccagaaccctgaaatacaaaaatttgagtgtttatccccttggttcataattgatttcagaaataagagagacagtcaattctcaattaactctcccataaccaggttcttttgcagcatgtgtaagagaagctgagaaaaatgggaaattctggccttctccattattatcaagcctctaaagattctggaaatccccctatctcagccccacagtccatgtgacttaaaaaaaaaatacagaggaaactgtgaaaaccatatcacctatgtggtatagatcattaaaacttcttgtagtagacactaaatatagataatgcaggcaccctgccattacagtagataagacaatagaagctgtagtattttgaggcagaaatagaaagacaagataatattttcatttttgcctatcttgaaattcctccaggatataaaagtggaaatttctagtggtcagtgtaaatgtaatctgcaattcagaaacaattgagaatgatgatcttagagatggcaaatgaagccaagagtgaatgagatcattcattgagggtacacagagaagtaagagaatcaataatacaaactgagaaagcaacttttaaaggataggacaattaccaaagatagacaggccatcatttaaacaataagaaaacccaggaaaaactactatcatagaagtcaagtcagggagggtggggagtattcaaagaagtgagcatggttggcagtgtaaaatgcctcacagatgcttcgccaaatttgaagaggagttgctgtatttggctattaagagataaactaggcgaaagcatgatggcggggtcacaagagaaatgaaaagagatagaggactaaaaagcaatggcaatgagtatattcatttattcatgaagtttggctgagaaaaagaaagctaaggtggtagttttatgaggacagttaatcgtaaagtaaaagtttgtttttattttgttttggtggaagagttgagcatgtcacaagcaaaggataagccaaaggcagtaaaagagagattaaaaatatgcgaagggatattattaagtaagtcctagagacagcagataagactggggaagaggtttgggatcattttcctttaagacaggaagaacaggatagtaaatctgaaaataaaaaggaggaaaattgggtttcacacctgatagattctctttttgggtgtgagctaagatattagatcatttgatatgagtgacaggtttgggtatattggaacagaaaatagaattcattcattcattcagctaatgttactgagcatctactatatgctgccactacattaagcactcaggtacaaagacaaacgggttatggttctatcggggaaacagcaaaataaataggtgattacaattaagtgccttgatggagatgtgcacaggtgctttgcaagcatacaggagatgtagctaattgagggtatgggggactccacatggaagagcagccaattaagaactaaggaaagaatattctaggtaaaagtaacagtaaggaccttaggtataaagcagcagatatatccaggaatagcacatagcatttggtctaacggcagtctaggatattagcagggatatggctgcagagacaggaacagccaagttgaagaggaccctgcagagaccacaccaaaagagctttgctgtgatcctctgggtaatgcaaactgaaggtttttaacaggaaagaacactattgtatctgtatttcagaatgataggcagcagagaagaaaaatgggtgtggcagagttagttaagactttggtaactatgctgttgacattatatctaaagtactaaatttaaacctaagtactacatttaaacctaggcagccacatttttaaatgaacaataacagaattgtccaaaaaggcagctgaaatacctgggcagtctggaacctatgttatgaggaatggctaatgtaacttaatattttagcttagaaaacaaaacaaaacaaaaacctatgggaagactgagagtcatttacaaatctttgaaaaactatcttgcaggagtgtagacttgttcttattcttcagaggatgtaactaaaaccagtggattttaaggaagtttcaggaaaagagaataagaggcatcatatgatgttttaacaattttaacaattagaacttcccgataatgaaacagaaaagcctcagattccttatctgtgagctaaaagcattatattcctcaatctctcagagccattgctaaaatcctatgtttacaaagatagaagctaaaacttaagtttattatgtgctgcaaaaagctctaatcggtctttctgcctgacttttaagtaatgcaacgtacctatgtgttaaaaagcaatgtccgtattgtacttatgttgtgcatatcagaagactcccaagagggggaaactcagtttcattcaaaacagtgaatcaagagtgagacaaagctacagagaggacagcagcagaaggataaacagcacactcagcaaatagctctagttatctaccaatgaatcaattatttatgtattcagcatgggaagaactgcaaatcatccattaacctttccaatcaccgtagtatccacatggttagaactgtccttcactataaagattaacaattcactctagagtgaaaatctttaacatttatactggggacagtattaacatcttcctgggaagctgttaaaataggcttttatcatatgttcagtgatcctgcggagtcagagtaggattatttcacataagtgaatttttcatataaactaaggtaaatgaatgctttggggacaaaagactttacttttaaccttaaaaaaaatcctccaacaatgttttatatatcacctttttcttaataacttgggcttatgattatgagcatacatttctattttatgttcagttcagtaaataattttgcatatttgctttttgccactctttgtgaaagggaatagaaagcatgagtcaccctgactgacctcagggaggaacctacagctgagtgaagcaaacagatatatcagcaataagggaccaagaggaaggctaaggcaagtagaaattctggtgcccctgtcacagagaggggctaggaaaatcagaaaagaaacacaggaaagtgatattcaccatttactggaatttaaaacctattatgtgtcagaaacttcaaccagcacttcgcacatattatttctctacatactcacaaaacccctgcaagatactgatatttccttttcacaggtgaggaaggaaattaaggcccagaaaggtcacatggtagtaagtgcagagctgggattcaaattcagatttgcaatgccattacagtctggtcttttcatcatgtcatggccccataaagaggtagtgtttgtgctagaccttgaaggatgtggaattggcatgtatgagaaggagcacattccaagcacatagtctgaggaaaggcataaagatgcctgtgatctaggaggaaccagtgccttcagcccagtatcaaggaacatgaagtttgagctaatcatccatttacagacaagagaatgcaagaacttatcctatcttgtctcaatttcttacttaccttagtcaacactacaacacatacttccctttaccaacaatagaactgactttctcaaaattttctaaatgtcccccattagctctaatccccaaacctaatgcccttcctctcaatcctttcattatccctctagatattctggatcagtgactagcagattattctgcatgccactcccatcctcaaaatcctctacctccttgtctgacctagctatgtcttcaggactccaaccctcttttcggctcttcctcccttgactgtcactgttgaacttcttcagagcaatatcccagactatttcttcttttcccactgtatattctccccaaagcatttcattcattcaatgacttcactttttatataataattttgaaattttatataataatttgaaattaataattttcaaatctttatttgtttcctgagagtcatatatccaactgctctttggacacttccatttggataacacacattgaaaactgagtttacatcctaatcttaaaacatatgccaaaataagattaatattgattaaatatttaaacgtcagatattatgctatacaaatactaaaatatgtggtgaatgctatgaaacattgagatggtctttttaactgtaacattagaaatcataaataaaagatagctctgacaacctcaaaacaaaaactctacaataccaacgatatcataaataaaactgaaaggcaaatggatagcttgaaaatagatgcaacacctttcataatttactgatcacctctttgtcctgtatttataagtacgcacttctactaacaaaagttccatctctcgagatcttaccatgcataattataaagtgaagtgccttgaatttcatgatagcccagagatagcagctacctgtttgaattctagtgattagtggtgaaactaaaaggataattaaggaagcaaatacaaaaaataacctcttaatttggaaaactgttatgtcctttttacttttttttttttttctgagatggagtcttgctctatcagccaggctggagtgcagtggtgtgatcttggctcactgcaacctctgccttctgggttcaagctattctcctgcctcacctctgagtagctgggactacaggcgcccaccaccacgcccaactaatttttgtatttctagtagagacagggtttcgctatgttgaccaggctggtctcaaatgcctgacctcgtgatccgaccacctcagcctcccaaagtgctgggattacaggcttaagccacagtgcccagccctttttattttttatacaagttgtatattttcctgtctaccctccatatttagaaacttaactccaaaatctgcttctctcccaaaccaaaaacaaaacctagaaaagtgaaaaacataatttacagtaagaagaaacacttagaatttggaaataaaaaagagttacctgagacatttcagctaggtatgtacggcgttcattgttgatcttctggtaagcctgtgtgaagatacaaaagcaaagggtccaacatatgagaagattagcaatactagcaagactaagttaaggtgtatgtctctatagtgtaggaaatagttttgtgttaattatagagtaggtttgtagataacattagaaataatggcagtttcaaaggaattgctaagtatagagtaaaaacaaacctttgattcttgttccagtttaagtgcatagtatttcacttgactttcaagagtcttcttttcttcttctagctgtttaagtaatgtgtttaaggattcctaaaaatataaatagtaaaattttatatgtactcatgttctaaacaaaataagaaatgaccatcaatttcttcactagtaaatgccttgtatacctaatattttgtgatttcataattctatgatatgtactttttttttttttttttttagacagagtctcactctgtcacccaggctggagtgcaatggcatgatcttggctcactgcaacctccgcctcccaggtctatgcgattcccctgcctcaggctcccaagtagctgggattacaggcacctgcaaccatgccaggctaattttttgtgtttttagtagagacgtggtttcactatgttggccaggctggtctcaaactcctgacctcaggtgatccacccacctcagcctcccaaagtgctgggattacagtcgtgagccactgcaccgggctaatgtgtactttttaagtaatagtaataatcacaatatttattgaaccctaacaatatgtcatgtattgtactaagtgtttttctttttttcatattaaactatctttatttgaaaaacggtatcgtacaaacctaacactctctatcaaacttcaataagggcaatttccacatcgactaatgaatagtagctaaactaacaagagatcaatcaaaagtgctttcaaaggagcagcactggctgatgttctgctgaggctgtgggcattcaggacctggctacagggaaaacagaatcaaaccagctggtgctttggacccaagccctcacatcgtgacctgcctccctcctgggggccctggcacttccaggttcctttggcacttcctggcccctgtgggggcaggaacttggcctcacagttagctggcttctgcctgttgtggtcatttttttttccagagtgcccagagtgctctctcagtggacatggcggtcatccagctttcctgaggtgttttctcaaggaagagggtcttgctgtgaaaactggaagtgtctttcttcaattcttgggccagttctaggaacaacttgtagcagtctgatacaagcagttcaagttttcatgcaccttgtgaagtctctggtcggggtccaggcagtaggtgtcctcctccatggactgctgctgagaccccatcatgcgttctccatgcagttcagatagagtggggagggtcagctacagcttcgggaactctcccacaggctgtgcccttgcaccctgcagaaagccctgctccctggtgtggtggctcacacctgtaatcccagcactttgagaggccgaggcgggtagatcacttgagctaaggagttcgacaccagcctggccaacatggcgaaccctgtctgcactaaaaatacaaaaattagctggcatggtggcgcatgcctgtaatcccagctactcggcaggctgaggaaggagaatcgcttggaacccaggaggcagaggttgcagtgagctgagattgtgccactgcactccaagctgagtgacagagcaaggctccataaaaaaaaaaaaaaaaaagaggcctgcttgccgatcagactttggacttgtcctgtgagttctttccttctttggatttcttcccataattgcattctgcttctccaacatcccctcaggaaataagaaggatgcacctaagctaccattgtcatccacagtcttcagaggaacttgtggccaggacgctgaagaggacccactatgtcctgcttccccaatccccattcactgccaagtcctcgtcctccacgtagtctcttaccacccttgaccagatgcagggcgctcagcacggtgtgggccagggaggtcagttgtcccactccaatattcatgtgggctgtttcattcctgtcttggcctgctccagcctttccttctccttctttgcctgcaagcgttgcttccatcttgcaatttcttggctgggcagctgtgcaggttgctgatggtcagtgctgtcattcagatcatctgcagtttgcccttgaagatctccagcatgctgtgaagtgtgagggacgtgatttgcatcagtcacttagggaagttcaggaggcctgttttttcacgcttttctcagctcactgttttagttcgttctcatgctgctatgaagaaatacccgacactaggtaatttataaagaaaagaggtttaactgactcatggttctgcatggctggggaggcctcaggaaacttataatcatggtggaaggcacctcttcacaggacagcaggagagaaaatgagagcaagcaggtgaaatgccagacacttataaagccatcagatcttgtgagaactcactatcacaagaacagcatggaggaaacagcccccataatcaatgacctccatctggtcttgcccttgacatgtgggaatattacaattcaagatgacatttgggtgggaacacagagccaaaccatatcactcagtcacgtctgaagggaaggcctactcatttcatttagaacccctcaagcagaggtttttgagtgatcaaggactgacctccagcatgggtgatatgaggcccccaccggcctggggtgctggccacatcttggccctggcctctctgtggacctcaccctgggctgaacccctctgggctgtctcttcccttcttctcactgcatgtcatctcctgatcataaaggccaccacagcagcacatgtctgatcacccagagtgtccataggttccctggcactagtcccaggattctgcacatcactaattactactgcccacaggtgggccagcagcagctgggtaggcactgtgtggcaggcagaggtgctctctggctcctgagggctctgcagctctgcttccatttgctagtggcctgtgggccacagctgaccactagtgttctgtctttaacacaaacaagggcctaacgaccaggtagaccacctattgagctggggataggggaggtacccggtgttatagaaaactgtgttcttgatttggctgtacaaatagaaagtgacattacttatgcaatgccttgggggagtggaaagagctcatggcagcccctagctcaggccatttcaggccccatctagccctacagcacagctagaaggtcaaagcagggctatctcatagccctgtgtccacacaatcctctcagggcactgtggtggcccatccctggtgaggttcattaccctaatttcaagtttccttctgcttcagggaagcctggtcctgcctacaaagagtctgtctaccggctgggcgtggtggctcatgcctgtaatcccagcactttgggaggccgaggcaggcagatcacgaggtcaagagatcgagacatcctggccaatatggtgaaaccccgtctgtactaaaaacacaaaaattagctgggtgtggtggcaaacgcctgtagtcccagctactcgagagactgaggcaagtgagtcgcttgaacgcgggaggcgggggttgtagtgagccaagatcacaccactgtactccaccctggcaacacagcaagactccaactaaaaaaaaagaaaaaaagaaaaaatctttctaccttactagattgagctccttgtaaaagggactatgttttcttcatctccatatccccagtagctagccagtgcccagtatacactaagggctcagtcattgtcttattttgttgtctactctgacttaggacatgtcacttcccctcttgacctccatattcagatctgtgaatgagtaagtgggtaaagtccctctagctttaaaagccctccaatatagacagaactcagaaaccagaaccagaagctgaggaatggcgaatggaacattttccctggtgtgatggatgagaccgcagatctggctactagggtgatttttttgccacttgaaagcctctgcagaatttgaccctagttttcaaatcagactctagaatgatcttcagtgttggtggttttgcttttgagactgttattgacacaacagtttctggaaatctttttcaaggagagtatgggggcttctttggccaaattgggtgggtgcaggctccatcagctcagcagctgctgtctgggccacagcctgtctgctgagtcctgctcccctacagaggtttttgtcagaggcatttgaaacagagcaactccatcttgaatagaggctaggtaaaataaggctgagacccactgggctgcattcccaggaagttagacaatcttaatcacaggatgaaataggaggttggcacaaggtacaggtcaataaaaggatgcagtaaagaaatggggcaaaacccaccaaaaccctagatggcaacaaaagtaacctctggttatcctcactgctcattatatgctaattataatgtattagcatactaaaagacacttctatcagcaccatgacagtttacaaatgccatggcaacatcaggaatttacctgtctaaaaagggaaggaaccctcatttccaggagctgcccacccctttcacggaaaactcatgaataatccactcctttagcatataatcaagaaataagcacaaaaatagccaaccagcaccccgggggctgctctgctgatggagtggccattcttttattcctttactgtcttaataaacttgctttcactttacactacggatttgcctctaattcttttttgtgcaagatccaagaaccctctcttgcagtctggatcgggacccctttccattaacagtttctccagacattacagtgtgactggccatgtcatctgtcacaggtgtgaaaacaatcaaaaccaagagcctgaagctgccgggatgagtgcctgcagaggaatcctgctccctgcaggcacatctagaatgtgttcctgtgctggggccctgctctttccaagaaggcaggctccagggactcccaggatcctgctccctcggataccacagtctatgtaggcagcaggactaaagtgatgagagccgccatgatagtgagggccgagagcaggatggcggaattagaaggcagcgtcctgacccctggcgatgagctgagtcaattggtccctgtctccccctcagagccaccatcttgtcgtggcttccctcaggaacattatgagctctcccccaggaagcgcttcttggtttcccattgttaccggatggaaagtcttgactgccagttgtccaagttcttggtgtattgaacaaagacttgaacaaaatgctcaaacaaagcaatggacgacagcgacatacatttgttgaagcaaaaggacactccacagagtgaagcaggcttaagtaagtggctcaagaggtctgagtatgttccctggggttattaactaaaagaacttgataacaccctttagaggtttccaattggttacacactatgcaaatgaagacagcccacgaccaaccagaggctgaagacatggcctgcaatcaatcagaggctgaagtggagttacactctatgcaaatgaaggataggctcacgaccaatcagaggctgaagtgaagacttggcccacgaccaatcagaggctgaagtgaagacttggctcgtgaccaaaggttgaagttttcctttaggtttaattccaagaagtcagaggcaggttggccttaggctccctgtctccagaccctattctcctgcctcatcttctccagactcccaccaggtggtggcctctctggccctgccagggactgggcgcagggaggggaggggtggctgacaggcctgcctgaggcaggtgggcagtttgtggccttcgggcatggcctgctccaatggaggtgcctccttggcctgccccagctcagtccctctccatgcctctgggagccctgggcctaaatgcttttcatagattatttcatttaatccttattacagttgaaatggctaatatatttctatctaactgttgagaagattgcagcttatagagattacataactggctcaaagacacgcagctaataatggtagagctggaacgtgaacccaggtaaaatgactccaaaggcaacagagggtaaacaattattatatgtgtgttcattttattgttaccattgtaacaaaagaggtacaggcaaagacatttaaagaggatgtcctactgttaactgtatactctcagtcgatttttacttcctggtgaaaactaacttagaaatctacaaaaacaggatcaaacaggcatccaaatataggaaaaagtgtatggcactttttttataaaaagatggaatgtagtgaattatcttgatccacatcagtaataccatatatatacatgattataaattgttagagaaatatacaattaaaatgtataattgttatcttccaatctgagttacactagtttcctggtattagtaaaacaaatgtatggaaacccttatgtaaaaaactccagctacttgtgatgaggagtatctaggttaaggtcttacaactggtctactctgtaatatcctcacaattctcctttagtgcctattctaccactctacttcttccacttctttggcttgataaataatctccttttcgtgatcatattgtttttcattttttgtgttagtgcatccctcacaaactctagaactttcttttctgaatgctacttttcataagagcctcctacccccatctgttttagcttttcagagaggacctagaagtacacggtttcctgggtatcacatatagaaatgtagaaaagctttcaagaatctaataatccttctacctggccaacattcactgagggcagaaatctgtactgacttgataactggggatgaggaaatctgggaaagaggtatgtggatggtcctataaaagtgggaacaaagggtgaaatccctgtattgcgcagtaattttcaccagagagcacccactgtgtaagaggcattaaaccaagtggaccaaaggcttaaccaggagatagcatctggtttctgttcttggtcaccccagtgggtggacaatgagctcatgaacagtaaccacagtggctgagatggcgactttgcattggctcaacagcatgggtcccttcccaccaagactaatctagtactgctgctgctcaatgtctagcctgccaataagagacgacaacataagcccctgttactgtgccatccttcaagatcaatcagctgcttggtggcaagctgattatacaagatgccttccaacctcaaaagagcaacaattcatcctgacaagtgttcctgatagttttacctttcctaccacagtgcctcagccagcaacataatttggcaatctatcagttctgagaaggaagtttgtttgttttttcactcaaaagggctcctttaggccaaaaaaacaatcttactatccttttcaggtgggactggctggacactcaactggttgatatccaagactggcagcctagcataattaggggctcaaagcatatgagttgaaggcagaatgctaggcatagagctaattcatagcaaagaaaacccacactaccactagaagataacatgtgcctgttccgtaggaaagctgtattctttatgattagacttgcctccagagcctgccctgtgatcacagaactgaacattagaaacatgccactgggaacttgctggttggaatttactgcagtgcatttgtgagttcaggtaaattcgtcagttgattttagcccagtagacccagatgccaatttactctaaatctgcttaggtctgggttgtttaatcatcccacactttttagttttctcttatactctgggaaaaccattaagaggtgcccctgttgagagactgtcacatgtcagaaactttttcaggaagttcatatagaggaataactgtctacccctctagtgctgcccagaaatgcttggccccacccaacttgaatctaccacccagaaatgacttatgttaacaattaaacctcctctgccaacacttcagcacatagtgttcagattaccaaatacacagcccttggggaggtatgtgatctcatccttagacaaaaaggagatgggtggaaataattttctaaggccagcctgaccaatctcacataatgctatttgaactgtaccagcatgactgtgccagtacctgatcaatgatgaacacctccatctccttctgggtgtgaaagtacattatatattgatttactgctagatctagtctcctactggccctgtcctggtagtcttggactcctctaacatgtgccacaaagattagttctaatacctaaataaatagaagtactactagctttgaactatacctaggaattcaagtcatgcttcaaatatgcttttaattgtggctcaagccttcaatcatgaaaacctgaagatcccctgccccaactgaaaggataaaggtggctggaggggtgaagattggtatatactggatagcccagcatagcatctttaaagaatgatttttacctaggaagtatgttctgggctctgctctgtgcataaaagggccatctaactataggtccagagctagtggccttgctttcttgaactatgtctctgtgcccagctctggatcagtgatgggggtatctcttttctaagagatactgtggttggccagtctatgtaaggtctccacctctagactaatgagctctggggacatataaagcagtgaaaactcttttggtataaagcatatgactgaaagaaggagaaaatacaatttgcagaaggaggtgagttctgtcctagaagaagccaaagggaatgctggtcaaaccaaaccaaaatgccctctacaaaggagatgttaaagcccagggtttggccatggtatctgggttgctgaaaaggagtaggagagggagggattaatagaattaagcagttcgaggaatttcaaggctatagtatgtgttgaatttacaatcaagttccccaaaacattggtacgaaagtagaggaaaaaaagggttagaggtcagagcaataacatactcatttggtttaaaatttaatccccaactgataactgatcattttcagtaactccaattagttctcacattcttgcaaattaaagggaaaaaatcttcaagtcaaattctctcaattatattggtcatgatctaggtcactaaatctattaaaagaatcattcaaagaaaaatggaagcagctgatttatatctccacaaagcaaaactgcaaaatattttagagctcataccttcctgaaacacagctacttctctaaacactttattctctcttagatacttcttaacaattattagaattttaaaaattatattaagagaataattaggtgaaacaggacaagttccagtctctgaaaataattctagtgataaaacaagtccctcagaaatgacacatcctcactatatatgtttgactaacatccctgttaaaacataattgggtgatatttctcaggtaggtattattgttcttcaaaaattaattacacactagtatcatgaatggtttccagttcccttcccccaaatacaaatttgctccagaagaaaatcaataaaaggtaaacatatgcaagaagctaaactgaatcattttatagaaaattaaagccctatgaaataaactgctcaatatgaagagcttttgaagggataatcagggggtgagggaggtagttcaaaattctgccacatggacgcttgctccaagaattccaagtttaggctaccatagtaacatagatcagttacataatttgttaaatacatttatagatgtaaaatgaatccaaccctttttagtatagttttaatggaaaatgtattctaagttctaaaagaagttagcttacaaataactttctgaaacacaaattattttggcattaaagataacctgaattagatgggattcaaaactttagaaattcatacccaaaaaaagtacattcaaaatagcagttaaaaatacaggcaatatatgattaaaagccaaaatctgaaacatacacaataaatacttcagaagtttttaaaagaagttgatcaacatgggctacagagtccctaaaatgagaaggatttagatggaaaaagtgagatgaaagagctatatactggtcacaggcttgaatcagaaatgattatttaatgagagtgatacagctgaagcaaaatatttgagcaataaataaaaaaaaaagtaggatacctagggaaggacctggataaagaaagcttaacatgttaggctcaggagtctaagaactgggagctattccaagttattaaagaagagatatgatgaaaatagggacttaggaatattagtcaagtggcagtctctctgacagaggatgttttctgttactttcaggtgtgaatttgcaattctaactctcgaggcttaaaaatttttaatatacctgtacttcctttgtgacttagactatatcttgctgctattcccaacctgactagattccttgtctcgtagcctaattttacaattcattcatttattcaaaaactagctatgaagcacctcttatgtgtcaggcattgtgctagggatagcacactaaaaattacaaacccagaccctgtcctcatgaagctgagaatctaataggggattcagaatgtggtctgtcttgatgaatgttacatgtgagcttgagaagaatctgtgttctggtggtgttggatggaatattcaataaatgtcagttagatcaagttgattggtagcactgttcaggtcaactgcctgcttgatttatcaatcactgacagtgggatgttgaagtctccaactttcataatggatttgtctattcttcctccagtaatttatcaaaattaccatttaggtgcacctaccagtttacaattctagcagctctcattttaggtaaacagatctcagttgtgaccgtccacttttgtctgtttatccagatttcagggtaggagtttgccctgcaaattcaattttctaatgggtccaagaaaagtcattgattttcagtttgatcaccattttcttgttgtgacgacaagattgacaactttcaagatatatacacgttctagttgaaacaaggagtcacaaactgatcaccttttctaactgaaatgaaaagaatgtattctccaaatcaatggctgcacagcctgtaactgaaaccttattaatctactctggcagtgatatcacatcgggcaaagtagctgcaaatgaggctactaattgtttaagtctgcagtagcctacagtttttccccataagacacccagtttctgcagccattaggctggcaaattaaagagagctatgttaggcagcagtatatttgcgtcttttaggtctttaattatggcactaatcgctactgtcttccctgggataagagatgtttttgatttacaattttgatctgatgaagggagcagtttcagaagtttttatttggtcttttccctaccatgatagcttttacttcagaaattagagacccataagggggtaactttcaactgtcaagtatatctatttcaattatgtacttggtgatggagatagttatcactgcaggggtaggggagtctgtgggcacattgagcccactgtgatttggaatttggtcatagatttccactctaggaatcaacgttaactcagaccctgtgctcaatcatccttgagagatctagttatttccgtttcctcagtgtacagtcacctgtgtaaatggccagaggtccgttttgggaggactgtggatactgtcataatataaactttgactagtattgcagggcccttcttaggaatccagccacttctttggtcagtagtttctggttctggaaattagttcaggtctgggaaatgagtaaagaattatgctttccactgggctgactgtcttcagcctcctgctcctctgttcttgcttttctttctttaattagagatgctgaacagcaccattcttaattggcttggcaagcaggggaggaggtgggtgcagctcctgagggggaaaccagttgtcttgttgggaagaggcctccgcagcatcttccaggacagtgggtactcttctagcccttattagggaagggtgggccacctctgcacacccagagggttcaggtagacttgtagactccagatccttaggggcacctatccagatgtcctgtcagagttttcaggatccctggtcatccctatcagggccctgtccttcacataacagacctacctgggctgagcattcagatgcctctggagctctgcaactctcacaattaggtctttagcctgttgttttaccctgtccacccttccactactggtatagagggcctcttatgaggctaccaccaaggctttctcgtttcacatacttgttaacagttctcagcctctcattatccttatgtagggtgtcaatacaacttagcagcaaatgcttgcatcatggcttcttccacagtattctactccaacaggacattttccaagatcatcatcagtgcaatctttatgaagtgaactgccacattgggccaggatctattgctgtcacacctaccaatcagaacagatcctgctacatggtgagtgagccagttacaaattacctcctattttctcgtatcactatccatactcctagttttagaactggtcttctgagaagcagacactaagatgggattacatgtacaaggatcatgttatcagatatgcccatgtaaaaggaaatagagagggagcaggaggaggccaggagagcagtctgacagtaatgcaagtcttagccctagtaaaggacagtgagagaaggttggctgaaagcaaaagcatcctaggctgtaatgtagtctaggaaaagtttggcaaagccaaccaagagtactcacttctgcagcacatatactaaaattagaatgatacagagaagattagcatagtccctgtgcaagaatgacacacaaattcatgaagaatttcatatttttacaagccagaaaagataagagtcctatcttcagcctccttaaacagaataactctcagccaataattttgtatccagcaaaactaagtttcataaatgaaggagaaataaagtcattttcagacaaacaaatgctgagggaatttgtcactaccaaaccagcactataagaaatgctaaaaggagttctagaccttgaaacaaaagcccaatatgtaccaaaacagaacctcttgaaaccttaaaactcacagggactataaaacaataacacaatgaaaaaaaactatctaggtaacaattaatatgatgaagagaacagtgcctcgtatctcaatattaacactgaatgtaaatggtctaaatgctctgcttaaaaaatacagaatgaatttaaaaaatcacaaaccaaatatctgctgtcttcaagagactcacctaacatggaaggattcatataaactcaaggtaaaagggtgcaaaaagatattccacgcaaatagaaaccaaaagtgagaagtagtagctattcttatatcagacaaaacagacttcaaagcaataacacattaaaaaaaagcaaagatggtcactatataatgacaaaaggatcaattcaacaagaagatatttcaattctaaatttatatgcacctaacactggagatcccagatttataaaacattttaaaatgtttaaattttaaaaattactactagatctaagaaatgagacagcaacacaataatggtgaaagacttcaatacaccactgacagcactagacagatctttcagacagaaagtcaacaaacaatgaacttaaatgacactccagaacaaatgcacttaacagatatttacagaacattcttcccaacaactgcagagtatacattcttctcatgagcgcatggaacattctccaagacagaccatatgataggccacaaaataaatctcaataaattttttaaaattgaaatcatatcaagtatattctcagacaacagaggaataaaactagaaatcaactccaaaaggaaccctcagaactatacaaatacatgcaaattaaataatctgctcctgaatgatatctgggttaacaatgaaataaagatggaaatttagaaattctttgaattgaatgataataatgacacaagctatcaaaacctctagtatacagcaaaagcagtgctaagaggaaagttaatagcactaaaggcctgtatcaaaaaaggtgaaagagtacaaattgacaacctaacgtcatacctcaaggagctagagaaacaacaacaaaccaaacccaaagctacaagaagaaaagaaataacaagatcagagtagaactaaatgaaattcaaacaaaaaaaccccaaaagatcaatgatacaaaaatctggctctttgaaaaaataaacaaaatagaacattagttagattaaccaagaaaagaagagagaagatccaaataagctcaattagaaatgatcctggaaacattacaaccaacaccacagaaataacaaaagatcattcaagccaggcatggtggctcatgcctgtaatcccagcactttgggaggctgaagtgggcagatcatttgaggtcaggagttcaagatcagcccggccagtatggtgaaaccccatctctactaaaaatacaaaaattagctgggtgtggtggtgaatgcctataatcccagctactcgggaggctgaggcaggagaatcacttgaaccatcaggtggaggttgcagtaaactgagattgtgccactgcactccagccggggtgagagagcaagactccaactcaaataaaaaaaaaaaaatcatttgaggctgctatgaatacctttatgtgcagaaactagaaaacctagaggaaatggataagttcttggaaacatacaaccctcctaggttaaatcaggaagaaatggaaaccctcaacagatcaataataagcaatgagattgaatcagtaatttaaaagttgccaacaacaataagaacacccaggaccagatggattcacagctaaattctaccaggcattcaaagaattggtatcaatcctactgaaactatttcaaaagactgagaaagagggaatcctccctaaatcattctatgaagccagtatcaccctgatactaatatctggaaaggatacaacaaaaaaagaaaactacagaccaatttccctgatgaacatagaggcagaaatcctcaacaaaatactagctaactgaatccaacagcacatcaaaaagataaggtaccttgatcaagtgggattcattccagggatgcaaggatgatttaatatatgcaagttaataaatgtgatatatcacaaaaaacagaattaaaaacaaaaaccacatgatcatctcaacagatgcagaaaaagcactggacaaaatccagcatcactttgtgataaaaactctcaacaaactagacatagaagggacttacttcaaaataataaaaaccacacatgacagacccacagccaacatcatactgaacggggagaagttgaaagcattctccctgagaacaggaacaagacaaggctgccgacatgcaccactcctattgaatatagttctggaagtcctagccagagcattcgggcaagagagaaataaagggcatccaaattggaaaagaggaatccgaactattgctgttttcagacgacatgatcgtatacctagaaaatcctaaagactcctcccaaaagactcctagatttgataaacaaattgagtaaagtctcaggttacaaaatcaatgtacacaaatcagtagcactgttgcacaacaaaatgaccaagctgagaatcaaatcaagaactcaatctcttttacaatagctgcaaaaacaaaacaacaactaggaatatacttaaagcaggtgaaagatctctacaaggagaactacaaaccactgctgaaagaaatcaccgatgaaacacacaaaaaaggaaacaacatcccatgctcatgaattggaataatcattgtgaaaaggaccatattgcccaaagcaatgcatacattcaatgcaattcccatcaaaataccaacatcatttttcacggaattagaaaaaaaaatcctaaaattcatattgaaccaaaaaagagcccaaatagccaaagcaatcctaatcaaaaagaacaactctggaggcatcatattaccagacttcaaattatactacaaggatatagttaccaaaacagcatggtactggtataaaaaacaggcacatagattaatggaacagaatagagaacccagaaataaaaccaaatacttacagccagctgatcttcgacaaagcatacaaaaacataacttagggaatggaccctctttttaataaatggtgcagggaaaactagcaatccacatgtagaagaataaaactggatccctatctcttaccttctataaaaatcaactcaagatggatcaaagacttacatataagatctgaaagtataaaaattctagaagacaaggttggaaaaattctcatagacattggcctaggcaaagaattcatgactaagatgcaaaaagcaaatgcaacaaaaacaaaaataaatacataagacctaattaaactaaaaagcttctgcacagcaaaagacataataatcacagcaagcacacaacccacagaacgggaggaattatttgcaaaccacacatctgataaagaatctagaatctacaaggaactcaaacaaatcagcaagaaataaacaatctcatcaaaaagtgggcaaaggacatgaatagatatttctcaaatgaagatatacaaatggccaacaaacatggaaaaatgctcaacatcactaatcctcagggaaatgtaaactaaaaccacaaagatgctaccttacttctgcaagaatggctattaaaaagtcaaaaaaaaatagatgttggcatggatgtggggaaaagggaatgcttatacactgctgatgggaatgtaaattagtacaacctctatagaaaacagtacggagattccttaaacagctaaaagtagatctaccatgtgatccagcaatcacactgctggatatctacccaaagaaaaagaagtcattatacaaaaaagacacttgcacacatatgtttataggagcacaattcataattgcaaagatgtggaaccaacctaagtgcccttcagctaacaagtagataaagaaaatgtggttatatatacaccatggaatactactcaggcattaaaaggaatgaaataatgtcttttgcagtaacttggatggaatagaagggtaatattctaagtgaagtaacacaggagtagaaaaccaaacaccgtatgttctgacttataagtgggagctttactgagtatgcagaagcatacagagtgatataatgaactttagagatgcagaagggggtggctgggagggaaggaagggataaaaaaactacacattagtggccgggcatggtggctcatacctataatcccagcactttgggaggccaaagcgggcggatcacgagttcaggagttcgagaccaacctgaccaacatggtgaaaccctatctctactaaaaatacaaaaaaattagcctggagtggcagtgcatgtctgtcatcccagctactcaggaggctgaggcagaagaatcgcttgaactcaggaggcggaggttgcagtgagccgagattgcaccactgcactcgcgcccgggtgacagagtgaggctccgtctcaaaaaaaaaaaaaactaaaaaaataaataaataaataaaataaaataaaactacacattagggacaatgtacactacttgggtgatgggtgcactaaaatctgagaattcaccactgtataattcatccatgtgacaaaaaaaaaaaaccatttgtaccccaaaatgtattgaaataaaaaatttttgaaaaaagacatcagggaactttaagttgaagtcagctaacaatggagtcccatgtttcgcagtaatgggtctgctttagtagctccactgcacttaatcataggcagagaatagcccttaggaagtataaacctgatacaaaagtagtaacacatgtaaaaattttttgaagcccagcacctagggtcctcaattaaccttcctgtcctgggaagtctgtgaggttcattgttgggtcaccacactaacttttctatttttttaaattattttttctctcattttttcttcctatttcttcccaatcaacacactaacttttctaaagggcatttcaggttttttgctgaagaatcctccaatctcctaccccataaggtttaatcctagctgctggtttatggagtagggcaggagaagagagctgagagttccattattcaaacggcatattttcatttgatcccatcattcttagacctctatctcactcacatgtctctgtgtctgaaactccaaagtacaagagctattgcagtttaatttctccagaaaatagactcctaactgaaggagagtatcccagctgcgtgggatggcagaggggtcccagtgaccaactgttccatgtgttcatcttcaactgtctcccagttttcagctcctttctcacccccaccttcttccatacctgccaagttctaaagcactaagcaggtcagaagagtgaatgcattattttcactgatattcttctctgcaggcactctgttgttgtttcctcaacttctatcaagtcaatttgtattcttccagctatgagccttccaaaatttgtttaaatcactcacctgctgagatttcttcttatccattaatttcaatgatcagctatcatgtcttgtctaataaatatcatatccaaatgtaaaagtaggcccctgggtgcctattcttaacattttcttcacaattcaaactcaacttcacctattttggtgatttatgataaaaaattatgattttacttacaccaattatacccacagttttccaattttacatttgttattggattttgtcaggtgggagtactttaggagttttatacatgggaagaatatgggtttgtgagataggagcatgtaagagtgaacacaccaaatgatgtaatagttataaaaaaaatatcctgaggccccacacacatactgccttacttactagcttcacaagcaaaaaatgttttgactaaaatggggaacattctaattatgcacatttgcattttttaaagcacaataatactacgcttcaataatatttctactattctacaagatttaaaaataataattttatactcaaaaactgtgaattctaaaatagatcacatttgagattgctaacaacccaccctggtatttgagttagaaattccatcaatgtttttatttaaaatttttttgtaatgtactaatttctaaagctttataagcaccatgtggaaaatgtattaagaagcagcttcatagcagttgtggtcttcgtgccttgtccttcgttctttcttcactattatctttaagctttaacaccttggtttcttcctccagcctctaacacatgactttgtctcccagctctgtgcgtgttcattctctccaggctcaacagagagacacaaagtattttctcttctgcagttagcctcagcattgcccccacacacagttacagctggtgtggcccagaattcccagaataacccacttcattctccttctctatacctgcttcctatgagttgtgttttaggcatactatgctttgaaattatactataactcaggaagttaggatgtttcattgtggcaatctcatgggaataaggccagcataaaaataaattatcctggggagacgacaaaaacacattatagattttgcaaaaacgacagcaatcatgaagtaacctggaccattaacaagaagatatttgtaattatccacttataaatatacataccagagatccttgaaaagtataaaattgtactacaataactttaaggttccctcttattttactgactccaaaatgaactagatatctttaaaacagaagaacagactctctcattccatcacttccaattcactggactgttcataacttaatgttcttgatcttcccaaggagctgcttttatctgattatataaatcaatggtaatatactagaaaactgcagcctggaaagacaaagcaacgccacagttaaactgaaaattctactagatattaacaacaacgaaaatcatatacataaagctaattctattatcataaaagagctgttttgttttgtttctgacactaataacttcttagcattccaagcaataacatatttcacctacgatcttgttttaatttgctttttaaaggtcattttccaagagtagattgaaacaacagggtaagaataagaaatttcaagatactgtttacacacctgaaataaagtatacttaggtttttaaaaaagtccctcacctctatccaaagcagagagaaaattccattagctgcattttttttttttttttttttgagacaaagtctccctgtcgcccaggctggagtgcagtggcgcgatctctgctcactgcaggctccgcctgccaggttcacaccattctcctgcctcagcctcccgagcagctgggactacaggcgcccaccatcacgcccggctaattttttgtatttttagtagagacggggtttcaccgtgttagccaggatggtctcgatctatgacctcgtgatccgcccgcctcggcctcccaaagtgctgggattacaggcgtgagccaccgcgctcggcctgcatattatttttaaaccaatgattgctaacaaacacacaaaaaaaaagtaaaaaaaaaatcactccactgaacgcttacaaaagaaaaaacaggagaatacaatgtagttaagcacagctcctatatatatagtacttttcaatataggcaactgcaacaatgaaagaacacagccttctacattcttaaataccaaatgcccccttgtggacagcactgttactagatttgcatataaaatctgtttaaactaacttttctgtctgtgatttgaagctatgtacctatcaattgaccattctgatcttggagagaacacaaacccagtgagggctgtccacagaacacctcaggaggcagtctcagagattatagcattttaataacctcaatactttaaaaatatatacttacacgtgtcaatagtgctctagtgtcactaattttaatgactggttatcaggcattaaaaacaacatttctaagaattttcaaaaggcataaactaccacagtgagcccagtgggagcatgactaattgggtgtacagtgaggtaatgggtcccaggaagacccaaatagggctggatgtccatcaggcagcacagctaaaagaagaatctgaatcatggtaaagaaattagtatcacagtcaggaaaatggtgtggggcaacaggatgaagaaaagataagtaggtcaatgagtaataagactggaagtcagagagtgggacatgacatggaccacaacagagaataatagaggggagagtcttgcttctctgaagagccaggtgtgtgataaaaacaatggcccgatggtttaaaagaactaagacttaaaaccatctctttcttcaggcttctcttgcttttgtaatatgttcttctcctgtttgtcctatggcaagctgaaacatatgtctgaagggaatatagacaaacaggcaaagattaatatttcaaaaagccaattcatcaaaggattaatttgcagggagaccaatctacctacgattccaaatttactaaaaattcgctttaaggaaaatcattcatatatgtgaacttataacctgaaatatactctttttctaagaatattttcaataataatactaaatgctaaatgatttccgtaagttttgggttttcaacaaacatttattaaaatgttactaaataaaattatattcattagaacatattcaaggatttggatttcggcaaattggcttcctgtgaattggttttctacaaattgatcaagagtcttccagagaatgtttgagatgagattaagtattttcctaaataatgtttctctgtttctacaccttctcccccattcttttcaccaccagctagtcttgttagctttaggaacaggatccatctgactgactaagcatatgcactggtgagagatttccctgaaggatccaagctgcctgggtgtagtggaggacaagggggagggtactgataggaaaactagagaaagagaaaaataggggtcatcacttttatgactctgaatgagtcaaggaataggacttccactttgcaatacaattgactacagggatatggtggggcttgttgataagagccattacagtaacttatcacaagcaaggctgtattccacatctttctctgagggatatacatcccctatatctgttgatcttaagttgtgctctgtaatagagcctattgtgaggtctgccaaaaaaatacaaatgtccaggccttactccagacctaccaaatttctggggaaatcctcagaacgtatacttttaatatacattagtatacatacataatgtatataaaagtatacattaagcagcactattcacaatagcaaagacatggaatcaacccaaatgcccatcaatgatagattggataaaggaaatgtggtacatatacaccatggaataatatgcagccacaaaaaggaaagagatcatatcctttgcagggatatggatggagctgaaagccatttccctcagtaaactaatgcaggaacagaaaaccaaacaccccatgttctcacttataagtggggcctgaacattgagaacacatggacacagagaggggaacaacacacactggggcctgtcagggggtagggtgggggagtggagagcattaggaaaaatagctaatgcatgctggacttaatacctaggtgatgggttgataggtgcagcaaaccaccatggcacatgtttacctatgtaacaaacctgcacatcctgcacatgtaccccagaacttaaacattaaaattaaaaaagaatatacctttaatatatattaatatggctacaggtctttgctgaacatacctggaaattcttggaaggaatttcaggtaggcactaagtcccgttttggtgaatgcacatgttagagactagaaaatgtacacccaactagctcaagggaagtaaaggttctgcactttttattaagagggttaaatatcagctgggtgaggtggctcacgcctgtaatgggaggctgaggcaggcggatcacctgaggtcaggagttcagcctggccaacatggcaaaaccccatctccactaaaaatacaaaaattggctgagcgtggtggcaggcacctgtaatcccagctactcgggaggctgaggcaggagaatcgcttgaacccgggaagctgacgttgcagtgacccgagatcgtgccattgcactccagcctgggcaacagagcaagactccgtctcaaaaaaaaaaaaaaaaagatgttaaatatctaatgaattctattatagttttgagaaggtaccaaaagattcagaagattcacaacttatataacagcacagcttaataagtgaaaacagattgcacatctttgggccttatgcttatcccttccaagttgattggggttaatttcacaacagacttgttttaataaaatagtacttttcctttatcaagggaaaacagaacaggaactaacagagcttactatgtcaggcactatgttatttgttttatctatctctaataatcttcacagtaaccctgcatgagagtttaattaactcaatttcacagatgaggaaattaagcctcagagagatgaaataacttcctcagtgtcccatagtctgaatttgagccatgatggtctgattccaaaacctacgtttcgagggaaaataggttatactcagtacattttctcacccctactcttccactacacaccacatcacattttctcctatgtcctagcctctaattggcacttctttcttcgcttttgaataatttgcctgaactctggacaacgtgttttatcctctcctacagcagaattttctagaacattcttttcctgaacattcataaagccttccccttcttgacttctgtgataccattcttccagttgtccccccatcctttctcaatatttttccttctcaataatattccctaaattgcctcctaacactttaaatgtcagcattccccagggtttcaacctcaattctatttttcagactgcatatttttcctgagcaatcccttgtagtttcatgactgcatgtgacacttatgacttggtgatctctgttttcagagaagcaactttccataatccaaaactattttcagttgcttccaaaccactatcacctgtgtaatacacacaaacaaaactaaacttaccatttcctaacatcctaatttcaatttctattatcctgttcattgtaatccatgaagttattcaagccaaaactctcaattgtcattaaattctcttgcagtcttacccaatatctaagtattcatgaaatcctcattcctaaatagatctttaatctgtctcctctgctccatccccatataatactgcccaagctaaaaaaaaacccaccttcccttacctagactacgacaaaagcatcctagctggtttctctgattcaattctaacccaccctgaggaatcctttcttcatggtggttggggtgggggtgggaggatctttcaacctctatataaaatatttcaatagcttcttatcatatacaaaaaaaattcacactccctaccatgaataccaaaccctttattatttagcccctgcatattatttccagcttcatcgctcatcatccctcttatttattccagacatactgaactaactgtagagctggggtgtctttagacagactgacccagaaatactttataataatttgaaaatctacctatcttatgattttaaaattccacttctaagaacatgtatacttgaagcagtggttctcaaacttttttattagaattacctgaagagttaataaaaatatagaggtggcaagtaggttgaaggacaggacttggcctttgtatttttatgaagtgccctaggtgattccataacctaccaaagtttatggatcactgccttaaagcagaggctggcaaactataacctaaagatcaaattcagcttctgcctgtttttgtaaaccaagattttttagaatacagcccaccaattaggtgttgtctatggctccctttatactacagcagcagggttgaatagctacaacaaagatcagagatcatacaactgcaatgctgaaaatatttactatttatccatctacagaaaagtttgctaagcctagaggaacactttgcactgaaagacacatataaagatattcactgtggcaatgcttgtcatagtgagattttgaaaaattcatgatgtacgtaaataggctaatttacgtaattcatgatgtacgtaaatatactaaggatatacacatataatgaaatactatacaactgataaaatttactagatctttattaacatgaatggaattaaataatgagtaaaagaatgatatgcacagtatgatactttttatatgcatttttatacatacaacatgtagagagatattaaaaataaactgaaataatatataccaaattcatggtagtccttgcctataaaaaggaaacaaaaagaagacagggaggagaataaaagggatctcaactctataaattgttttcattaaaacatttaaagtcaaaaagggacaaagatctgaagatttataaatactagaatatggagttgtttgccataatacactctgtgggtttcaactcaaaattaaaaccagaaacaacctaaaatacccagttatagggaaaagtaattgaacattcacattccaacacaatggaacataatatatcattgaaaaatgcacatgaagagaacataacatatgaaataattgacttaattaccccaattagcataggattcaaaactgtccatgcggtaaggttataattatattttaaacaacaataaaaactagctgtaatcctttttcactttgtttgttggctgacttatttatttggttgttctttttaatcaatatgtatgcatacaaaaattactaaaaacagaactgtctacagtggatatgtttgattttatgatattctttttctataccttttattttccaaataatatcagctgaatacatgttgaacgaatatgtatgaatgaattgaatgaatacataaaatgaaatgccttcactttaaatgactttgtgtgtggcagatacagccaactgtacgctcacaatccactcttctcttcttcctgtatattcagtaaaacactatatttcctagcctgtcatgcacacgaaggtgcccatatgatacagttctaactcccaatgaaatgtcaaggggaattactgggtgcagcatcttagaaagctctttgaaggggagtagacgtgaccggctttcacctttaccatttctccttcacctatgtctttttttgaatgataacgtgaagcagctgagaaggcgaagcagccatctttaaacacgaggacaaaagccactcacaaatggatggcagagtagaaacttaggggaagcctggattcctgaaggcattatacagccactgcaccacccctggactgcaaacctcatactttctgtcacatgaggaaaaaaaagaaaagagaaaaaaaaaactttacttgtttaaacctttctcttacattctgccaaatgcaacccttgatacatcatgctaaaataaaattttaataaattaccccactgaaagacacttagaagataatataacgtatcttaccttcagaggagaaaagtgaacctcaagaaaaaaaaaagttggaggcaccaacctattatcagaacaaagactaaagcttcactctcacttatgtgaataattttttctaaaatattaaaatcacactgaactttacatttcaaaatggctgaaacaggcggggtgtggtgacttatacctgtcatcccagcactttgggaggcgaggcaggtggattgcttgagctcaggagttcgagaccagcctgggacacacggtgaaacctcgtctctactaaaaatacaataattagccaggcatggtggcatgagcctgtagtcccagctattcaggaggctgaggtgagaggactgcttgagctcagcaggcaaaggctgtagtgagccaagattgaaccactacactccagcctgggtgacagagtgagaccctccctcaaaaaaaaaagaaatgctgaatggtaaattttaagttatgtatatttaccacaataaaagagagataaaattatattaaaatgaagtccactttaatgatatagtttaaagataacattttatacatttttgtcaaataacatataaaatattacacatatactagtcaacaacgagtgcccatccttttgctactcataagcaaatctgtagtttgaaattattcaaaattagtattcaaactaacacatcaatttcataagtatgtctgtacagattactcctaaacactaaacaatccacaacaaggataaagaatcgggaaatttacagatggtatttgaattcatactctatcccacaaaagcaactaatttaagcccttttccctaattgtcaatttaacaggaagccaaaaatatgtctgcattacacaattatatgtctgaatttcacaaatattattctttatatcaaagaataagacttagttttgtccttagctaagagggtctcttgactggatataggattgttggatcccaatgctttttgcttagtaattggacacttctatcgctgactccttgattagatttctaatctctgctgctcagacacacccctcttggattcatgagtaccaaacactcatgaaagcacctgtccagagaatagagaggaccagttctgtttatactgaactttcattctctttcctttctgcttggtctgtggtcccactcttcgttgtgctaatatttcttcagtcctttactgtggagaaatataattctctgtctctggatctaaattattaaatctcttagagaaccacattttcttcaaaaataacacaaatacatcaaggaaaataaatgtattttttccaacatgaatatgttccagagtctcaggtagtagttagaaaaccaattaaacgctccttagatatgccctaaggtattttactaagtcataccagcacttgttgctactctccacaagggtggtgatacccactctgttgagctaggactgagcctcagttatcaagaagcaggtagacagaatattttatatccagtaggtagtaataaaattctacctgcaattaagaaaaggcactaagcttaacatagccctagcaactatttctaaatgccacaagagggcgatataactctatgacagcacatgggaaaacaatttttcgagttagaaaaattcctgactttccaagatatggaaataaaggcatgtctgggttgaaagtaacaagcgtgcaaaaggacttatttctcctcaattcattattagcaaaaacacagtatttgtctatatctttctctgaaggttggcggtgattcaaaaagcaatatctatacatgctctgctcttcaggacacctgtgaatatagctggcaacttagtgctccacctatagctactcaaaaattatttgttgtccttcaaacagatcccttgaacaaaacagtttatttggaccttgcgctagtcttcaaacttctctttgaaatacgtctggaaaaaatagacataatttccttcaattattctttgtgtttaatcacatttctactcaccactggcattcgttcatagacacgaatagaagatagtctatctacaataaatcaaatatgagcacttaatgttttatcagttttaactcaaattataaaatgtacatatgattggttttgtacctgaagagtttccatggattttttccactttctccttgagataaacaatttgcttttctagttcatcatttaattcaagttgtgtctcataacgggttttccattcactacctgagtaaaaacagggagaaacaatcaagatcaccccaccacctctcatttattcattaaaataacattatgagcttgatcttactctattactatatttgactttattggcaatacagatcaactagaaggaaatagttattaagtctgtatttctgttagtaagattttccagactgcaagaattagactcacactcaggctaccaaacagccaaaccttatcacaactactgcaattcctcttcttccctacttcccacctgcttttttcttttacttcttgtgcatccttacaatgaattcaattagagggaatatcaggacatgtttctttccttggaacttgaaatacccatatatataatatccatatatttcatatatgatatttcatatacatatccataaatatatatatttcaagttccaaggaaacttgaaatacatatttatatatttatacattttatatatgtttatgtgtatataaaatatcctaaacattactaacctatccaatgtcatgttcattttttttcctttgaaagcaattctgaagtctgctgaataactatcacttacgtgtctgccgtgtgtaaagcacacaatgcttcacatacattaagtaatttaatcctcattttagaaatgtagtcacctattttacaaagatgaggaaaccaaggctcaaagatgtcaatgtcaaataacattcttaagatgacagagctaataaataagggaaccgggtttttaatccagttttatctgcctttgaaatcatatcctcttaactcctaagctgaaggaacaatgtacatttagctatcttctcaggcattttctcttaaccttaagcagttttctttcactaaacccttttagctattaaagtcaaagcattttccttatgtctggggaaaaagaagaatacagcctaaaattaaaaggtctttgttcagattcaaagcccaaagctaactttttcgagtctttaaagtcaggctttgtagagggcaaaaagatggcttctttttcaactttaaatgctcttcacaggtctgaaataactgctgctacataacagttagtggaagagttaaggagaaagagtattagcacataccactaccaacctcctcagccctgacacaggtctcccttacaccctcatctctatgcaaatgcggtctaccaaaggggatggaaccccctcccatactgaaactgaaagtcattaacccaaaagctttggaaaggtacaagaagaaaggagaagccctgaaagactaaacatttacccaaaagatacagtagagctcaactgtatggaatcatctttataacttgctacctaaagtctccctttgtcatggtatcccctttcctaacatggtaacggattcttcagagcaagatgagaatggttaccaaaaaattaaaaatgcaatttatttttggcacatctgagtacagtttataaattttgacaccattttatttaaaaatattattgacttttaagtcaatcatcaaatttaattatcaaatatagacaagccagccaggcacggtggctcacacctgtaatcccaccattttgggaggctgaggctggtggatcacttgaggtcaggagttcaagactagcctggccaatgtggtgaaaccccgtctctactaaagaatacaaaaattagccaggcatggtggcaggtgcctgtaatcccagctactcaggaggctgaggcagaagaattgcttgaacccgggaggcagaggttgcagtgagctgagattgtgccactgcactctaacctgggtgacatagctagtctgcatctcaaaaaaataaaaatttttctcaaaaaaataaaataagatagatagatagatagatagatagatagatagatacatagatacatagatacatagatacatagatagatagaccgacctattagtatacagtcgtaaccaaatggaatccggctgcttgccacttacagagtccaattaataagagcaaggtctggcataaagtggctttattaaccccaacatcaacatgggacaacacaaaagacccaagatagacaccaaaacaagacacacagaccttgtaaccagcacaactcctgcatgcctcccatattaagtttccctttgaaagccccctgccttttccctagaaattggacatggttattttggatgggaatctggccacttgtccattattagttttggtcaatgaagtcactttctctctactggacctcgcttttgttaattgaactatgcaatcagcacttacaattgctggttacaattttagtgtcccgtatggtgagtgctgtatgctccagggcctgagcctgccagtctggtttctatcagatggggcatagggccacctgtgaatactagttgctgatggctagctgacccatggctaggatattagggaatttcccagcagctgccaagactcttttgtcttagggatcctctcttttcttcctgctatggtgtctgctaccttcaatgcttcactggtgcaaagaaagtgacctctggagaagctgagaaactatggaactaggtgcattagtcagagtgtacccaaccaccttctgcctcttttggggtgtcgctggggctctgctttatttagacttggctgccagtgaaactatatgagcattttatgcattggttttgtttgtatttgctgcacccttgggcctttgctcagttctgactcagttgcctgggggagccatttgaaactgaaatgagggatttcggagtctacacagccccttaaccagggatttgtttggatgcacaccacctgtttgtccgtgtgtgagatctttgtgcaccctgatctctttgtctctctttctctctctctttccccttttttccaacttcatcatcctgattatctcagaagccatctacagccctactcttctcagccaaaaccacccttcgctccctctggctggaaacagtttaccttgactggtgacttgaggaaatgggagggattcatcccacacccttcagttctagggtgctgaggctctccctaagaggagataaacaagagaggtaggggtactgtgcagtggctggaaggctcataaacctcccttccttcttttctctttcctcttcctgcccataaaacctgacctcctttctcctctccactcctttctttttctcttttcctgttcaaaccaggaaaccagtactgaagagaaaaaacaattttcaacatcctggcccctgattttgtcatcctctttgggactgcagctgattacatatggtgcatttttgtgtacattttaaactgacgggcaaattacagcaagaaaaatttagagctcaaatagttaacctgaagctatagagttaagtagagtcttctaaagctatcttccctcttcccctcttttctgcctgctttaaatctgctgttactaagctgctggtgctaggactcatttatgatctaactagaatgtaaacactggaaagttgtttgaaactgaaaataaaaaataacaagggtaaaagcggtttaaaaaaactgccatagagactcctttacccaaaattttggttcacaaatttccttggattacctattagggcaaatgaagtttggccatatgaacaggttccaattttgtcagaaaaagaacttgaagccagctatcttttgtaggtctgtgagtttgtaatgctgtctcatggctggagttccaaggtaaaagctattggttatttctttgtgcatgtatgtatacatgtttagatatatttatgtaatattcatgtattatgttctgcgttgtgtctagcatgttatcaaactggcttataagtaaatgagtactcaaaaattaagtccaaatgcttttcaagtgcatgtgaatttttaataaataaaagtggttttaaaattattgataaaaatagaaaggtcttcagaattgtccccatacatttttgtctaagtggttttatatttgtatcagtgtgtatacaaaggtgtcaagggttgacataaaggttctaagactttaaactcaaccaaaaacagaataatctttgtgtatttttttttgacaaataagactaacttgttagttcaatgaaacagctaaatcttcagagtcatcagcaaatacatttaattttaaggttcttaattaggtgctcaccatttagtgttcagattttaaaaatggttaatagggaaataactttattatttatttttaatttttttttttgagatggagtctcgctctgtcacccaggctagagtgcagtggcgcaatcttggctcactgcaagctccacctccctgattcacgccattcttctgcctcagcctcccgagtagctgggactacaggcgcccatcaccatgcctggctaatttttctgtatttttttagtagagacagggtttcaccatgttagccaccaggatggtctcgatcttctgacctcattatccgcccgccgcagcctcccaaagtgctgggattacaggcgtgagccaccgtgcccgacccggaaataactttaaataatgattagttttgtgtaatatctcagttttcagaagtaatctagataaactattaagaaatggaaaaggtgaatacatgtaaatgagataaatgcttgtaagtggactttttgtgtaagttaaaatcttaaaattattttgaattaaataatagatgctccaatccaatagataataatttgatttctgggacatttccaattaagaaaagattatgatatgggaaaacatatttctaaaattgtagaatggtttcatccagaaaatcctaacatctgataaacagttcaggatttcttgcttcctaagttttcactaaaatttaaggttactaagaattctaatatataattctgcaagttgtgttctcattttttaaaaaagagtaatttaagtaattcaaaggttatttaaaagttatttctaaaagaaggtaaaaaagaatcagtgagtaggggagagagatataaagaaagttgtggatacaaaaatgtatttataataaaaaagttataaaacaagcaaataattttacatgagaaagattttatatagtaaattcttatcctaaaataaaatggctagttattcagaaaacagaaaattttaggacaagtcagaaagtccaagcatgtaataaatggtctatgtaagttatgataaggttcataaaaggaaaattacaaaagctattttatatattaagttggctataattagaagggaattatttttaatagtctttctaagattgatcccctatcttaaaacaaggttttcttaaggtattacttttctcttaataaaattacaagagatttttaaaattttagaaactgtttcttttaaaagcttctcagaatcatatctcagaagttcaactattgctgtctcactgctttcagctttttctccccctgagaaggtctgagatgacagctctctccttcagcttctaaattagcttctgtaacttttttcctctggttccactgttgtggcctgatgctaaaatgttttatcttaaaggtctagaaaagcaatattttccttcagtataatttgattctgtactcttggctttcttgatagatgtaaatttttcaatgtaatcaagaaacttctcatgcagttactaagaactatgtattcctctgctatactcataaccctgaacacattcttcctatgtctgattaaattcaagaatatttttcatcaggtttaacttccaggttgtctaaataggcttcctataaggaaaagtagtcacactgcaggtttttctttgcctttctggtaactggcgtaagaaacaacattttactttttatcaaaataattcatatgttgtcttcattagatttttaactgcttagaaaaactgagacctaaaaggctgaaagttgttatatgcatgtaaccttctgtattgcctttaagtctttcaataatcattttggttaaattagtaactattggtttacaatgacctgtggatctgttttaatcaaatgttttgagccctttaacatttttaagaaacatcttcaaaattgaaacaaaaattaagtctctggcttattgctggtgtttatcaaagctataaaagttaatcactgcaaggttatagaatctttttacagcttccagtcaagtcatagactccagtgtcaccacctccagccccttaaaaaaaaggtccttatcaggtgttattaactaatccttgtgctatgaagttacagggctttgactcctgggtacacatatctcatctaaagaaggcagtgactcctgccagtatctgacagcaaatctaagttaaccgaagccccatttttagatctgggcaaagatgacaatcatagtaaactactttcatgagacacagggacacgcctgtaccacaaaaaaattaagattctcttaataattttgcctctatctaaaataatataatttattctgtgcctaaataaatagatactaaataatttaaatgtttaaatttagtgcctaaattgacactaaataatttaaatgtttagctacctataagtttcctttcctgtaactgtcagaactaggcagggcttattacctttttgtttgaaacactgctaatactttacatttttttttacctccagaatttgaaactattgaatccctccaggcccaggggctatcgcagaagtgtatcattgtaagggccagattttgagggataaaattaattaagaccctccaaatcaaggacagacacacagatgcctaaacagctgaacaatatgcttgtgttttgtacagctaattgctataagtcaagattacagtatctcaatgcagagaatttatagataactcaactttataatcttattttttgagttttggtttttggctcttatgttgcctaaaaggggttttaaagattactgaatacctgctcacctccactcccatctggcctaaaacgtttaattggatttaagtctttgactctaagttccttggcaataggggtcccactgagaggcacgatggaccaggggcaagtagccacaccatcccagaacttaagttaataaaagcttagctatggataccacctctgcataccttgaccaaaaaagggggaatataaactaaaaaaaaaaaaaatcctaagccccctcaacagactgaatgtatccacctcttggccaaagggaatcccaaagaaacctgacaaactagttcaggccattatgagaagtggagggttggacatgccacactataccttcccccaatttggagtttaggcacaaatgaccagcattaacattaaaatagagatcacataagactgacaagacagactctgtagcaataagatacacactgttatgtttcacttactaacaaagtctctcagaagctcagcaaacatgtgttaatgctgcaaagctttcccaaatttattttattctagagtttcctgtatgaaatctcttatgttaaataagtaagaatttggactaaacagttatgcctttatagttatagtcttctgttatctcttcatacaggtcctcatatttctggtcaggaatattgtcagatcttttatggtttcggttggaattgtgggtgggatcatttaaaaaccctattttctaactggttattgctggcatttgtttttttaaataaatatttatttcatgattgtatccaactattttctaattctttattaatatactaatctttataactgtatcacttcctctctaatagctataactcatttctatttcatattttattgcttaattagaactttcaaaaactatattgcattttaataatggcagcaggcagctttggtattttttcccccaagaatggaaatgcctctactatttcattgttaagtattatgctagtttgagataaatagaagtattcttttccttgttttgaaaaacaaatggaattttatttttaaaattttagcatttactgaggtgatttaaaaaaatatattggatttattaatatattacctactagccaaaggtatttgggcatagaaaccagcctataaaagactcaaaggagaaatccaggatgaagatgtaaacttgtgtgttgtcaataagtcttctttttttttttttttttggatggagtctcgttcttgtcatccaggctggagtgcaatggtgcaatctttgctcactgcaacctctacctcccggttcaatcgattctcctgcctcagcctccagagtagctgggattacaggcacccaccaccacacctgactaatttttcttttgttatttttagtacagacacagtttcaccatgttggccaggctggtctcgaacttctgacctcaggtgatctgcctgccttggcctcccaaagtgctgggattacaggtgtgaactgccgcacctggcctccatttttcaatctataaaacggaggtaatgatattattttcaaagggtagttgtgaggtttcaatttttttaaaaaacgtacttaaagccctacacaaatactaattcttcttgcttaaaaaaaaagtcacctgaacattttctttaccattttcttattactaaactttgttgtgaaattcaaattaaaacataaaaccaaattttctacatacagtttcctatgaatcctaaaaggcttcaagaggtgactttgagaatataaagctctttggagttggctgtgtttaccacctgcctaaaaactaatccagtgacaagcaagatcaaacaataagcagatgagaaagtagaaataaaaactactcttttgaaggcttttgctgtaaatggggcagggacaggggatgctagctgaaggggaaaagtggggccaaaagaagcctgtcatttgttgtttagataaaataaattcagcatgttggtctgctgttgggaatgatccagtagagcagggaaaacagacagtgtagggaagagagggccatcactacagtgatatccttgagtaggtgcaagtaggtaggatctactccacaaagggaggagataacctgagacaagaataaggacagatcattcatagaaacaagagggaagaggatgtgcaagggtgcaggtagatgggtagctctgttggtagaaacaggtagaagtcctcttctgattgcttctcttttttctttgaaagaagagggtaagctcattacctgagagtgtgattgagtggagaggtggtagaggtttgagaagaaagcagaaagggtgaaaaaattatctgaacagtgaatgtacccctatttgtcacatgtgcgcatatttccagtaataaattccttttaaaacacctttaatattgccccactgccttcaggataaacgtaaattcattagcatcatgcaatcttcttgatttatctccttcataaactttaacctcatctcctaatgcattctcattatgacctatgttccatttttatcaattacttagcatattccccaaatggctttatgtttaatgctcctgtggcagactgtattttccaaagatgactgccaataatatatcccatcccatgtgttgctctgtaatgtgaccttaaaagcagtctacctctccagtcccttgaatctgtgactactatgaccaacagaatacagtggatatacccctgtgccagttctgggagtagcccttgactggcctggcagtctctacttatgtcttttggaatgcttgctcttgggatacatcctcttggaacctaaccaccatgctgtgagaagaaaaaggtacaagaggcatttctgacaggcagccctagctgagcttccagtcaaaagccagtgtcagatgttagccatgtgaatgagtcatcacggaatgaccagctcacttgaatcttcagtatacctgattgcaaccagagaccccaatcaagaaccatccaggtgaaccaacccagttaatccacagaattataagagtttgttgttttaagctcctaaattatagggtgatttgctatgcagcaaaagacaagcagaagtgttttgagtgtgatgtggtagatggaagttgtattatcatttactgaaggcatggtaaatagatgatctaggatcaagtcatggctctgccactacctggctatattaccttagaagttatttgaattcctgaatttcattcttccatatatggggataataataactacctcacctgacacagtccctggctttaaaggagtaaatgtttctgcccttcaccttaggccttacttttggcccactaaggaaagaactttctctcctatcattctgacgttttctctttatacccacatactagctccttcttttgagaactgctacaacttgttgagccacattttactactgggcatagttattgcatgtgtacctgtgagcatgccttctgtttttcctgtaactgggtacatgaggacgttccagttaccctgccaacgcagctacttgataagtacactgagagcctgcccccagagactgaggttatatctaagatatagatatggagatagaggaagctacttcagccttgggacaaagtagtattctgcaaccaagctttaacaaagcactgggtacttatagaaagtggcattttatttcccatatggccactattcctttttgttcatggctccccaattgaggaagagtataaatgtagcaggacgagccacagacaaaacccctcagacaccaagttaaagaaggtaaggctttattcggccgggagcatcagcaagactcacatctcaaaaaaatgagctccccgagtaagcaattcctgtccctcttaagggtttagaactctaagggggtctgcatgagagggttgagattgattgagcaagcagggggtacgtgactgggggctccatgcaccagtaattagaacagaacagaacaggacagggattttcacagtgcttttccatacaatgtctgtaatctatagataacataaccgattaggttgggggtcaatctttaactaccaggcccagggtgtggtgctgggctgtctgcctgtggatttcatttctgccttttagtttttatttcttctttctctggaggcagaaattgggcataagacaatatgaggggtggtctcctcccttataaatgcccaccctgataatcctaataaagtcctcctgttctttagcattcagttcaaacaatgcctgttctggaaagcctgtctttattaactcacccgaattctgttaggtttcccttccctaagttttcatttatccttacatagaacttatatgacttctcatatccataatctgatttgatactttctcccaatagtcaatgaacctctttagaacagggaaaacaaaggtcttccatttaaagtgttgacatatggcagggtcatatcttgcatacattacaaattttaaggatatatgagtgtgtaggtacacagcatcctccacaccaaacacacattcttccaacaacaatagctaaaacctagatacggattttaaacatatcccaaacctagaagttaagatataaagagtgtaacttgaggtgaatagaaaactggtgatatttatttaataaagaaataatatattgatgtcatgtaacaaagtttttgctaattaatgaacattttgaacttgaaaggtagaaaaataattaaatagtaataggtttgatattctgaagtatcagttttaaagcctctatcataaactatcattaatgtggccaaaaagcaatactgaaatgttggtactattattcaatatatggaatttaatgcaccatagatatcctggtaaaatgaacaataattatacaggagtcacaaatataagtatttacttatataccttcattgtcagtattgagtttggcttccagttccgtaatcttgtgtcttagttcaaatattgagagttgcactgcatccctgttatttaaaatatttttgttgattataattcaattaaaaataacatcagaaaaataatacatagtaacccactactacttcaggaacaatttactatgacacattatttactgaaggactggttaagaaataagactcaggcaaaggaaggcttccaattagtcagttctaggactcaaatatgcactaaagctcaaagacccccaggcaaccattagaaatcttttatttatttttatttatttttttgagacagaatctcgctctgtcgcccaggctggagtgcagtggtgcaaactcggctcactgcaacctccgcctcccgggttcaagcaattctcctgcctcagcctcctgaatagctgggattacaggcatgcgccaccaagccctgctaatttttttgtatttttagaagagacagggtttcaccatattggccaggctggtctcgaactcctaaccttgtgatccgcccagcctcggcctcccaaagtgctgggattacaggcgtgagccaccaggcccggcccttggaaatcctttatttttaacttaaatatcatcctaaagaagttagttacctggtttttcagaaccaagcaaattaggcactgcacattattacagaaaggcatacctagggcaatacataacagctgacaaactgaaacaaagagaaaaaaacaaacactaatttaaaaggttagctatttagggcatcagtaaatagaacattatcatatgacagggccatttattcaataaatatttttgagtgcctattatgttcaaggcattgtattaaatacggaagaattcagtgaacagtgaacagaaaaatagcaatagcggcagcaaagttccactggatgcgtatcacaagccaatgctaagttctttatagtgcatttcattccaacctgggaacaacagcaggaggtatgagatgactatttgtataccagtcttagagctgagaaaactgaggattaaagaggttaattaacttgtctaagattgcatagttactgagtgacaagagatggagtttgtgtttttgcaggactgtcctcaagtacttgctcttattctctacttcctcagaatacacagaacctgtcctcagaacgcgtgtagtttggtagcaaaacaagaaatagacaggcaattaaaatactgtgactggagctacaatagaggaaaacccagaaccctatctaggcacaaaggagagtccaattctcacgggacttgtggatggagttgggagtatgtccaaaaaatactttaaatgtttcaaaaatttaacacgaagtacgaatactgtttttaaaaagcataaaggaggagtaacagttttactaaatgtcattttatgaagttccccttaaagggatgaaagaaaaaaaaaaccccgtataactaaataaaatctttggaattttaagcagaaaacctggatttatggagacatcaaaaccaaacacaacttttggcattacagtatatgggcaaaatacacgccatatgattggatccttaagggcagcacatcctacccggaaagctgcctacttaacaataccaaaggcttactcaaagaggcacgtgaatctttcgcatggaatacttttggaacccagaccgaagtgcccaggggttaatcacggcgccggtcttacagcaccctcagcggcttcagccctgagactctgcaggtgaaggctcggggggtgtggacgggaccccacaccgcgccgcccgccgactcacttcttgcggacttcttccagcaactgctgtttcaggcggttggtgctcacaccgtcgaagttgtagtttctctcttccttcatagtgtcaggccagagacctcccgcgtctttcccctcagcaccttagagcacaagacattaagggccacccagaagccagtacggcacgaggcggtgaaccccaaccgccccccggtcgcacctcccgcgcctgccc

SEQ ID NO: 1743 - DNA, 70815 bp, Homo sapiens
ggagagttggaagaagtttcattcagtttgagagatgaagccacactaaaccagcagagtgggtcccaatcttttctgtacaatttcctgggggaggcttaaagaaatacatgtgagatcacaatcctgggggtggtgcacatgtctgagtattttacttttagctcttcaggtgagtctgacacacagccaaggttgaggacccatgtaagcaggcgggccagagtgctttttgtccgaggcatgtcctattctctggtccagccacacctgcagcactgaaacccaatgtctccaagcagctgacctttaaagggtccaattcttcttttaagaggaggctgtttgaagagatgtgaatagaacatgaataaggacagcgaaggtacaaatatgctaataaagcagatattccaaccagtttattgtatttttacacacacacacacatatacacaaaaataaataaataaataaaagctctatacccagtgatagcactagtgatgatgcacttttgtatttttaggatcatattattgagaaagatcaaataatatttcattaacatttatctactaatattaaaatgttaatgtatatttaacatttttacaacaactttactgaggtataaatcacaaaacatacaattaacccacttagagtatacaatagttttcattagtttcacagagttgtgcaactgtcactgcaatcaattttagaacattttcatccctccaaaaaagaatcctgtacctattagcagtcattctccatcaccgaccttcccccaaccctcagcaactattgatctattttctgtctctatggatttgcctatttgggacatttcatataaatggaattatgcaatatatggtcttttgttattccattatttcacttaggataatgtttccaaggtttacccatgttgcagcatatatcagcatttcattcctttctactgccaaataatatccattgttggaatatactacattttatttacccaatcatcagctgatgaacatttgagttgtttcgacttcttgactatttgaataatggtgccacaaaccttcctgtacatgtttttacgtggacatgggtttccatttttcttgggcatataccgaagagacttgctgtgtcatatagtaactctatgtttaaccttttgaggaactgacagttttccaaagtggctgtatcactttatatccccaccagcaacatatgagggttccaggtttttcacactcatgtcaatactcatgatctgtcttttttattatggcaatatttgtttttaaaaatggtatgtcttgatattttgtaatacatttagatatcttaaattttttaatatatattgttttactgatggttttgctttatgaattctgaactttccaatgaaagaaaacaactactgaagtcaatacatatttgagtatcaaagaccctaaactgtcatttttgctgtggttattgcaacaaataattggatttttttttctttttctttgagacagggtcttactctgttgcccacgctggagtgcagtggctcattgcagcctcaacctcctggcctggctcaagtgatcctcccacctcagccttctgagtactaggctacaggcacgtgtcaccacaactggttaatttttgtattttttgtagagatggagttttgccatgttgctcaggctggtctggaactcctgggctcaagcaattcacccgcctcaccctcccaaagtgacagggggtgtgagccaccatgtccagccagtaattgcattttctttatgacaaaattattttcagagcttagaactggataaaactttttctctacttgtatattccttctacaaaggaaagcagtcattgcttctttgcactgactggtagaaagcttaaaactaaaacttttcttggttggaaattcttgctaaattttaatttttattttcatcttttatcttgtaggtattttttgatacctctatattagtaaaagctaattcacatcccttctagtgggaaagagactataaagaagtaaagaaataaatatgtggtaagtacccttgatctgcacagcaatctcaaggcagtaattataaaggataaaactgaggatatgagaagttatttaccaaagtcagaagcttataagtggcaaaactggtattagaatacagatcttggagtccctcatttcagttctttatactctctcaacattccatcattctgtttaatacagacattttatggtatctgaaaagtatcccaaagtagctcctgcagaaccaacacttaaatgtaatagagtccctgtgataagatgttcaactgatattttatcccagtgattgagataactttaaatgttcctcaatagtccccacaatagcttagctctgtaaggaaaaaatgtgtttatttttcattgataattataattattataataatgtttttttttttttttgagacagagtcttgctctgtctcccaagctggagtgcagtggcatgatctcagttcactgcaacctctgcctcccgggttcaagtgattctcatgccccagcctcctgagtagctgggactataggcatgcacaaccactccaggctaactgtattttttgtatttttagtagagacaagttttgccatgttggccaggctggtctcaaactcctggactcaagtgatctgcctgccttggcctcccaaagtactaggattacaggtgtgagccaccacacctggcctataattattatttaaattattaattttctactaatgctgagaaagatggtataagacataaaaatctaatgtttgtctaatgatatgggtcaaggcacctaatattaatagttagctaaagaataggggaaaatatttacaaataattccaatgtagaatgatttatagaaagttactttatatttttccacattacattttaaagttacttaaaatatttttggctacatgaaatttatatattcttccttaaggaaagaaaataaacttttatagaagaagttacagaaatgcacttggtattcattactggtgatacataatagaatttaggtttagtgccagatatagggtgagaacaccattagctggaaactatacttacctctaggtgatttctataaatctgaagtccaatgatttcacttattaaagtggacaaataagttatatgttccggacctaggtgacagttacaaaaactatctaaaagacaaaaacagtctaaccatgaatgagaggattcaatacattttataaatgcctcaaaagaactcttttcttatcctcattctatctccacatctggacttgagtattgtgaacaattgcagtttggtctaaagaattagtccatcactatgaattaccacacatcacaaaatgacttaaatcaccagtgttaagtaagtggtaggaccttatgattgaataaatattggttttctagaattgtaaaaacctcagaaagtgtatagttttgcttcaatcattttacaggtgtgggaaataaacatgaggtgaagggacttgcccaagatctcctaagttcatggcagagtggagactacaaacaagtttatttaagattgaaggttgttctacgataccataatatttcaagtcaaaacttaaaatggacttgattttcggctttgtttaaacctgcaatttaaaaaactgagcaagatccagcccaaaatggcaaaaaggttttatgaatacacactttttgctaacagtcaactagaaaccaaatagaatagcaacgttactatcagagcagatcatgggtatattattgaaagcaagtgtaatgatgccagccttcagattccctaggatattttaaaactctcaagcacttctattacatagtttagggtcactggagaaaattacttttatgcagacaaaggaacacacgtctggaaaaggaactaaagaaaaatgtggcagttcttatctattttattccctgaagaaatgtgctgaccattaactttataacttgaatattataaatggaaaaaaaaaggaagaaatagaaatccatccagttctggaatcatggatggagttctggaagatggtttggtcttgtaatcttttttactggtcctctcttggcactcactgtcttctgcttagctggattatatcttccactgaaataaataagtgttaatcataatttttcagtcaccattatgtacaacaaaaacattataggccacacaggaagaaatgtatattgcaccttgttccccccaacagaccttcacacggaaaccttcctgtgaatagtttctgcttacagtgcaaatcttaggcagccttctgttatagcacatcatctccaccgctacagaggcatacagcttaagggcaggtaattcaaaggctggaagcagcatgtcaggtgccctaatgtggaaagttctgtctaatgaggataagacagatccgtgaattccttttcttagatttccatgagatcctttttccattaatgacttatgtggcactaaaaagccaaccttccttacactctgacttgagagagttaaaggccacttcaatttcctaaaaactttcttagggggtgatggcagcaaaatgacagagtcatttaaagtctttctctattaagtctaacatctggacttcctcagggaaagtgtttatttgttgctttttttcttgtataagagccatgttttcttgtctcttctcatatattgtaattttgttttgaaaactggatgttttaaaatatgtaacatgtaagaacttgtcattttctcctcattaaaatgaaggataaaattctctcctccataaaagtgatgacaaattggcaatatggttagaagcaactttatcaaaaccctggaaattaacgaaagtgttgcaacaatcctggagaatttataaaataacaacaacagcaacaaacggctgaaacttcgaacactgagctttgtagcattttaacttgccctatgcctatccactgttcccctgactttcatccccagctccatggtagccttgaaaaccaacagcgcacaattgcagtgaaaactcagtagcctggtggacaccataagaggtggaatagggttggagatcctttaacacctatttcattccaagaggaatttcattatttaaacagtctggtgattacttgaaagaccacttacaaagctatctttatttgacctgacatggagatggtccagtgtaaatagccttttccctaggggcatttgctggaacaataagaaaccactgtttaatttcagagctgccagaggtagtagataacaattgaggcaaaaaataggctaaccaggaagcttaaaaggaaaagctgagaggccaggctcagtggctctcacctgtaatcccagcactttgggaggctaagggaggcaggtggatcacttgaggccaggagtttgagaccagcctggccagtatgatgaaaccccacttgtactaagaatacaaaaaaagatgagccgagattgcgccactgcagtccgcagtccggcctgggcgacagagcgagactccgtctcaaaaaaaaaaaagaatacaaaaaaagaaaaaaaaattagccaggcatggtgctgcatgcctataatctcagctagttgggaggctgagacatgagaatcacttgagcctgaggcagaggttgcagtgagccgagatcagcctaggcaacagagtgagactctgtctctaaaaaaaaggaaaagctgagaaatgagtgttaataagctccattatatttcttggaatctagaagcccatacacatgtgtaactgtgggtatgcataggactgtgtgcatactcaggaaaggcctgaaaaggccctaagctcttgcctctggctgaccttgaggctctgcacaagcaggaagtaaagaataaggtagagttgtaatttgcctggccgactgttgaaggcatgctccaacacacacacacagagcccatcagcaaaggctaggagatttattgatgctaggcatttaaataaatctgttcaatcattagctgacccctaagctaactcagcagagacttcagtgtccaccccaacaaagaatacagattttacataattattttagaaaagtcactaaacaagcagcagcaaaaacagtgacaacaacaaaccctggggaggggaaagaaactaatatacagagtggccatgttacatattttaaaacatccagttttcaaaacaaaattacaatatatgagaagagacaagaaaacatggctcttatacaagaaaaaaagcaacaaataaacactttccctgaggaagtccagatgttagacttaatagagaaagactttaaatctactattttaaagaactaaaggaaatcatatctatagaggaaattatgagaatgatgtctcaccaaatcaagaatactaataagagatagaaattatttaaaaagaaccaaataggcattctggagttgaaaaagaatataaatgcaatgaagaattcactagaagagctcaacggcagattggagcagacacaagagtcaatgaagttaaagatttgtcaattaagatcgtctggtttgagcaagagataacaaagaataaagtgaaggaaattaaaatattttcccccaaaatatatttctttgacatattttaaaatgtcagtctcttggccagcaggcagaaatggccttacaaagctgtcttaagtgggaaagtttgcattaatgtggagaatctccactaatgcaactgtgccacctctcctttctatgcttttccccagatctaggagagactgaaagtctgacacatttaaaagtctgagaagaaacatttaccatctattctctctgagggtggcttcatctacataaaaagtccacctttgttcgccaaaccttttctccctgctcccaaaaccttttttaaaatcagaatctaagcccccactctttctgtaacctcaaaatggtatataagtttctataactcattgggaagttgggtcttcattctgaagactcccatgtatacatattaaataaatctgtgtgccttttctcctattaataaatatgattcatgtctgtgatttttagcaaacttcaggggcgaagagcctatggcggcccccactaaagaaaactgaacagtctcagagacctgtaaaacactatcaactataccaacatatgtataatgagtgtcccagaaggagaggggaaagaaaaggacagatagaatatttgaaaaataatagctaaaaatttcccaaatttcattaaaaatattgatctacaaatttaagaagcctaacaaattccaagatgaatatccagacacatcataataaaactatcaaaagccaatacaaacagggaatcttgaaagcagctagaatgaagcaactcactctgtaaaagggatcttcaataggagtaacaactgatttctcatcagaaactatgaaggcctgaagacagggagatgaaatatttaaagtgctataaggaaaaagactttcaactaagaattctatatgcaacaaaactatccttctaaaataaaagaaaaattaaacatttccagataagcaaaaacagaaggaattaatcatcagcaaacctgccctataaaaaaatagtagagacttttgtgttgaaataaaaggacatttgatagaagtgtaaattcacatgaagaaataaagaaaactggcaaagataactacataggtaaacataaaaataggataaatgtagtttttgtttgtaattcttctttttaaatctcctaactgattaagaaaataactgcatgagcaataattgtaaatctgttgatggaaacaaaatgtataaacttgtaatttgtatgacaataacagcacaaagaaggtgaagggaatggagctacataggaaagaacttttggtacactattgaaattaagttgttttgaacctaaagtagattgttataaattaatatcttaattgtaattcccaggcaaccactgagaccaagaccagatggcttcgctggtaaattctaccacatattaaatcatacatatataaaaccaatccttcacacgcacttcataaaaatgaaataggagagaacaccttccaacttattttatgaggcaaatattactcttattttcttctttctgcttatttggggtttagtttgctcctctttttcaagtttcttaaggtaaaagatttgattttttatttgaaatgatttatttaaaaatatatttacggccataaatttctctctaagcactaaacctgataaagaaaatctatgaacaaaatttacagctaacattatatttaatgtaaaaaccaaaagctttctctctaagataaggaacaagttaaggatgttcactattaccacttctattcaacattgtataggaggttccagccagggcaattaggcaagaaaaatagataaaaggcatccaaattagaagaaaaaaaaaagaagtaaaacaatctctatttaggtgacatgttcttatatatagaaaatactaaggcatacacattcacatacagacacagacacatacatgcatttatgagatctaataagttcctcagggtttctggatttaagatcaatatgcaaaaatcaactgtatttctagacaccagcaatatacagtcctaaaatgaaatttaaaacttaattctgtttcaaactgcatcaaaaagaatacagttttaggaataaatttagccaaagaattgcaagatttgtacactaaaatctataaaatatctatgaaagaaattaaagaagatctaaatgaatagaaagaaattcatgttcttggattagaagacttaatattgttaagatggcaacactacccaaagtgatctacagattcaacatactctctccatcaaaacaccagctatattttgtgaagaaattgacaagtggatcctaaatccacatggaaataaaagggactctgaataaccaaaacaatcttgaaaaagaacaataaaattggagtactcgcacttcttgattttaaactcactaaaaagttagtcatccagacagtatggtattggcataaggatagagttatagatcaatgaaacacaactgggagtctaagagtaaacccatatgttacggtcaattgtttttttacaagagtgccaagagcatttaattggcaaaggatagtgtcttcaacctatggtgttaggacaactgaataaatacaggcaaaagagtgaaactggacgcctacctcacatcatatacaaaaatgaactcaaaatgggtgaaaagggagctaaaactataaaactcttagaagaaaacataggttaggcaatgacttcttatgtatgacacctaacacacaagcaagcaagaaaaagtagatgatggtctttatcaaaattgagaacttttgtgtttctaaagatatcatcaagaaaataaaaataccatccatagaatgggaaaaaattataaatcttttatctgataaggtctcatactcagaatataaaatgctctcaatgcaatataatagagacaaacaaaccaatttaataataggcaaaggacttgaatagacatttctccaaagaagatacagttgtccctctacatccaagggtgattggttccaggacccccatggataccaaaattcacagatgctcaagtcccttacataaaacggtgtcatatttccacataatgtacacacataatccagtatactttaaatcatctctagattacttaacattagattacattaacacaaaagtaaatgctatataaatagatgttatactttgttgggtttttaaaaattatttattattattgtattattattattattattttccccaattttttttgatccacagttggttgaattcatggatgcagaatttgtggatatggaaggctatctgtatagaaatggccaacaagtacaagaaaagatttcaacatcattagtcattaggaaagtgcaaatcaaaaccacagtaagatatcacttcacatccactaggatggttaaatttttttaaataaaggacaacatgtgttgataaggatgtggagaaattggaaccctgatacacagctaatgggaatataaaatggtacagccactatagaaaatagcttggcagttcctcaaaaagataaacaaaatggaattaacccagcaattccacttctaggcatgcaccaaagagaattaaaaatatttgcacacaaaacttgtacagggatgttcatagtagcattattcataatagtgaagaggtgtaaacatgtaaatgttcatcagctgatgattcggtaaataaaatgtggcatatccaaaaactggaatattactctgtcacagaaaggaataaggaattcgtatatgttccaacatggatgaaccatgaaaatgttatattaagcagcagaaggtaaacacccaaattcacatattgtatgctcccatttacagttggaaatgtgccacataacatttcagtcagcaatggactgcatatatgacagtattcctgtaagattataatactgtatttgtactgtaccttttctatgtttagatacacaaatacttaccattgtgttacaattgtcagagtgttccctacagtaatatgctgtacaggtttgtaacttaggagcaagaggctataccatatagctaggtgtgaagtaggatctaccatctaggtttttgtaagcgcactctgatgtttgcacaatgacaaaattgccttatgacacacttctcacaacatgtccccatcattaagggacacatgactgactgtatatgaaataacaagaccagagaaaaccataaaaacagaaagcagattagtaattgccaggagtttagtggaagggggtttgggaactaactgctcattcatacaggctttctttttggggtgatgaaaatgttctggaatcagttagtggtgatgcttgcatgaccccatgaatatacgaaaaatcactgagttgtacactttattatttttattttaaaaaagtttttaaatggggtctggctctgttgcccaagctgcaatgcagtggcacgaacatagctcacggcagccttcaactcctgggctcaagtgattgtcctgccttggccttccaaagtgctaaggatacagagctgtaggctaaaaggataatttttttggtatgtgaataatatctcaattaaaaaatttttttaaatgtgctttgggaataatccatttcctgttaaaattttctttagtttattaatcatgtttaaaaatgatttcttctggtgaaatatggaattaaccacaatcattcaattattatgtctaattaatatagctcattatagatatttattatttatagtactaaatgattttctattacactaaggatgttttgagtagcttccaaaatatggcccatttctaaaagatctaactaacatgatgacacaagtgtctgaataataactaactaatgacactaatgatgaagctgaggtacttcactggtaaaagatatttaatcactgtcttttagagcagtgttttccaaactgcagaatgcaactcattagtggattgatttactgaattacaatagcaatataaaaataacagaaaaggaaacagaacagaagaggaaaaagaacatatattaataaaaagaacagaaaaggggccaggtgcagtgattcatgcctgtaatcccagcactttaggaggccaaggtgggagattgcttgagcccaggagattaataccagcctgaaaaaacatggcaagaccctgtccatattctctacagaaaatcaaaaaatgagctggacatggtggctcatgcctatagtcctagctactcaggaggctgaggcagggggatctcttgagcctgggagtttagggttaaagtgagcaatcattgtaccactgcactgtagctggggcaacagcacaagacctgtctctttaaaaaaaagaaaaaaaaaaaaacagaaaaagaagtatcaatatgcatcacacatagtaagagaaaatattctttcataaactgtaaaatatgtgaatatatatgtgggtatagggatcacaatatggtgtcagtcatggtcaacacagtttggaaaccattctatgctcctgagtattatgatttttaaataaataatagtggttaagcctccagcaagtttatgttattaatagcaaaacagacacttgcagttccaaattattgtcatatgtatttttctgtcctcacaaatcaatacattgttactctgctgattctttatattcagtaaagcactatagtaatgataatagttagtgtttgttgaattagggatttttaaaaataatctctaattctcataccaatcattcattttgggtttcatctcttcatcttatgggggagaaaatggaatctgagagtggttacttatataaagtcacattaaataataagaaatggaggcaaaaattgattggtctatctgctccaaagtcagtgccgattttcatttacacttgtcccccctttatccatggttttactttccagtttcagtttcctgtggtcagccatggtcccaaaataggtgattatggtacaataagctattttgagagagagagagacaccacattcatataacttttattacagtatgctgttataattaagttgtattattagttactgctaatctcttcctatgcctaaattgtaaatttaattttatcatagatatctatgtatgtaaaaaaacttagcatacacagggtgcagtactatccatggttttggtatccactggtggtctttggaatgtatctctcttgggtaagagaggactactgtaccaccttgcttctcactatttttttaaacactgtactgtattagttacacagtatttatactgctattatgacttaagaatttccatagtctatctggactatctcttgacttttctcttttaatataaaattatttaaaataattataaagtatacatattcttatataaaacctaagaggcataaatataaatcatccacaattttactaacctattttgtactataatttttgtttactattataggtaagcgtttttctatgtcagctatgtactctcctagaatgtaatttttgcaacttcctaatatcaacagagttattgacttactcttttaatgttggatattttggttgtgttatctctactgtagctgctttttaaaaaaatcagaatcagaaggatacgcccctaacaatctgtctcttaccaagtcctagtatcaatttccctcaggttcttttgctccagggtaccaatggctccttagttattttcttcctttagggcttttagtcactttaaaactgttcataagcagaaaaaaatgaggtttcacactaaagaaaaaaataaactttagttttctatttttaggaactattcctgtggtatcagttttgagctccttgctttcgggaatatgatttttcatagttaatacacaccatgggcgacagtcaataaagttacctattgacttgtctagacttttttggcaacttacaaaacttatactaaaaagactgtttctcctatttaatcttaaagagacttttgtccaattgatatatgtaaagatctctagaatacatccttcaacagcagtatagatatcttgttcatttgtggtcataatacatagtattatgtctacacagtaggactataatagctaatattaaatctacatagtctatatagtaggactataatagttaatattatatcaggcactatccctttctgctagatttttaaaagagaatttcacattcatatgggtattttctaatgttctgatttgttctgaatgttaggaaaaatgggtaagtcaatattttaatattagtacatatgagaatatcaaccaaagcaaacattaaaagccatggagacttgattaaaagttcacaaatcataaatgtaccaatccataaattataataaagcaaatactgatgtaaccacaacttaggtcaagcactagaatattatcatcatactggaagatgccatcatgtcacaattattattcacttcttcctttccattggtattaataattactagcctgtgttctgacatcacagtttacttttgtctgtctttgaactttaaatgaatgggatcacattgtacatattcttttatttctgacctacttcactcaatactgagaattatccataatgttgtatgagttatagtttgtttttattgctgttattttcatatatgtatatataattttcatccattccattactgatggacatttaagctgtattcagttttgaactgtcaagaataaagctgctatgaacattcttgttcttttggtgtaaatgtatgcaccattctatttgatatattactggaattgttgggttatagagaaggtatatgatcagctaaatatagaaaataatgctaaaatgtatttgatatggtttggccctttgtccccaacccaaatctcatgttgaattgtaatccctggtgctgggggagtgacccagtgggagataatttgatcctgggggcggacctcccccttagtgtcctggtgatagtgggttctcacgaaatctggttgtttgaaaatgtgtagcacttccccattcactctctcttctgctctgccatgtgaagaaggcacttgcttccccttcgcccttccaccatggttgtaagtttcctgaggcctccccaaacatgtttcctacacagcttgcgggactgtgattcaattaaacttcttttcttcataaattatccagtctcaggtagttctttatagcagtgtgaaaacaaactaatacaatattccaaagtggttatataaatgtatactcctactagcaatgtatgagaatcccctattcctccacatccttgacaacacttggaatcatcaatcttcaaaatttgtggctgtatcttgtaattttaatttgcattctgctgatgagtaatggtgttgagtctctcttcacatgtcctttggccatttggatatcccattctgtgaggtgcctaataccgtgacttcctttaaagactcaaatttgagtcatcaacaaaaggaggatactaacttccagagttaagccagtaagaaaaacaatattttgaggtagtaccaattatatatacctaatttggatgattagagagatatttctatgtttctattagatgagtgatttgcattgtttatagtttcagagagtgaacgggttttttttttccatttgaccatttatttagtcataaattcattcaaaaattattaaacaccaatttatgccaggcactctattcaacattaagtttcatcagagatggaagtgattgatctgggatcaagcacaagcagtgctggagggcacaaagcagctgaatgggcaggtataccagaccatgccacctacctcgatgcaccagcaccttaagctcagttcagacctgtggtgtggagggcctcacagacaacctgatctcagcctgattcatagctgctgctacataagggggtggggaggaatgagtttggcacccaggtgatctacttggttgtcctttggtagtaacttgcccaattctgacagtaagtggacaagtatcttagccatgacttggaaaggacatgataaacagaagttcagattccccagggataagagtctgggtcatcctgccagaggaagaaaaggcccatacttgagtcatggataaatcagcttggtacatgggactgcagctgcgctatagccctactccctctgcccaaacctggttcctagccttcccccacaggtgttgatcctaagaactctcgctaataaacttcctggccaggtgcagtggctcatgcctgtaatctcagcactttgggaggccaaggcgggaggatcttttgaggtcaggagttcgagaccagcctggccaacatggcgaaaccctgtctctactaaaagtacaaaaattagccaggaatggtggcacacacctgtaatctcagctatttgggaggctgaggcagaataataatttgaatccaggaggcagaatttgcagtgagcagagagattgcaccactgcacttcaacctgggtgacagagcaagactccatctcaaaataaatacataaatacataaggccaggcacggtggctcatgcctgtaatcccagcaccttggaaggccaaggcaggcggatcacctgaggtcggaagttcgagaccagcctgatcaacatgaagaaaccctgtctctactaaaaatacaaaattagccaagcacagtggcatgtgtctgtaatcccagctactcgggaggctgagacaggagaatcacttgaacccaggaggcagaggttgcagtgagccaagatcgcgccatggcactacagcctgggcaacaagagctaaactccatctcaataaataaataaataagtaaaataaacttcctacatgctgattcctatttcagagtctactccctgagagatccaactcccagtaatattcaatggaaaaccaaactgccctcgtagacctacattctggtgacacacatatgtgtatgtgctaacatatgattagaataaagaagtttaactttcattttcgaaatattcccctcttcactatttaagcaaatttgaataacagaggtaatatatttttagaacagatatgaattggaaaataaacctgaactgcaagatattaataaaaatatttagggtggttgtgcagaaaagtcaacatagcaggctttaggctactgtctttggaaaagcccacttgcgaggttggcccttggctggtatctggaaacttactggtaaacagttccctacacagatataaaccttttcccaaatgaaaagaatgattcactgtgcctatgctgtttgtacaaacaatgtggtttatattgaacacctgttttccttctgggagtctggaattttggtgcatgccaggcagaagaagcctatgtgatctgctcccaatagaaacattagatgctaagtatctaacgagcttctctggtaggtaaaacttcatgtactgtcatacctgttgttgcaattttttgctggaggaattaagtatttcttatgtgaccctaacttggagaaaactttcggaagcttgagcctagttttctgagaattcatcccatgtgccttatgcctttgttgattttgctttgtattccttagctataaattccctgtgaggtacatggattagagaaagaaagaaaaaaagaaagaaagagaggaaggaaagaaggaaggaaggaaggaaggaagggaggaaggaaatatatattagccataagtacaaatatatgccaatccttatgaattcttctagtgcatcattgaatatggcagtggtcttggggactctgacagtatagaattcttctagtgaaccactgaatatggatgggagtggtcttggggactctgacacagtggcgtaatagtttttccagggaagtcctttgtcagaatttattttaatacttaaactacattatatttccaataatgaaaatgtataaagataataaataataatttaaagaatttgactattcaagaaagaatatactttatctagccaaatattggacaaaatgttgctacctcattaatctccaccaaggaaatttgctatacttgagtggctcttaccttgacctatatataaaaaggatgctgacttatagctgattcacatgttggcttaattttttatagggttaagttatatattaatgtttttccctacatgggataaagttactcagacaaggattacctgagtaattcttctgtatttagtacaggaccagggaaaattgtgtgtagacataaccttgtaaactcacaaaacattcctgtgtttttgttttttttttcttaagagacagtgtcttgctctgctgaccaggctggattgcagtggtgcaatcgtggctcactgcagccttgaactcctgggctcaggtgatcctcctgtctcagcctcccaagcagctgggactacagtgcacaccatcacacccagtcaatttttctaattttttgtagagacagtcttgccatgtttcccaagttggtcttgaacttgaggcctcaagcaatcctcccgcctcagcctcccaaaatgttgtatgataggcatgagccactgcaccaagccctctgttctttatctatcttaaattggttttatttacatagaaaaaacagtttaaactgcactgtcacctacgtttattttggtgtccactccagtgaacatatttcctgactaaaaagggtagggctgatgctgtaattattcaggcataccttgtcttattatgcttcactttattgtgcttcaaagatactgcattttttacaaattgaagatttgtggcacccctgtgttaagcaagtctatcagcactatttttccaatggcatatgttcatttcctatctgcatcatattttggtaattctcacaatatttcaaacttttaaattattactatatccgttaatggtgatcagtgatctttgatgttactactgtaattgttttggggagccataaaccaagcccatataaaacagcaaactgtttaataaaggtatgtatgttctgactgctctaccaaccagccattcctgggtctctctccctctctttgggcttctctattcattgagacacaacactattgaaattaggccaattaataaccctactatggtgttgaagtagaaggaagagttgcacatctctcactttaatttggctagaaatgataagcttagtcatttagtgaggaaggtatgttgaaagctgagacaggctgaaagctaggcctcttgtgccaaacagttaagccaaggcataaatgcaaagggaagattcttaaaagaaattaaaagcaccactctagtgaacacacaaatgataaggaagcaaaacagctttcttgctgatatggaaaaagtgtgagtggtctggatagaagaccaaagaaaccacaatattctcttaagccaaaacctaatcaagagtaagaccctaaatcctttcaattctatgaaggctgagagaagtgagaaagctgcagaagaaaagctggaagccagcagaggatggttcatgaggtttaaggaaagaagcccccttcataacataaaaatgccaagtgaagcagtaagtgctgatgtcacacctgttgctgcaattttttgctggaggaattaaatatgtcttatgtgttgcagcaagttacccagaactagctaagatcactgatgaaggtgattacactaaccaacagattttcaatgtacacaaaacagccttctgttggaaaaagatgcaagctgagaaaagtgggaaattctggccttctccattattatcaagcctctaaagattctggagatacccctatctcagccccacagtccatgtgacttttaaaaaaatatatatggaggaaactgtgaaagccatatcacccagacattcctagctagagaggagaagacaatgcctcgcttcaaagcatcaaaaaacaggttgacttgtctaatgcagccagtgagtttatgttgaagctaatgctcaattaccattctgaaaatcctaggaattatgctaaacctactcttcctgtactctatacatgaaacaacaaagcccagatgacagcacaagagtttagagtttacagcatggtttattgaatattttaagcccagtgttgagacctactgctcagaaaataagattcctttcaaaatattactactttttgagaatgtacctggttacatccaagaactctgtgggagatacacaagaagataaatgctgtttaaatgcctgctaacataacatctattctgctgcccatggatcaaggagtaattttagctttcaagtcttattatttaagaaatacatttcataagtttatacctgccatagatagtgattcctctgatgggtctggaagaaaaccttctggaaaggattcatcattctagatgccactaagaacatttgtgatttatgggaggaggtagaaaaatgtcaacattaaaagaagtttggaagaagttgattccaaccctcacagatgactatgaggggtgcaagacttcagtggaggaagtactgtagatgttttggaaacagcaagagaactagaattagaagtagagcctgaagaggtgactgacttgctgcaatctcatgataaaatttgaatggatgaggagttgcttcttacagatgagcaaagaaagtggtctcttagatgaaatctgctcctggtaaagatgctgtgatgtcatttttgaaatgacagcaaaggatttagaatattctatggacttggttgataaatcagcagcagagtttgaaaggactatgccaattttgaaagaatttctactgtgggtaaaatgctatcaaaccacaacacatatgacagagacatctttcataaaagagtcaatcggtgcagcaaacttcgttgttgccctattttcaaaatttgccacaggcacttcagctttcagcaaccaccaccctgatccatcaggagccatcaacattgaggcaagaccctccaccagcaaaaagattataactcactgaaggctcaaatgatcaatagcatttttcagcataaaatcttttaaaagtaaggtatttacattgtttttagacataatgctattgcatacttaatagactacagtaatggtataaaaaaaacttttatatatactaagaaaccccaaaatttgtgtaactcacttcatcgtgatacttgcttcattacagtgatccggaaccaaacccataatatctccaaggtatgcctgtgtttatgttgttgttaatggtgtagttttaagttctcctaggtacatattattttagtttaaaaaataatataataatatattatcgtgcttgaggaccaaaaatgtatctgggatctaaaaaaaatgtgtataaatagtggaacagatcacaacttctttaagttctcttaccatatgcaattttatattgttgctataaaacctagaagttcagcttccaaaatatagtggacacctgttttgtcagtggcatttatgtgcaaatgtaacgaattagaaagaaaatatatagctagacttacgttttcactagattctcttgcatcctaggcagttgatccacctgttgccttttagaaacttgatgtaaaccagaaccctgaaatacaaaaatttgagtgtttatccccttggttcataattgatttcagaaataagagagacagtcaattctcaattaactctcccataaccaggttcttttgcagcatgtgtaagagaagctgagaaaaatgggaaattctggccttctccattattatcaagcctctaaagattctggaaatccccctatctcagccccacagtccatgtgacttaaaaaaaaaatacagaggaaactgtgaaaaccatatcacctatgtggtatagatcattaaaacttcttgtagtagacactaaatatagataatgcaggcaccctgccattacagtagataagacaatagaagctgtagtattttgaggcagaaatagaaagacaagataatattttcatttttgcctatcttgaaattcctccaggatataaaagtggaaatttctagtggtcagtgtaaatgtaatctgcaattcagaaacaattgagaatgatgatcttagagatggcaaatgaagccaagagtgaatgagatcattcattgagggtacacagagaagtaagagaatcaataatacaaactgagaaagcaacttttaaaggataggacaattaccaaagatagacaggccatcatttaaacaataagaaaacccaggaaaaactactatcatagaagtcaagtcagggagggtggggagtattcaaagaagtgagcatggttggcagtgtaaaatgcctcacagatgcttcgccaaatttgaagaggagttgctgtatttggctattaagagataaactaggcgaaagcatgatggcggggtcacaagagaaatgaaaagagatagaggactaaaaagcaatggcaatgagtatattcatttattcatgaagtttggctgagaaaaagaaagctaaggtggtagttttatgaggacagttaatcgtaaagtaaaagtttgtttttattttgttttggtggaagagttgagcatgtcacaagcaaaggataagccaaaggcagtaaaagagagattaaaaatatgcgaagggatattattaagtaagtcctagagacagcagataagactggggaagaggtttgggatcattttcctttaagacaggaagaacaggatagtaaatctgaaaataaaaaggaggaaaattgggtttcacacctgatagattctctttttgggtgtgagctaagatattagatcatttgatatgagtgacaggtttgggtatattggaacagaaaatagaattcattcattcattcagctaatgttactgagcatctactatatgctgccactacattaagcactcaggtacaaagacaaacgggttatggttctatcggggaaacagcaaaataaataggtgattacaattaagtgccttgatggagatgtgcacaggtgctttgcaagcatacaggagatgtagctaattgagggtatgggggactccacatggaagagcagccaattaagaactaaggaaagaatattctaggtaaaagtaacagtaaggaccttaggtataaagcagcagatatatccaggaatagcacatagcatttggtctaacggcagtctaggatattagcagggatatggctgcagagacaggaacagccaagttgaagaggaccctgcagagaccacaccaaaagagctttgctgtgatcctctgggtaatgcaaactgaaggtttttaacaggaaagaacactattgtatctgtatttcagaatgataggcagcagagaagaaaaatgggtgtggcagagttagttaagactttggtaactatgctgttgacattatatctaaagtactaaatttaaacctaagtactacatttaaacctaggcagccacatttttaaatgaacaataacagaattgtccaaaaaggcagctgaaatacctgggcagtctggaacctatgttatgaggaatggctaatgtaacttaatattttagcttagaaaacaaaacaaaacaaaaacctatgggaagactgagagtcatttacaaatctttgaaaaactatcttgcaggagtgtagacttgttcttattcttcagaggatgtaactaaaaccagtggattttaaggaagtttcaggaaaagagaataagaggcatcatatgatgttttaacaattttaacaattagaacttcccgataatgaaacagaaaagcctcagattccttatctgtgagctaaaagcattatattcctcaatctctcagagccattgctaaaatcctatgtttacaaagatagaagctaaaacttaagtttattatgtgctgcaaaaagctctaatcggtctttctgcctgacttttaagtaatgcaacgtacctatgtgttaaaaagcaatgtccgtattgtacttatgttgtgcatatcagaagactcccaagagggggaaactcagtttcattcaaaacagtgaatcaagagtgagacaaagctacagagaggacagcagcagaaggataaacagcacactcagcaaatagctctagttatctaccaatgaatcaattatttatgtattcagcatgggaagaactgcaaatcatccattaacctttccaatcaccgtagtatccacatggttagaactgtccttcactataaagattaacaattcactctagagtgaaaatctttaacatttatactggggacagtattaacatcttcctgggaagctgttaaaataggcttttatcatatgttcagtgatcctgcggagtcagagtaggattatttcacataagtgaatttttcatataaactaaggtaaatgaatgctttggggacaaaagactttacttttaaccttaaaaaaaatcctccaacaatgttttatatatcacctttttcttaataacttgggcttatgattatgagcatacatttctattttatgttcagttcagtaaataattttgcatatttgctttttgccactctttgtgaaagggaatagaaagcatgagtcaccctgactgacctcagggaggaacctacagctgagtgaagcaaacagatatatcagcaataagggaccaagaggaaggctaaggcaagtagaaattctggtgcccctgtcacagagaggggctaggaaaatcagaaaagaaacacaggaaagtgatattcaccatttactggaatttaaaacctattatgtgtcagaaacttcaaccagcacttcgcacatattatttctctacatactcacaaaacccctgcaagatactgatatttccttttcacaggtgaggaaggaaattaaggcccagaaaggtcacatggtagtaagtgcagagctgggattcaaattcagatttgcaatgccattacagtctggtcttttcatcatgtcatggccccataaagaggtagtgtttgtgctagaccttgaaggatgtggaattggcatgtatgagaaggagcacattccaagcacatagtctgaggaaaggcataaagatgcctgtgatctaggaggaaccagtgccttcagcccagtatcaaggaacatgaagtttgagctaatcatccatttacagacaagagaatgcaagaacttatcctatcttgtctcaatttcttacttaccttagtcaacactacaacacatacttccctttaccaacaatagaactgactttctcaaaattttctaaatgtcccccattagctctaatccccaaacctaatgcccttcctctcaatcctttcattatccctctagatattctggatcagtgactagcagattattctgcatgccactcccatcctcaaaatcctctacctccttgtctgacctagctatgtcttcaggactccaaccctcttttcggctcttcctcccttgactgtcactgttgaacttcttcagagcaatatcccagactatttcttcttttcccactgtatattctccccaaagcatttcattcattcaatgacttcactttttatataataattttgaaattttatataataatttgaaattaataattttcaaatctttatttgtttcctgagagtcatatatccaactgctctttggacacttccatttggataacacacattgaaaactgagtttacatcctaatcttaaaacatatgccaaaataagattaatattgattaaatatttaaacgtcagatattatgctatacaaatactaaaatatgtggtgaatgctatgaaacattgagatggtctttttaactgtaacattagaaatcataaataaaagatagctctgacaacctcaaaacaaaaactctacaataccaacgatatcataaataaaactgaaaggcaaatggatagcttgaaaatagatgcaacacctttcataatttactgatcacctctttgtcctgtatttataagtacgcacttctactaacaaaagttccatctctcgagatcttaccatgcataattataaagtgaagtgccttgaatttcatgatagcccagagatagcagctacctgtttgaattctagtgattagtggtgaaactaaaaggataattaaggaagcaaatacaaaaaataacctcttaatttggaaaactgttatgtcctttttacttttttttttttttctgagatggagtcttgctctatcagccaggctggagtgcagtggtgtgatcttggctcactgcaacctctgccttctgggttcaagctattctcctgcctcacctctgagtagctgggactacaggcgcccaccaccacgcccaactaatttttgtatttctagtagagacagggtttcgctatgttgaccaggctggtctcaaatgcctgacctcgtgatccgaccacctcagcctcccaaagtgctgggattacaggcttaagccacagtgcccagccctttttattttttatacaagttgtatattttcctgtctaccctccatatttagaaacttaactccaaaatctgcttctctcccaaaccaaaaacaaaacctagaaaagtgaaaaacataatttacagtaagaagaaacacttagaatttggaaataaaaaagagttacctgagacatttcagctaggtatgtacggcgttcattgttgatcttctggtaagcctgtgtgaagatacaaaagcaaagggtccaacatatgagaagattagcaatactagcaagactaagttaaggtgtatgtctctatagtgtaggaaatagttttgtgttaattatagagtaggtttgtagataacattagaaataatggcagtttcaaaggaattgctaagtatagagtaaaaacaaacctttgattcttgttccagtttaagtgcatagtatttcacttgactttcaagagtcttcttttcttcttctagctgtttaagtaatgtgtttaaggattcctaaaaatataaatagtaaaattttatatgtactcatgttctaaacaaaataagaaatgaccatcaatttcttcactagtaaatgccttgtatacctaatattttgtgatttcataattctatgatatgtactttttttttttttttttttagacagagtctcactctgtcacccaggctggagtgcaatggcatgatcttggctcactgcaacctccgcctcccaggtctatgcgattcccctgcctcaggctcccaagtagctgggattacaggcacctgcaaccatgccaggctaattttttgtgtttttagtagagacgtggtttcactatgttggccaggctggtctcaaactcctgacctcaggtgatccacccacctcagcctcccaaagtgctgggattacagtcgtgagccactgcaccgggctaatgtgtactttttaagtaatagtaataatcacaatatttattgaaccctaacaatatgtcatgtattgtactaagtgtttttctttttttcatattaaactatctttatttgaaaaacggtatcgtacaaacctaacactctctatcaaacttcaataagggcaatttccacatcgactaatgaatagtagctaaactaacaagagatcaatcaaaagtgctttcaaaggagcagcactggctgatgttctgctgaggctgtgggcattcaggacctggctacagggaaaacagaatcaaaccagctggtgctttggacccaagccctcacatcgtgacctgcctccctcctgggggccctggcacttccaggttcctttggcacttcctggcccctgtgggggcaggaacttggcctcacagttagctggcttctgcctgttgtggtcatttttttttccagagtgcccagagtgctctctcagtggacatggcggtcatccagctttcctgaggtgttttctcaaggaagagggtcttgctgtgaaaactggaagtgtctttcttcaattcttgggccagttctaggaacaacttgtagcagtctgatacaagcagttcaagttttcatgcaccttgtgaagtctctggtcggggtccaggcagtaggtgtcctcctccatggactgctgctgagaccccatcatgcgttctccatgcagttcagatagagtggggagggtcagctacagcttcgggaactctcccacaggctgtgcccttgcaccctgcagaaagccctgctccctggtgtggtggctcacacctgtaatcccagcactttgagaggccgaggcgggtagatcacttgagctaaggagttcgacaccagcctggccaacatggcgaaccctgtctgcactaaaaatacaaaaattagctggcatggtggcgcatgcctgtaatcccagctactcggcaggctgaggaaggagaatcgcttggaacccaggaggcagaggttgcagtgagctgagattgtgccactgcactccaagctgagtgacagagcaaggctccataaaaaaaaaaaaaaaaaagaggcctgcttgccgatcagactttggacttgtcctgtgagttctttccttctttggatttcttcccataattgcattctgcttctccaacatcccctcaggaaataagaaggatgcacctaagctaccattgtcatccacagtcttcagaggaacttgtggccaggacgctgaagaggacccactatgtcctgcttccccaatccccattcactgccaagtcctcgtcctccacgtagtctcttaccacccttgaccagatgcagggcgctcagcacggtgtgggccagggaggtcagttgtcccactccaatattcatgtgggctgtttcattcctgtcttggcctgctccagcctttccttctccttctttgcctgcaagcgttgcttccatcttgcaatttcttggctgggcagctgtgcaggttgctgatggtcagtgctgtcattcagatcatctgcagtttgcccttgaagatctccagcatgctgtgaagtgtgagggacgtgatttgcatcagtcacttagggaagttcaggaggcctgttttttcacgcttttctcagctcactgttttagttcgttctcatgctgctatgaagaaatacccgacactaggtaatttataaagaaaagaggtttaactgactcatggttctgcatggctggggaggcctcaggaaacttataatcatggtggaaggcacctcttcacaggacagcaggagagaaaatgagagcaagcaggtgaaatgccagacacttataaagccatcagatcttgtgagaactcactatcacaagaacagcatggaggaaacagcccccataatcaatgacctccatctggtcttgcccttgacatgtgggaatattacaattcaagatgacatttgggtgggaacacagagccaaaccatatcactcagtcacgtctgaagggaaggcctactcatttcatttagaacccctcaagcagaggtttttgagtgatcaaggactgacctccagcatgggtgatatgaggcccccaccggcctggggtgctggccacatcttggccctggcctctctgtggacctcaccctgggctgaacccctctgggctgtctcttcccttcttctcactgcatgtcatctcctgatcataaaggccaccacagcagcacatgtctgatcacccagagtgtccataggttccctggcactagtcccaggattctgcacatcactaattactactgcccacaggtgggccagcagcagctgggtaggcactgtgtggcaggcagaggtgctctctggctcctgagggctctgcagctctgcttccatttgctagtggcctgtgggccacagctgaccactagtgttctgtctttaacacaaacaagggcctaacgaccaggtagaccacctattgagctggggataggggaggtacccggtgttatagaaaactgtgttcttgatttggctgtacaaatagaaagtgacattacttatgcaatgccttgggggagtggaaagagctcatggcagcccctagctcaggccatttcaggccccatctagccctacagcacagctagaaggtcaaagcagggctatctcatagccctgtgtccacacaatcctctcagggcactgtggtggcccatccctggtgaggttcattaccctaatttcaagtttccttctgcttcagggaagcctggtcctgcctacaaagagtctgtctaccggctgggcgtggtggctcatgcctgtaatcccagcactttgggaggccgaggcaggcagatcacgaggtcaagagatcgagacatcctggccaatatggtgaaaccccgtctgtactaaaaacacaaaaattagctgggtgtggtggcaaacgcctgtagtcccagctactcgagagactgaggcaagtgagtcgcttgaacgcgggaggcgggggttgtagtgagccaagatcacaccactgtactccaccctggcaacacagcaagactccaactaaaaaaaaagaaaaaaagaaaaaatctttctaccttactagattgagctccttgtaaaagggactatgttttcttcatctccatatccccagtagctagccagtgcccagtatacactaagggctcagtcattgtcttattttgttgtctactctgacttaggacatgtcacttcccctcttgacctccatattcagatctgtgaatgagtaagtgggtaaagtccctctagctttaaaagccctccaatatagacagaactcagaaaccagaaccagaagctgaggaatggcgaatggaacattttccctggtgtgatggatgagaccgcagatctggctactagggtgatttttttgccacttgaaagcctctgcagaatttgaccctagttttcaaatcagactctagaatgatcttcagtgttggtggttttgcttttgagactgttattgacacaacagtttctggaaatctttttcaaggagagtatgggggcttctttggccaaattgggtgggtgcaggctccatcagctcagcagctgctgtctgggccacagcctgtctgctgagtcctgctcccctacagaggtttttgtcagaggcatttgaaacagagcaactccatcttgaatagaggctaggtaaaataaggctgagacccactgggctgcattcccaggaagttagacaatcttaatcacaggatgaaataggaggttggcacaaggtacaggtcaataaaaggatgcagtaaagaaatggggcaaaacccaccaaaaccctagatggcaacaaaagtaacctctggttatcctcactgctcattatatgctaattataatgtattagcatactaaaagacacttctatcagcaccatgacagtttacaaatgccatggcaacatcaggaatttacctgtctaaaaagggaaggaaccctcatttccaggagctgcccacccctttcacggaaaactcatgaataatccactcctttagcatataatcaagaaataagcacaaaaatagccaaccagcaccccgggggctgctctgctgatggagtggccattcttttattcctttactgtcttaataaacttgctttcactttacactacggatttgcctctaattcttttttgtgcaagatccaagaaccctctcttgcagtctggatcgggacccctttccattaacagtttctccagacattacagtgtgactggccatgtcatctgtcacaggtgtgaaaacaatcaaaaccaagagcctgaagctgccgggatgagtgcctgcagaggaatcctgctccctgcaggcacatctagaatgtgttcctgtgctggggccctgctctttccaagaaggcaggctccagggactcccaggatcctgctccctcggataccacagtctatgtaggcagcaggactaaagtgatgagagccgccatgatagtgagggccgagagcaggatggcggaattagaaggcagcgtcctgacccctggcgatgagctgagtcaattggtccctgtctccccctcagagccaccatcttgtcgtggcttccctcaggaacattatgagctctcccccaggaagcgcttcttggtttcccattgttaccggatggaaagtcttgactgccagttgtccaagttcttggtgtattgaacaaagacttgaacaaaatgctcaaacaaagcaatggacgacagcgacatacatttgttgaagcaaaaggacactccacagagtgaagcaggcttaagtaagtggctcaagaggtctgagtatgttccctggggttattaactaaaagaacttgataacaccctttagaggtttccaattggttacacactatgcaaatgaagacagcccacgaccaaccagaggctgaagacatggcctgcaatcaatcagaggctgaagtggagttacactctatgcaaatgaaggataggctcacgaccaatcagaggctgaagtgaagacttggcccacgaccaatcagaggctgaagtgaagacttggctcgtgaccaaaggttgaagttttcctttaggtttaattccaagaagtcagaggcaggttggccttaggctccctgtctccagaccctattctcctgcctcatcttctccagactcccaccaggtggtggcctctctggccctgccagggactgggcgcagggaggggaggggtggctgacaggcctgcctgaggcaggtgggcagtttgtggccttcgggcatggcctgctccaatggaggtgcctccttggcctgccccagctcagtccctctccatgcctctgggagccctgggcctaaatgcttttcatagattatttcatttaatccttattacagttgaaatggctaatatatttctatctaactgttgagaagattgcagcttatagagattacataactggctcaaagacacgcagctaataatggtagagctggaacgtgaacccaggtaaaatgactccaaaggcaacagagggtaaacaattattatatgtgtgttcattttattgttaccattgtaacaaaagaggtacaggcaaagacatttaaagaggatgtcctactgttaactgtatactctcagtcgatttttacttcctggtgaaaactaacttagaaatctacaaaaacaggatcaaacaggcatccaaatataggaaaaagtgtatggcactttttttataaaaagatggaatgtagtgaattatcttgatccacatcagtaataccatatatatacatgattataaattgttagagaaatatacaattaaaatgtataattgttatcttccaatctgagttacactagtttcctggtattagtaaaacaaatgtatggaaacccttatgtaaaaaactccagctacttgtgatgaggagtatctaggttaaggtcttacaactggtctactctgtaatatcctcacaattctcctttagtgcctattctaccactctacttcttccacttctttggcttgataaataatctccttttcgtgatcatattgtttttcattttttgtgttagtgcatccctcacaaactctagaactttcttttctgaatgctacttttcataagagcctcctacccccatctgttttagcttttcagagaggacctagaagtacacggtttcctgggtatcacatatagaaatgtagaaaagctttcaagaatctaataatccttctacctggccaacattcactgagggcagaaatctgtactgacttgataactggggatgaggaaatctgggaaagaggtatgtggatggtcctataaaagtgggaacaaagggtgaaatccctgtattgcgcagtaattttcaccagagagcacccactgtgtaagaggcattaaaccaagtggaccaaaggcttaaccaggagatagcatctggtttctgttcttggtcaccccagtgggtggacaatgagctcatgaacagtaaccacagtggctgagatggcgactttgcattggctcaacagcatgggtcccttcccaccaagactaatctagtactgctgctgctcaatgtctagcctgccaataagagacgacaacataagcccctgttactgtgccatccttcaagatcaatcagctgcttggtggcaagctgattatacaagatgccttccaacctcaaaagagcaacaattcatcctgacaagtgttcctgatagttttacctttcctaccacagtgcctcagccagcaacataatttggcaatctatcagttctgagaaggaagtttgtttgttttttcactcaaaagggctcctttaggccaaaaaaacaatcttactatccttttcaggtgggactggctggacactcaactggttgatatccaagactggcagcctagcataattaggggctcaaagcatatgagttgaaggcagaatgctaggcatagagctaattcatagcaaagaaaacccacactaccactagaagataacatgtgcctgttccgtaggaaagctgtattctttatgattagacttgcctccagagcctgccctgtgatcacagaactgaacattagaaacatgccactgggaacttgctggttggaatttactgcagtgcatttgtgagttcaggtaaattcgtcagttgattttagcccagtagacccagatgccaatttactctaaatctgcttaggtctgggttgtttaatcatcccacactttttagttttctcttatactctgggaaaaccattaagaggtgcccctgttgagagactgtcacatgtcagaaactttttcaggaagttcatatagaggaataactgtctacccctctagtgctgcccagaaatgcttggccccacccaacttgaatctaccacccagaaatgacttatgttaacaattaaacctcctctgccaacacttcagcacatagtgttcagattaccaaatacacagcccttggggaggtatgtgatctcatccttagacaaaaaggagatgggtggaaataattttctaaggccagcctgaccaatctcacataatgctatttgaactgtaccagcatgactgtgccagtacctgatcaatgatgaacacctccatctccttctgggtgtgaaagtacattatatattgatttactgctagatctagtctcctactggccctgtcctggtagtcttggactcctctaacatgtgccacaaagattagttctaatacctaaataaatagaagtactactagctttgaactatacctaggaattcaagtcatgcttcaaatatgcttttaattgtggctcaagccttcaatcatgaaaacctgaagatcccctgccccaactgaaaggataaaggtggctggaggggtgaagattggtatatactggatagcccagcatagcatctttaaagaatgatttttacctaggaagtatgttctgggctctgctctgtgcataaaagggccatctaactataggtccagagctagtggccttgctttcttgaactatgtctctgtgcccagctctggatcagtgatgggggtatctcttttctaagagatactgtggttggccagtctatgtaaggtctccacctctagactaatgagctctggggacatataaagcagtgaaaactcttttggtataaagcatatgactgaaagaaggagaaaatacaatttgcagaaggaggtgagttctgtcctagaagaagccaaagggaatgctggtcaaaccaaaccaaaatgccctctacaaaggagatgttaaagcccagggtttggccatggtatctgggttgctgaaaaggagtaggagagggagggattaatagaattaagcagttcgaggaatttcaaggctatagtatgtgttgaatttacaatcaagttccccaaaacattggtacgaaagtagaggaaaaaaagggttagaggtcagagcaataacatactcatttggtttaaaatttaatccccaactgataactgatcattttcagtaactccaattagttctcacattcttgcaaattaaagggaaaaaatcttcaagtcaaattctctcaattatattggtcatgatctaggtcactaaatctattaaaagaatcattcaaagaaaaatggaagcagctgatttatatctccacaaagcaaaactgcaaaatattttagagctcataccttcctgaaacacagctacttctctaaacactttattctctcttagatacttcttaacaattattagaattttaaaaattatattaagagaataattaggtgaaacaggacaagttccagtctctgaaaataattctagtgataaaacaagtccctcagaaatgacacatcctcactatatatgtttgactaacatccctgttaaaacataattgggtgatatttctcaggtaggtattattgttcttcaaaaattaattacacactagtatcatgaatggtttccagttcccttcccccaaatacaaatttgctccagaagaaaatcaataaaaggtaaacatatgcaagaagctaaactgaatcattttatagaaaattaaagccctatgaaataaactgctcaatatgaagagcttttgaagggataatcagggggtgagggaggtagttcaaaattctgccacatggacgcttgctccaagaattccaagtttaggctaccatagtaacatagatcagttacataatttgttaaatacatttatagatgtaaaatgaatccaaccctttttagtatagttttaatggaaaatgtattctaagttctaaaagaagttagcttacaaataactttctgaaacacaaattattttggcattaaagataacctgaattagatgggattcaaaactttagaaattcatacccaaaaaaagtacattcaaaatagcagttaaaaatacaggcaatatatgattaaaagccaaaatctgaaacatacacaataaatacttcagaagtttttaaaagaagttgatcaacatgggctacagagtccctaaaatgagaaggatttagatggaaaaagtgagatgaaagagctatatactggtcacaggcttgaatcagaaatgattatttaatgagagtgatacagctgaagcaaaatatttgagcaataaataaaaaaaaaagtaggatacctagggaaggacctggataaagaaagcttaacatgttaggctcaggagtctaagaactgggagctattccaagttattaaagaagagatatgatgaaaatagggacttaggaatattagtcaagtggcagtctctctgacagaggatgttttctgttactttcaggtgtgaatttgcaattctaactctcgaggcttaaaaatttttaatatacctgtacttcctttgtgacttagactatatcttgctgctattcccaacctgactagattccttgtctcgtagcctaattttacaattcattcatttattcaaaaactagctatgaagcacctcttatgtgtcaggcattgtgctagggatagcacactaaaaattacaaacccagaccctgtcctcatgaagctgagaatctaataggggattcagaatgtggtctgtcttgatgaatgttacatgtgagcttgagaagaatctgtgttctggtggtgttggatggaatattcaataaatgtcagttagatcaagttgattggtagcactgttcaggtcaactgcctgcttgatttatcaatcactgacagtgggatgttgaagtctccaactttcataatggatttgtctattcttcctccagtaatttatcaaaattaccatttaggtgcacctaccagtttacaattctagcagctctcattttaggtaaacagatctcagttgtgaccgtccacttttgtctgtttatccagatttcagggtaggagtttgccctgcaaattcaattttctaatgggtccaagaaaagtcattgattttcagtttgatcaccattttcttgttgtgacgacaagattgacaactttcaagatatatacacgttctagttgaaacaaggagtcacaaactgatcaccttttctaactgaaatgaaaagaatgtattctccaaatcaatggctgcacagcctgtaactgaaaccttattaatctactctggcagtgatatcacatcgggcaaagtagctgcaaatgaggctactaattgtttaagtctgcagtagcctacagtttttccccataagacacccagtttctgcagccattaggctggcaaattaaagagagctatgttaggcagcagtatatttgcgtcttttaggtctttaattatggcactaatcgctactgtcttccctgggataagagatgtttttgatttacaattttgatctgatgaagggagcagtttcagaagtttttatttggtcttttccctaccatgatagcttttacttcagaaattagagacccataagggggtaactttcaactgtcaagtatatctatttcaattatgtacttggtgatggagatagttatcactgcaggggtaggggagtctgtgggcacattgagcccactgtgatttggaatttggtcatagatttccactctaggaatcaacgttaactcagaccctgtgctcaatcatccttgagagatctagttatttccgtttcctcagtgtacagtcacctgtgtaaatggccagaggtccgttttgggaggactgtggatactgtcataatataaactttgactagtattgcagggcccttcttaggaatccagccacttctttggtcagtagtttctggttctggaaattagttcaggtctgggaaatgagtaaagaattatgctttccactgggctgactgtcttcagcctcctgctcctctgttcttgcttttctttctttaattagagatgctgaacagcaccattcttaattggcttggcaagcaggggaggaggtgggtgcagctcctgagggggaaaccagttgtcttgttgggaagaggcctccgcagcatcttccaggacagtgggtactcttctagcccttattagggaagggtgggccacctctgcacacccagagggttcaggtagacttgtagactccagatccttaggggcacctatccagatgtcctgtcagagttttcaggatccctggtcatccctatcagggccctgtccttcacataacagacctacctgggctgagcattcagatgcctctggagctctgcaactctcacaattaggtctttagcctgttgttttaccctgtccacccttccactactggtatagagggcctcttatgaggctaccaccaaggctttctcgtttcacatacttgttaacagttctcagcctctcattatccttatgtagggtgtcaatacaacttagcagcaaatgcttgcatcatggcttcttccacagtattctactccaacaggacattttccaagatcatcatcagtgcaatctttatgaagtgaactgccacattgggccaggatctattgctgtcacacctaccaatcagaacagatcctgctacatggtgagtgagccagttacaaattacctcctattttctcgtatcactatccatactcctagttttagaactggtcttctgagaagcagacactaagatgggattacatgtacaaggatcatgttatcagatatgcccatgtaaaaggaaatagagagggagcaggaggaggccaggagagcagtctgacagtaatgcaagtcttagccctagtaaaggacagtgagagaaggttggctgaaagcaaaagcatcctaggctgtaatgtagtctaggaaaagtttggcaaagccaaccaagagtactcacttctgcagcacatatactaaaattagaatgatacagagaagattagcatagtccctgtgcaagaatgacacacaaattcatgaagaatttcatatttttacaagccagaaaagataagagtcctatcttcagcctccttaaacagaataactctcagccaataattttgtatccagcaaaactaagtttcataaatgaaggagaaataaagtcattttcagacaaacaaatgctgagggaatttgtcactaccaaaccagcactataagaaatgctaaaaggagttctagaccttgaaacaaaagcccaatatgtaccaaaacagaacctcttgaaaccttaaaactcacagggactataaaacaataacacaatgaaaaaaaactatctaggtaacaattaatatgatgaagagaacagtgcctcgtatctcaatattaacactgaatgtaaatggtctaaatgctctgcttaaaaaatacagaatgaatttaaaaaatcacaaaccaaatatctgctgtcttcaagagactcacctaacatggaaggattcatataaactcaaggtaaaagggtgcaaaaagatattccacgcaaatagaaaccaaaagtgagaagtagtagctattcttatatcagacaaaacagacttcaaagcaataacacattaaaaaaaagcaaagatggtcactatataatgacaaaaggatcaattcaacaagaagatatttcaattctaaatttatatgcacctaacactggagatcccagatttataaaacattttaaaatgtttaaattttaaaaattactactagatctaagaaatgagacagcaacacaataatggtgaaagacttcaatacaccactgacagcactagacagatctttcagacagaaagtcaacaaacaatgaacttaaatgacactccagaacaaatgcacttaacagatatttacagaacattcttcccaacaactgcagagtatacattcttctcatgagcgcatggaacattctccaagacagaccatatgataggccacaaaataaatctcaataaattttttaaaattgaaatcatatcaagtatattctcagacaacagaggaataaaactagaaatcaactccaaaaggaaccctcagaactatacaaatacatgcaaattaaataatctgctcctgaatgatatctgggttaacaatgaaataaagatggaaatttagaaattctttgaattgaatgataataatgacacaagctatcaaaacctctagtatacagcaaaagcagtgctaagaggaaagttaatagcactaaaggcctgtatcaaaaaaggtgaaagagtacaaattgacaacctaacgtcatacctcaaggagctagagaaacaacaacaaaccaaacccaaagctacaagaagaaaagaaataacaagatcagagtagaactaaatgaaattcaaacaaaaaaaccccaaaagatcaatgatacaaaaatctggctctttgaaaaaataaacaaaatagaacattagttagattaaccaagaaaagaagagagaagatccaaataagctcaattagaaatgatcctggaaacattacaaccaacaccacagaaataacaaaagatcattcaagccaggcatggtggctcatgcctgtaatcccagcactttgggaggctgaagtgggcagatcatttgaggtcaggagttcaagatcagcccggccagtatggtgaaaccccatctctactaaaaatacaaaaattagctgggtgtggtggtgaatgcctataatcccagctactcgggaggctgaggcaggagaatcacttgaaccatcaggtggaggttgcagtaaactgagattgtgccactgcactccagccggggtgagagagcaagactccaactcaaataaaaaaaaaaaaatcatttgaggctgctatgaatacctttatgtgcagaaactagaaaacctagaggaaatggataagttcttggaaacatacaaccctcctaggttaaatcaggaagaaatggaaaccctcaacagatcaataataagcaatgagattgaatcagtaatttaaaagttgccaacaacaataagaacacccaggaccagatggattcacagctaaattctaccaggcattcaaagaattggtatcaatcctactgaaactatttcaaaagactgagaaagagggaatcctccctaaatcattctatgaagccagtatcaccctgatactaatatctggaaaggatacaacaaaaaaagaaaactacagaccaatttccctgatgaacatagaggcagaaatcctcaacaaaatactagctaactgaatccaacagcacatcaaaaagataaggtaccttgatcaagtgggattcattccagggatgcaaggatgatttaatatatgcaagttaataaatgtgatatatcacaaaaaacagaattaaaaacaaaaaccacatgatcatctcaacagatgcagaaaaagcactggacaaaatccagcatcactttgtgataaaaactctcaacaaactagacatagaagggacttacttcaaaataataaaaaccacacatgacagacccacagccaacatcatactgaacggggagaagttgaaagcattctccctgagaacaggaacaagacaaggctgccgacatgcaccactcctattgaatatagttctggaagtcctagccagagcattcgggcaagagagaaataaagggcatccaaattggaaaagaggaatccgaactattgctgttttcagacgacatgatcgtatacctagaaaatcctaaagactcctcccaaaagactcctagatttgataaacaaattgagtaaagtctcaggttacaaaatcaatgtacacaaatcagtagcactgttgcacaacaaaatgaccaagctgagaatcaaatcaagaactcaatctcttttacaatagctgcaaaaacaaaacaacaactaggaatatacttaaagcaggtgaaagatctctacaaggagaactacaaaccactgctgaaagaaatcaccgatgaaacacacaaaaaaggaaacaacatcccatgctcatgaattggaataatcattgtgaaaaggaccatattgcccaaagcaatgcatacattcaatgcaattcccatcaaaataccaacatcatttttcacggaattagaaaaaaaaatcctaaaattcatattgaaccaaaaaagagcccaaatagccaaagcaatcctaatcaaaaagaacaactctggaggcatcatattaccagacttcaaattatactacaaggatatagttaccaaaacagcatggtactggtataaaaaacaggcacatagattaatggaacagaatagagaacccagaaataaaaccaaatacttacagccagctgatcttcgacaaagcatacaaaaacataacttagggaatggaccctctttttaataaatggtgcagggaaaactagcaatccacatgtagaagaataaaactggatccctatctcttaccttctataaaaatcaactcaagatggatcaaagacttacatataagatctgaaagtataaaaattctagaagacaaggttggaaaaattctcatagacattggcctaggcaaagaattcatgactaagatgcaaaaagcaaatgcaacaaaaacaaaaataaatacataagacctaattaaactaaaaagcttctgcacagcaaaagacataataatcacagcaagcacacaacccacagaacgggaggaattatttgcaaaccacacatctgataaagaatctagaatctacaaggaactcaaacaaatcagcaagaaataaacaatctcatcaaaaagtgggcaaaggacatgaatagatatttctcaaatgaagatatacaaatggccaacaaacatggaaaaatgctcaacatcactaatcctcagggaaatgtaaactaaaaccacaaagatgctaccttacttctgcaagaatggctattaaaaagtcaaaaaaaaatagatgttggcatggatgtggggaaaagggaatgcttatacactgctgatgggaatgtaaattagtacaacctctatagaaaacagtacggagattccttaaacagctaaaagtagatctaccatgtgatccagcaatcacactgctggatatctacccaaagaaaaagaagtcattatacaaaaaagacacttgcacacatatgtttataggagcacaattcataattgcaaagatgtggaaccaacctaagtgcccttcagctaacaagtagataaagaaaatgtggttatatatacaccatggaatactactcaggcattaaaaggaatgaaataatgtcttttgcagtaacttggatggaatagaagggtaatattctaagtgaagtaacacaggagtagaaaaccaaacaccgtatgttctgacttataagtgggagctttactgagtatgcagaagcatacagagtgatataatgaactttagagatgcagaagggggtggctgggagggaaggaagggataaaaaaactacacattagtggccgggcatggtggctcatacctataatcccagcactttgggaggccaaagcgggcggatcacgagttcaggagttcgagaccaacctgaccaacatggtgaaaccctatctctactaaaaatacaaaaaaattagcctggagtggcagtgcatgtctgtcatcccagctactcaggaggctgaggcagaagaatcgcttgaactcaggaggcggaggttgcagtgagccgagattgcaccactgcactcgcgcccgggtgacagagtgaggctccgtctcaaaaaaaaaaaaaactaaaaaaataaataaataaataaaataaaataaaactacacattagggacaatgtacactacttgggtgatgggtgcactaaaatctgagaattcaccactgtataattcatccatgtgacaaaaaaaaaaaaccatttgtaccccaaaatgtattgaaataaaaaatttttgaaaaaagacatcagggaactttaagttgaagtcagctaacaatggagtcccatgtttcgcagtaatgggtctgctttagtagctccactgcacttaatcataggcagagaatagcccttaggaagtataaacctgatacaaaagtagtaacacatgtaaaaattttttgaagcccagcacctagggtcctcaattaaccttcctgtcctgggaagtctgtgaggttcattgttgggtcaccacactaacttttctatttttttaaattattttttctctcattttttcttcctatttcttcccaatcaacacactaacttttctaaagggcatttcaggttttttgctgaagaatcctccaatctcctaccccataaggtttaatcctagctgctggtttatggagtagggcaggagaagagagctgagagttccattattcaaacggcatattttcatttgatcccatcattcttagacctctatctcactcacatgtctctgtgtctgaaactccaaagtacaagagctattgcagtttaatttctccagaaaatagactcctaactgaaggagagtatcccagctgcgtgggatggcagaggggtcccagtgaccaactgttccatgtgttcatcttcaactgtctcccagttttcagctcctttctcacccccaccttcttccatacctgccaagttctaaagcactaagcaggtcagaagagtgaatgcattattttcactgatattcttctctgcaggcactctgttgttgtttcctcaacttctatcaagtcaatttgtattcttccagctatgagccttccaaaatttgtttaaatcactcacctgctgagatttcttcttatccattaatttcaatgatcagctatcatgtcttgtctaataaatatcatatccaaatgtaaaagtaggcccctgggtgcctattcttaacattttcttcacaattcaaactcaacttcacctattttggtgatttatgataaaaaattatgattttacttacaccaattatacccacagttttccaattttacatttgttattggattttgtcaggtgggagtactttaggagttttatacatgggaagaatatgggtttgtgagataggagcatgtaagagtgaacacaccaaatgatgtaatagttataaaaaaaatatcctgaggccccacacacatactgccttacttactagcttcacaagcaaaaaatgttttgactaaaatggggaacattctaattatgcacatttgcattttttaaagcacaataatactacgcttcaataatatttctactattctacaagatttaaaaataataattttatactcaaaaactgtgaattctaaaatagatcacatttgagattgctaacaacccaccctggtatttgagttagaaattccatcaatgtttttatttaaaatttttttgtaatgtactaatttctaaagctttataagcaccatgtggaaaatgtattaagaagcagcttcatagcagttgtggtcttcgtgccttgtccttcgttctttcttcactattatctttaagctttaacaccttggtttcttcctccagcctctaacacatgactttgtctcccagctctgtgcgtgttcattctctccaggctcaacagagagacacaaagtattttctcttctgcagttagcctcagcattgcccccacacacagttacagctggtgtggcccagaattcccagaataacccacttcattctccttctctatacctgcttcctatgagttgtgttttaggcatactatgctttgaaattatactataactcaggaagttaggatgtttcattgtggcaatctcatgggaataaggccagcataaaaataaattatcctggggagacgacaaaaacacattatagattttgcaaaaacgacagcaatcatgaagtaacctggaccattaacaagaagatatttgtaattatccacttataaatatacataccagagatccttgaaaagtataaaattgtactacaataactttaaggttccctcttattttactgactccaaaatgaactagatatctttaaaacagaagaacagactctctcattccatcacttccaattcactggactgttcataacttaatgttcttgatcttcccaaggagctgcttttatctgattatataaatcaatggtaatatactagaaaactgcagcctggaaagacaaagcaacgccacagttaaactgaaaattctactagatattaacaacaacgaaaatcatatacataaagctaattctattatcataaaagagctgttttgttttgtttctgacactaataacttcttagcattccaagcaataacatatttcacctacgatcttgttttaatttgctttttaaaggtcattttccaagagtagattgaaacaacagggtaagaataagaaatttcaagatactgtttacacacctgaaataaagtatacttaggtttttaaaaaagtccctcacctctatccaaagcagagagaaaattccattagctgcattttttttttttttttttttgagacaaagtctccctgtcgcccaggctggagtgcagtggcgcgatctctgctcactgcaggctccgcctgccaggttcacaccattctcctgcctcagcctcccgagcagctgggactacaggcgcccaccatcacgcccggctaattttttgtatttttagtagagacggggtttcaccgtgttagccaggatggtctcgatctatgacctcgtgatccgcccgcctcggcctcccaaagtgctgggattacaggcgtgagccaccgcgctcggcctgcatattatttttaaaccaatgattgctaacaaacacacaaaaaaaaagtaaaaaaaaaatcactccactgaacgcttacaaaagaaaaaacaggagaatacaatgtagttaagcacagctcctatatatatagtacttttcaatataggcaactgcaacaatgaaagaacacagccttctacattcttaaataccaaatgcccccttgtggacagcactgttactagatttgcatataaaatctgtttaaactaacttttctgtctgtgatttgaagctatgtacctatcaattgaccattctgatcttggagagaacacaaacccagtgagggctgtccacagaacacctcaggaggcagtctcagagattatagcattttaataacctcaatactttaaaaatatatacttacacgtgtcaatagtgctctagtgtcactaattttaatgactggttatcaggcattaaaaacaacatttctaagaattttcaaaaggcataaactaccacagtgagcccagtgggagcatgactaattgggtgtacagtgaggtaatgggtcccaggaagacccaaatagggctggatgtccatcaggcagcacagctaaaagaagaatctgaatcatggtaaagaaattagtatcacagtcaggaaaatggtgtggggcaacaggatgaagaaaagataagtaggtcaatgagtaataagactggaagtcagagagtgggacatgacatggaccacaacagagaataatagaggggagagtcttgcttctctgaagagccaggtgtgtgataaaaacaatggcccgatggtttaaaagaactaagacttaaaaccatctctttcttcaggcttctcttgcttttgtaatatgttcttctcctgtttgtcctatggcaagctgaaacatatgtctgaagggaatatagacaaacaggcaaagattaatatttcaaaaagccaattcatcaaaggattaatttgcagggagaccaatctacctacgattccaaatttactaaaaattcgctttaaggaaaatcattcatatatgtgaacttataacctgaaatatactctttttctaagaatattttcaataataatactaaatgctaaatgatttccgtaagttttgggttttcaacaaacatttattaaaatgttactaaataaaattatattcattagaacatattcaaggatttggatttcggcaaattggcttcctgtgaattggttttctacaaattgatcaagagtcttccagagaatgtttgagatgagattaagtattttcctaaataatgtttctctgtttctacaccttctcccccattcttttcaccaccagctagtcttgttagctttaggaacaggatccatctgactgactaagcatatgcactggtgagagatttccctgaaggatccaagctgcctgggtgtagtggaggacaagggggagggtactgataggaaaactagagaaagagaaaaataggggtcatcacttttatgactctgaatgagtcaaggaataggacttccactttgcaatacaattgactacagggatatggtggggcttgttgataagagccattacagtaacttatcacaagcaaggctgtattccacatctttctctgagggatatacatcccctatatctgttgatcttaagttgtgctctgtaatagagcctattgtgaggtctgccaaaaaaatacaaatgtccaggccttactccagacctaccaaatttctggggaaatcctcagaacgtatacttttaatatacattagtatacatacataatgtatataaaagtatacattaagcagcactattcacaatagcaaagacatggaatcaacccaaatgcccatcaatgatagattggataaaggaaatgtggtacatatacaccatggaataatatgcagccacaaaaaggaaagagatcatatcctttgcagggatatggatggagctgaaagccatttccctcagtaaactaatgcaggaacagaaaaccaaacaccccatgttctcacttataagtggggcctgaacattgagaacacatggacacagagaggggaacaacacacactggggcctgtcagggggtagggtgggggagtggagagcattaggaaaaatagctaatgcatgctggacttaatacctaggtgatgggttgataggtgcagcaaaccaccatggcacatgtttacctatgtaacaaacctgcacatcctgcacatgtaccccagaacttaaacattaaaattaaaaaagaatatacctttaatatatattaatatggctacaggtctttgctgaacatacctggaaattcttggaaggaatttcaggtaggcactaagtcccgttttggtgaatgcacatgttagagactagaaaatgtacacccaactagctcaagggaagtaaaggttctgcactttttattaagagggttaaatatcagctgggtgaggtggctcacgcctgtaatgggaggctgaggcaggcggatcacctgaggtcaggagttcagcctggccaacatggcaaaaccccatctccactaaaaatacaaaaattggctgagcgtggtggcaggcacctgtaatcccagctactcgggaggctgaggcaggagaatcgcttgaacccgggaagctgacgttgcagtgacccgagatcgtgccattgcactccagcctgggcaacagagcaagactccgtctcaaaaaaaaaaaaaaaaagatgttaaatatctaatgaattctattatagttttgagaaggtaccaaaagattcagaagattcacaacttatataacagcacagcttaataagtgaaaacagattgcacatctttgggccttatgcttatcccttccaagttgattggggttaatttcacaacagacttgttttaataaaatagtacttttcctttatcaagggaaaacagaacaggaactaacagagcttactatgtcaggcactatgttatttgttttatctatctctaataatcttcacagtaaccctgcatgagagtttaattaactcaatttcacagatgaggaaattaagcctcagagagatgaaataacttcctcagtgtcccatagtctgaatttgagccatgatggtctgattccaaaacctacgtttcgagggaaaataggttatactcagtacattttctcacccctactcttccactacacaccacatcacattttctcctatgtcctagcctctaattggcacttctttcttcgcttttgaataatttgcctgaactctggacaacgtgttttatcctctcctacagcagaattttctagaacattcttttcctgaacattcataaagccttccccttcttgacttctgtgataccattcttccagttgtccccccatcctttctcaatatttttccttctcaataatattccctaaattgcctcctaacactttaaatgtcagcattccccagggtttcaacctcaattctatttttcagactgcatatttttcctgagcaatcccttgtagtttcatgactgcatgtgacacttatgacttggtgatctctgttttcagagaagcaactttccataatccaaaactattttcagttgcttccaaaccactatcacctgtgtaatacacacaaacaaaactaaacttaccatttcctaacatcctaatttcaatttctattatcctgttcattgtaatccatgaagttattcaagccaaaactctcaattgtcattaaattctcttgcagtcttacccaatatctaagtattcatgaaatcctcattcctaaatagatctttaatctgtctcctctgctccatccccatataatactgcccaagctaaaaaaaaacccaccttcccttacctagactacgacaaaagcatcctagctggtttctctgattcaattctaacccaccctgaggaatcctttcttcatggtggttggggtgggggtgggaggatctttcaacctctatataaaatatttcaatagcttcttatcatatacaaaaaaaattcacactccctaccatgaataccaaaccctttattatttagcccctgcatattatttccagcttcatcgctcatcatccctcttatttattccagacatactgaactaactgtagagctggggtgtctttagacagactgacccagaaatactttataataatttgaaaatctacctatcttatgattttaaaattccacttctaagaacatgtatacttgaagcagtggttctcaaacttttttattagaattacctgaagagttaataaaaatatagaggtggcaagtaggttgaaggacaggacttggcctttgtatttttatgaagtgccctaggtgattccataacctaccaaagtttatggatcactgccttaaagcagaggctggcaaactataacctaaagatcaaattcagcttctgcctgtttttgtaaaccaagattttttagaatacagcccaccaattaggtgttgtctatggctccctttatactacagcagcagggttgaatagctacaacaaagatcagagatcatacaactgcaatgctgaaaatatttactatttatccatctacagaaaagtttgctaagcctagaggaacactttgcactgaaagacacatataaagatattcactgtggcaatgcttgtcatagtgagattttgaaaaattcatgatgtacgtaaataggctaatttacgtaattcatgatgtacgtaaatatactaaggatatacacatataatgaaatactatacaactgataaaatttactagatctttattaacatgaatggaattaaataatgagtaaaagaatgatatgcacagtatgatactttttatatgcatttttatacatacaacatgtagagagatattaaaaataaactgaaataatatataccaaattcatggtagtccttgcctataaaaaggaaacaaaaagaagacagggaggagaataaaagggatctcaactctataaattgttttcattaaaacatttaaagtcaaaaagggacaaagatctgaagatttataaatactagaatatggagttgtttgccataatacactctgtgggtttcaactcaaaattaaaaccagaaacaacctaaaatacccagttatagggaaaagtaattgaacattcacattccaacacaatggaacataatatatcattgaaaaatgcacatgaagagaacataacatatgaaataattgacttaattaccccaattagcataggattcaaaactgtccatgcggtaaggttataattatattttaaacaacaataaaaactagctgtaatcctttttcactttgtttgttggctgacttatttatttggttgttctttttaatcaatatgtatgcatacaaaaattactaaaaacagaactgtctacagtggatatgtttgattttatgatattctttttctataccttttattttccaaataatatcagctgaatacatgttgaacgaatatgtatgaatgaattgaatgaatacataaaatgaaatgccttcactttaaatgactttgtgtgtggcagatacagccaactgtacgctcacaatccactcttctcttcttcctgtatattcagtaaaacactatatttcctagcctgtcatgcacacgaaggtgcccatatgatacagttctaactcccaatgaaatgtcaaggggaattactgggtgcagcatcttagaaagctctttgaaggggagtagacgtgaccggctttcacctttaccatttctccttcacctatgtctttttttgaatgataacgtgaagcagctgagaaggcgaagcagccatctttaaacacgaggacaaaagccactcacaaatggatggcagagtagaaacttaggggaagcctggattcctgaaggcattatacagccactgcaccacccctggactgcaaacctcatactttctgtcacatgaggaaaaaaaagaaaagagaaaaaaaaaactttacttgtttaaacctttctcttacattctgccaaatgcaacccttgatacatcatgctaaaataaaattttaataaattaccccactgaaagacacttagaagataatataacgtatcttaccttcagaggagaaaagtgaacctcaagaaaaaaaaaagttggaggcaccaacctattatcagaacaaagactaaagcttcactctcacttatgtgaataattttttctaaaatattaaaatcacactgaactttacatttcaaaatggctgaaacaggcggggtgtggtgacttatacctgtcatcccagcactttgggaggcgaggcaggtggattgcttgagctcaggagttcgagaccagcctgggacacacggtgaaacctcgtctctactaaaaatacaataattagccaggcatggtggcatgagcctgtagtcccagctattcaggaggctgaggtgagaggactgcttgagctcagcaggcaaaggctgtagtgagccaagattgaaccactacactccagcctgggtgacagagtgagaccctccctcaaaaaaaaaagaaatgctgaatggtaaattttaagttatgtatatttaccacaataaaagagagataaaattatattaaaatgaagtccactttaatgatatagtttaaagataacattttatacatttttgtcaaataacatataaaatattacacatatactagtcaacaacgagtgcccatccttttgctactcataagcaaatctgtagtttgaaattattcaaaattagtattcaaactaacacatcaatttcataagtatgtctgtacagattactcctaaacactaaacaatccacaacaaggataaagaatcgggaaatttacagatggtatttgaattcatactctatcccacaaaagcaactaatttaagcccttttccctaattgtcaatttaacaggaagccaaaaatatgtctgcattacacaattatatgtctgaatttcacaaatattattctttatatcaaagaataagacttagttttgtccttagctaagagggtctcttgactggatataggattgttggatcccaatgctttttgcttagtaattggacacttctatcgctgactccttgattagatttctaatctctgctgctcagacacacccctcttggattcatgagtaccaaacactcatgaaagcacctgtccagagaatagagaggaccagttctgtttatactgaactttcattctctttcctttctgcttggtctgtggtcccactcttcgttgtgctaatatttcttcagtcctttactgtggagaaatataattctctgtctctggatctaaattattaaatctcttagagaaccacattttcttcaaaaataacacaaatacatcaaggaaaataaatgtattttttccaacatgaatatgttccagagtctcaggtagtagttagaaaaccaattaaacgctccttagatatgccctaaggtattttactaagtcataccagcacttgttgctactctccacaagggtggtgatacccactctgttgagctaggactgagcctcagttatcaagaagcaggtagacagaatattttatatccagtaggtagtaataaaattctacctgcaattaagaaaaggcactaagcttaacatagccctagcaactatttctaaatgccacaagagggcgatataactctatgacagcacatgggaaaacaatttttcgagttagaaaaattcctgactttccaagatatggaaataaaggcatgtctgggttgaaagtaacaagcgtgcaaaaggacttatttctcctcaattcattattagcaaaaacacagtatttgtctatatctttctctgaaggttggcggtgattcaaaaagcaatatctatacatgctctgctcttcaggacacctgtgaatatagctggcaacttagtgctccacctatagctactcaaaaattatttgttgtccttcaaacagatcccttgaacaaaacagtttatttggaccttgcgctagtcttcaaacttctctttgaaatacgtctggaaaaaatagacataatttccttcaattattctttgtgtttaatcacatttctactcaccactggcattcgttcatagacacgaatagaagatagtctatctacaataaatcaaatatgagcacttaatgttttatcagttttaactcaaattataaaatgtacatatgattggttttgtacctgaagagtttccatggattttttccactttctccttgagataaacaatttgcttttctagttcatcatttaattcaagttgtgtctcataacgggttttccattcactacctgagtaaaaacagggagaaacaatcaagatcaccccaccacctctcatttattcattaaaataacattatgagcttgatcttactctattactatatttgactttattggcaatacagatcaactagaaggaaatagttattaagtctgtatttctgttagtaagattttccagactgcaagaattagactcacactcaggctaccaaacagccaaaccttatcacaactactgcaattcctcttcttccctacttcccacctgcttttttcttttacttcttgtgcatccttacaatgaattcaattagagggaatatcaggacatgtttctttccttggaacttgaaatacccatatatataatatccatatatttcatatatgatatttcatatacatatccataaatatatatatttcaagttccaaggaaacttgaaatacatatttatatatttatacattttatatatgtttatgtgtatataaaatatcctaaacattactaacctatccaatgtcatgttcattttttttcctttgaaagcaattctgaagtctgctgaataactatcacttacgtgtctgccgtgtgtaaagcacacaatgcttcacatacattaagtaatttaatcctcattttagaaatgtagtcacctattttacaaagatgaggaaaccaaggctcaaagatgtcaatgtcaaataacattcttaagatgacagagctaataaataagggaaccgggtttttaatccagttttatctgcctttgaaatcatatcctcttaactcctaagctgaaggaacaatgtacatttagctatcttctcaggcattttctcttaaccttaagcagttttctttcactaaacccttttagctattaaagtcaaagcattttccttatgtctggggaaaaagaagaatacagcctaaaattaaaaggtctttgttcagattcaaagcccaaagctaactttttcgagtctttaaagtcaggctttgtagagggcaaaaagatggcttctttttcaactttaaatgctcttcacaggtctgaaataactgctgctacataacagttagtggaagagttaaggagaaagagtattagcacataccactaccaacctcctcagccctgacacaggtctcccttacaccctcatctctatgcaaatgcggtctaccaaaggggatggaaccccctcccatactgaaactgaaagtcattaacccaaaagctttggaaaggtacaagaagaaaggagaagccctgaaagactaaacatttacccaaaagatacagtagagctcaactgtatggaatcatctttataacttgctacctaaagtctccctttgtcatggtatcccctttcctaacatggtaacggattcttcagagcaagatgagaatggttaccaaaaaattaaaaatgcaatttatttttggcacatctgagtacagtttataaattttgacaccattttatttaaaaatattattgacttttaagtcaatcatcaaatttaattatcaaatatagacaagccagccaggcacggtggctcacacctgtaatcccaccattttgggaggctgaggctggtggatcacttgaggtcaggagttcaagactagcctggccaatgtggtgaaaccccgtctctactaaagaatacaaaaattagccaggcatggtggcaggtgcctgtaatcccagctactcaggaggctgaggcagaagaattgcttgaacccgggaggcagaggttgcagtgagctgagattgtgccactgcactctaacctgggtgacatagctagtctgcatctcaaaaaaataaaaatttttctcaaaaaaataaaataagatagatagatagatagatagatagatagatagatacatagatacatagatacatagatacatagatagatagaccgacctattagtatacagtcgtaaccaaatggaatccggctgcttgccacttacagagtccaattaataagagcaaggtctggcataaagtggctttattaaccccaacatcaacatgggacaacacaaaagacccaagatagacaccaaaacaagacacacagaccttgtaaccagcacaactcctgcatgcctcccatattaagtttccctttgaaagccccctgccttttccctagaaattggacatggttattttggatgggaatctggccacttgtccattattagttttggtcaatgaagtcactttctctctactggacctcgcttttgttaattgaactatgcaatcagcacttacaattgctggttacaattttagtgtcccgtatggtgagtgctgtatgctccagggcctgagcctgccagtctggtttctatcagatggggcatagggccacctgtgaatactagttgctgatggctagctgacccatggctaggatattagggaatttcccagcagctgccaagactcttttgtcttagggatcctctcttttcttcctgctatggtgtctgctaccttcaatgcttcactggtgcaaagaaagtgacctctggagaagctgagaaactatggaactaggtgcattagtcagagtgtacccaaccaccttctgcctcttttggggtgtcgctggggctctgctttatttagacttggctgccagtgaaactatatgagcattttatgcattggttttgtttgtatttgctgcacccttgggcctttgctcagttctgactcagttgcctgggggagccatttgaaactgaaatgagggatttcggagtctacacagccccttaaccagggatttgtttggatgcacaccacctgtttgtccgtgtgtgagatctttgtgcaccctgatctctttgtctctctttctctctctctttccccttttttccaacttcatcatcctgattatctcagaagccatctacagccctactcttctcagccaaaaccacccttcgctccctctggctggaaacagtttaccttgactggtgacttgaggaaatgggagggattcatcccacacccttcagttctagggtgctgaggctctccctaagaggagataaacaagagaggtaggggtactgtgcagtggctggaaggctcataaacctcccttccttcttttctctttcctcttcctgcccataaaacctgacctcctttctcctctccactcctttctttttctcttttcctgttcaaaccaggaaaccagtactgaagagaaaaaacaattttcaacatcctggcccctgattttgtcatcctctttgggactgcagctgattacatatggtgcatttttgtgtacattttaaactgacgggcaaattacagcaagaaaaatttagagctcaaatagttaacctgaagctatagagttaagtagagtcttctaaagctatcttccctcttcccctcttttctgcctgctttaaatctgctgttactaagctgctggtgctaggactcatttatgatctaactagaatgtaaacactggaaagttgtttgaaactgaaaataaaaaataacaagggtaaaagcggtttaaaaaaactgccatagagactcctttacccaaaattttggttcacaaatttccttggattacctattagggcaaatgaagtttggccatatgaacaggttccaattttgtcagaaaaagaacttgaagccagctatcttttgtaggtctgtgagtttgtaatgctgtctcatggctggagttccaaggtaaaagctattggttatttctttgtgcatgtatgtatacatgtttagatatatttatgtaatattcatgtattatgttctgcgttgtgtctagcatgttatcaaactggcttataagtaaatgagtactcaaaaattaagtccaaatgcttttcaagtgcatgtgaatttttaataaataaaagtggttttaaaattattgataaaaatagaaaggtcttcagaattgtccccatacatttttgtctaagtggttttatatttgtatcagtgtgtatacaaaggtgtcaagggttgacataaaggttctaagactttaaactcaaccaaaaacagaataatctttgtgtatttttttttgacaaataagactaacttgttagttcaatgaaacagctaaatcttcagagtcatcagcaaatacatttaattttaaggttcttaattaggtgctcaccatttagtgttcagattttaaaaatggttaatagggaaataactttattatttatttttaatttttttttttgagatggagtctcgctctgtcacccaggctagagtgcagtggcgcaatcttggctcactgcaagctccacctccctgattcacgccattcttctgcctcagcctcccgagtagctgggactacaggcgcccatcaccatgcctggctaatttttctgtatttttttagtagagacagggtttcaccatgttagccaccaggatggtctcgatcttctgacctcattatccgcccgccgcagcctcccaaagtgctgggattacaggcgtgagccaccgtgcccgacccggaaataactttaaataatgattagttttgtgtaatatctcagttttcagaagtaatctagataaactattaagaaatggaaaaggtgaatacatgtaaatgagataaatgcttgtaagtggactttttgtgtaagttaaaatcttaaaattattttgaattaaataatagatgctccaatccaatagataataatttgatttctgggacatttccaattaagaaaagattatgatatgggaaaacatatttctaaaattgtagaatggtttcatccagaaaatcctaacatctgataaacagttcaggatttcttgcttcctaagttttcactaaaatttaaggttactaagaattctaatatataattctgcaagttgtgttctcattttttaaaaaagagtaatttaagtaattcaaaggttatttaaaagttatttctaaaagaaggtaaaaaagaatcagtgagtaggggagagagatataaagaaagttgtggatacaaaaatgtatttataataaaaaagttataaaacaagcaaataattttacatgagaaagattttatatagtaaattcttatcctaaaataaaatggctagttattcagaaaacagaaaattttaggacaagtcagaaagtccaagcatgtaataaatggtctatgtaagttatgataaggttcataaaaggaaaattacaaaagctattttatatattaagttggctataattagaagggaattatttttaatagtctttctaagattgatcccctatcttaaaacaaggttttcttaaggtattacttttctcttaataaaattacaagagatttttaaaattttagaaactgtttcttttaaaagcttctcagaatcatatctcagaagttcaactattgctgtctcactgctttcagctttttctccccctgagaaggtctgagatgacagctctctccttcagcttctaaattagcttctgtaacttttttcctctggttccactgttgtggcctgatgctaaaatgttttatcttaaaggtctagaaaagcaatattttccttcagtataatttgattctgtactcttggctttcttgatagatgtaaatttttcaatgtaatcaagaaacttctcatgcagttactaagaactatgtattcctctgctatactcataaccctgaacacattcttcctatgtctgattaaattcaagaatatttttcatcaggtttaacttccaggttgtctaaataggcttcctataaggaaaagtagtcacactgcaggtttttctttgcctttctggtaactggcgtaagaaacaacattttactttttatcaaaataattcatatgttgtcttcattagatttttaactgcttagaaaaactgagacctaaaaggctgaaagttgttatatgcatgtaaccttctgtattgcctttaagtctttcaataatcattttggttaaattagtaactattggtttacaatgacctgtggatctgttttaatcaaatgttttgagccctttaacatttttaagaaacatcttcaaaattgaaacaaaaattaagtctctggcttattgctggtgtttatcaaagctataaaagttaatcactgcaaggttatagaatctttttacagcttccagtcaagtcatagactccagtgtcaccacctccagccccttaaaaaaaaggtccttatcaggtgttattaactaatccttgtgctatgaagttacagggctttgactcctgggtacacatatctcatctaaagaaggcagtgactcctgccagtatctgacagcaaatctaagttaaccgaagccccatttttagatctgggcaaagatgacaatcatagtaaactactttcatgagacacagggacacgcctgtaccacaaaaaaattaagattctcttaataattttgcctctatctaaaataatataatttattctgtgcctaaataaatagatactaaataatttaaatgtttaaatttagtgcctaaattgacactaaataatttaaatgtttagctacctataagtttcctttcctgtaactgtcagaactaggcagggcttattacctttttgtttgaaacactgctaatactttacatttttttttacctccagaatttgaaactattgaatccctccaggcccaggggctatcgcagaagtgtatcattgtaagggccagattttgagggataaaattaattaagaccctccaaatcaaggacagacacacagatgcctaaacagctgaacaatatgcttgtgttttgtacagctaattgctataagtcaagattacagtatctcaatgcagagaatttatagataactcaactttataatcttattttttgagttttggtttttggctcttatgttgcctaaaaggggttttaaagattactgaatacctgctcacctccactcccatctggcctaaaacgtttaattggatttaagtctttgactctaagttccttggcaataggggtcccactgagaggcacgatggaccaggggcaagtagccacaccatcccagaacttaagttaataaaagcttagctatggataccacctctgcataccttgaccaaaaaagggggaatataaactaaaaaaaaaaaaaatcctaagccccctcaacagactgaatgtatccacctcttggccaaagggaatcccaaagaaacctgacaaactagttcaggccattatgagaagtggagggttggacatgccacactataccttcccccaatttggagtttaggcacaaatgaccagcattaacattaaaatagagatcacataagactgacaagacagactctgtagcaataagatacacactgttatgtttcacttactaacaaagtctctcagaagctcagcaaacatgtgttaatgctgcaaagctttcccaaatttattttattctagagtttcctgtatgaaatctcttatgttaaataagtaagaatttggactaaacagttatgcctttatagttatagtcttctgttatctcttcatacaggtcctcatatttctggtcaggaatattgtcagatcttttatggtttcggttggaattgtgggtgggatcatttaaaaaccctattttctaactggttattgctggcatttgtttttttaaataaatatttatttcatgattgtatccaactattttctaattctttattaatatactaatctttataactgtatcacttcctctctaatagctataactcatttctatttcatattttattgcttaattagaactttcaaaaactatattgcattttaataatggcagcaggcagctttggtattttttcccccaagaatggaaatgcctctactatttcattgttaagtattatgctagtttgagataaatagaagtattcttttccttgttttgaaaaacaaatggaattttatttttaaaattttagcatttactgaggtgatttaaaaaaatatattggatttattaatatattacctactagccaaaggtatttgggcatagaaaccagcctataaaagactcaaaggagaaatccaggatgaagatgtaaacttgtgtgttgtcaataagtcttctttttttttttttttttggatggagtctcgttcttgtcatccaggctggagtgcaatggtgcaatctttgctcactgcaacctctacctcccggttcaatcgattctcctgcctcagcctccagagtagctgggattacaggcacccaccaccacacctgactaatttttcttttgttatttttagtacagacacagtttcaccatgttggccaggctggtctcgaacttctgacctcaggtgatctgcctgccttggcctcccaaagtgctgggattacaggtgtgaactgccgcacctggcctccatttttcaatctataaaacggaggtaatgatattattttcaaagggtagttgtgaggtttcaatttttttaaaaaacgtacttaaagccctacacaaatactaattcttcttgcttaaaaaaaaagtcacctgaacattttctttaccattttcttattactaaactttgttgtgaaattcaaattaaaacataaaaccaaattttctacatacagtttcctatgaatcctaaaaggcttcaagaggtgactttgagaatataaagctctttggagttggctgtgtttaccacctgcctaaaaactaatccagtgacaagcaagatcaaacaataagcagatgagaaagtagaaataaaaactactcttttgaaggcttttgctgtaaatggggcagggacaggggatgctagctgaaggggaaaagtggggccaaaagaagcctgtcatttgttgtttagataaaataaattcagcatgttggtctgctgttgggaatgatccagtagagcagggaaaacagacagtgtagggaagagagggccatcactacagtgatatccttgagtaggtgcaagtaggtaggatctactccacaaagggaggagataacctgagacaagaataaggacagatcattcatagaaacaagagggaagaggatgtgcaagggtgcaggtagatgggtagctctgttggtagaaacaggtagaagtcctcttctgattgcttctcttttttctttgaaagaagagggtaagctcattacctgagagtgtgattgagtggagaggtggtagaggtttgagaagaaagcagaaagggtgaaaaaattatctgaacagtgaatgtacccctatttgtcacatgtgcgcatatttccagtaataaattccttttaaaacacctttaatattgccccactgccttcaggataaacgtaaattcattagcatcatgcaatcttcttgatttatctccttcataaactttaacctcatctcctaatgcattctcattatgacctatgttccatttttatcaattacttagcatattccccaaatggctttatgtttaatgctcctgtggcagactgtattttccaaagatgactgccaataatatatcccatcccatgtgttgctctgtaatgtgaccttaaaagcagtctacctctccagtcccttgaatctgtgactactatgaccaacagaatacagtggatatacccctgtgccagttctgggagtagcccttgactggcctggcagtctctacttatgtcttttggaatgcttgctcttgggatacatcctcttggaacctaaccaccatgctgtgagaagaaaaaggtacaagaggcatttctgacaggcagccctagctgagcttccagtcaaaagccagtgtcagatgttagccatgtgaatgagtcatcacggaatgaccagctcacttgaatcttcagtatacctgattgcaaccagagaccccaatcaagaaccatccaggtgaaccaacccagttaatccacagaattataagagtttgttgttttaagctcctaaattatagggtgatttgctatgcagcaaaagacaagcagaagtgttttgagtgtgatgtggtagatggaagttgtattatcatttactgaaggcatggtaaatagatgatctaggatcaagtcatggctctgccactacctggctatattaccttagaagttatttgaattcctgaatttcattcttccatatatggggataataataactacctcacctgacacagtccctggctttaaaggagtaaatgtttctgcccttcaccttaggccttacttttggcccactaaggaaagaactttctctcctatcattctgacgttttctctttatacccacatactagctccttcttttgagaactgctacaacttgttgagccacattttactactgggcatagttattgcatgtgtacctgtgagcatgccttctgtttttcctgtaactgggtacatgaggacgttccagttaccctgccaacgcagctacttgataagtacactgagagcctgcccccagagactgaggttatatctaagatatagatatggagatagaggaagctacttcagccttgggacaaagtagtattctgcaaccaagctttaacaaagcactgggtacttatagaaagtggcattttatttcccatatggccactattcctttttgttcatggctccccaattgaggaagagtataaatgtagcaggacgagccacagacaaaacccctcagacaccaagttaaagaaggtaaggctttattcggccgggagcatcagcaagactcacatctcaaaaaaatgagctccccgagtaagcaattcctgtccctcttaagggtttagaactctaagggggtctgcatgagagggttgagattgattgagcaagcagggggtacgtgactgggggctccatgcaccagtaattagaacagaacagaacaggacagggattttcacagtgcttttccatacaatgtctgtaatctatagataacataaccgattaggttgggggtcaatctttaactaccaggcccagggtgtggtgctgggctgtctgcctgtggatttcatttctgccttttagtttttatttcttctttctctggaggcagaaattgggcataagacaatatgaggggtggtctcctcccttataaatgcccaccctgataatcctaataaagtcctcctgttctttagcattcagttcaaacaatgcctgttctggaaagcctgtctttattaactcacccgaattctgttaggtttcccttccctaagttttcatttatccttacatagaacttatatgacttctcatatccataatctgatttgatactttctcccaatagtcaatgaacctctttagaacagggaaaacaaaggtcttccatttaaagtgttgacatatggcagggtcatatcttgcatacattacaaattttaaggatatatgagtgtgtaggtacacagcatcctccacaccaaacacacattcttccaacaacaatagctaaaacctagatacggattttaaacatatcccaaacctagaagttaagatataaagagtgtaacttgaggtgaatagaaaactggtgatatttatttaataaagaaataatatattgatgtcatgtaacaaagtttttgctaattaatgaacattttgaacttgaaaggtagaaaaataattaaatagtaataggtttgatattctgaagtatcagttttaaagcctctatcataaactatcattaatgtggccaaaaagcaatactgaaatgttggtactattattcaatatatggaatttaatgcaccatagatatcctggtaaaatgaacaataattatacaggagtcacaaatataagtatttacttatataccttcattgtcagtattgagtttggcttccagttccgtaatcttgtgtcttagttcaaatattgagagttgcactgcatccctgttatttaaaatatttttgttgattataattcaattaaaaataacatcagaaaaataatacatagtaacccactactacttcaggaacaatttactatgacacattatttactgaaggactggttaagaaataagactcaggcaaaggaaggcttccaattagtcagttctaggactcaaatatgcactaaagctcaaagacccccaggcaaccattagaaatcttttatttatttttatttatttttttgagacagaatctcgctctgtcgcccaggctggagtgcagtggtgcaaactcggctcactgcaacctccgcctcccgggttcaagcaattctcctgcctcagcctcctgaatagctgggattacaggcatgcgccaccaagccctgctaatttttttgtatttttagaagagacagggtttcaccatattggccaggctggtctcgaactcctaaccttgtgatccgcccagcctcggcctcccaaagtgctgggattacaggcgtgagccaccaggcccggcccttggaaatcctttatttttaacttaaatatcatcctaaagaagttagttacctggtttttcagaaccaagcaaattaggcactgcacattattacagaaaggcatacctagggcaatacataacagctgacaaactgaaacaaagagaaaaaaacaaacactaatttaaaaggttagctatttagggcatcagtaaatagaacattatcatatgacagggccatttattcaataaatatttttgagtgcctattatgttcaaggcattgtattaaatacggaagaattcagtgaacagtgaacagaaaaatagcaatagcggcagcaaagttccactggatgcgtatcacaagccaatgctaagttctttatagtgcatttcattccaacctgggaacaacagcaggaggtatgagatgactatttgtataccagtcttagagctgagaaaactgaggattaaagaggttaattaacttgtctaagattgcatagttactgagtgacaagagatggagtttgtgtttttgcaggactgtcctcaagtacttgctcttattctctacttcctcagaatacacagaacctgtcctcagaacgcgtgtagtttggtagcaaaacaagaaatagacaggcaattaaaatactgtgactggagctacaatagaggaaaacccagaaccctatctaggcacaaaggagagtccaattctcacgggacttgtggatggagttgggagtatgtccaaaaaatactttaaatgtttcaaaaatttaacacgaagtacgaatactgtttttaaaaagcataaaggaggagtaacagttttactaaatgtcattttatgaagttccccttaaagggatgaaagaaaaaaaaaaccccgtataactaaataaaatctttggaattttaagcagaaaacctggatttatggagacatcaaaaccaaacacaacttttggcattacagtatatgggcaaaatacacgccatatgattggatccttaagggcagcacatcctacccggaaagctgcctacttaacaataccaaaggcttactcaaagaggcacgtgaatctttcgcatggaatacttttggaacccagaccgaagtgcccaggggttaatcacggcgccggtcttacagcaccctcagcggcttcagccctgagactctgcaggtgaaggctcggggggtgtggacgggaccccacaccgcgccgcccgccgactcacttcttgcggacttcttccagcaactgctgtttcaggcggttggtgctcacaccgtcgaagttgtagtttctctcttccttcatagtgtcaggccagagacctcccgcgtctttcccctcagcaccttagagcacaagacattaagggccacccagaagccagtacggcacgaggcggtgaaccccaaccgccccccggtcgcacctcccgcgcctgccc

SEQ ID NO: 1744 - DNA, 70815 bp, Homo sapiens; identical to SEQ ID NO: 1743

SEQ ID NO: 1745 - DNA, 70815 bp, Homo sapiens; identical to SEQ ID NO: 1743

SEQ ID NO: 1746 - DNA, 70815 bp, Homo sapiens; identical to SEQ ID NO: 1743

SEQ ID NO: 1747 - DNA, 15716 bp, Homo sapiens
taagcgcgtcgccaccgcccccgcctaggcgagagcccagagagctgaacctgcatcccggacctgcggcgaccgtcgtacaccatgggcctccacctccgcccctaccgtgtggggctgctcccggatggcctcctgttcctcttgctgctgctaatgctgctcgcggacccagcgctcccggccggacgtcaccccccagtggtgctgggtgaggcacgggtctcgtggtggatctgtcggtcgggcgggacgggccgcgggcggggctgccttcccggtctgcttctgttccagtcacgaaatgggggagcgtattggtatctgtcttgtcacttaggtgatctagatctgccggctcacctcccgccatgctgggcgcgggtgtggtcagctccccacctcctgtcctggtagaaaatgggggtgagtgggagagttaccatctggttattcatagttccacctgtccgcatcattcccaagccttgcctccccttatcccatttttaagctggaaagacaggtgcttcagccccactcctgagggatggtgggggtgtgtagagtggctcctgagttgacttctgcatcgacctgggcctggttaggaggctgtcaccctcgacccctccaatgccacatatgccagaaggcattgctgaaaggaacctccttagggaaaggattgctgtcctagctggccaccaactcccacaacttatcagatgtgtggcattgcctgagggaaaaggcctaagggaaactgaagacaactgaagtcaggggaaagggttgggacaatggccatgaacctgtgtcaggcaacatgcttgtactcttaccctgccacacatgcttggactagactatgtggaggctcggtgacctcccctgctcaccccgctccttgatcacaaccctggcaactctacaacggccactgtatttccttgcagggatgggcagggatgagacctctgtctggggggccttgggtgcctcattgaggccgtcactcccatccagagctggtgtgtccgtggccagccaggattcctgaaagcagaggcatctgaggcatgaattacacgtggagtctagtgcagcatgatctccatgctctttctgctgagagtactttaaatggggacgatgcaaatcacagaagggtagagttggcaggtagggtggtgccaggcaggccccaccaggagttcccagccaggaaaagctccagggggatactaggcccaggttcaccatgggatttgggcagacttggccctgcctccccaaagcttgcaggataggaataacagtgatccccagagaggaagtctgtgtggggcaagcacagagaatccaccaacccagcctggatgggtgggtgtcaagtaaggcttcctggagtatatagctggagctaaggccaggagagagtaatgggtcggggagagacgtgagcatctcaggctgcctgggatcgagtcacaggaggagtggactgcacaggacttgtgactggttgggtcatctgaactttatcttgagggcctcagggagtcctgggttggcctgcagagttctaagtctgaggggcgtggcattaggaagcatgtggtctgtggcacacaaaatggcacatagccattttgcctggattgatgctaaccgcactcatcaattcagtcagtctgtttatccttggtcacagcagaagagcctcagaccccacccagaatcacagagcagcaggagtcctaacatgcccagcttctcagggagtgaggctgctggccttagccctgggagacctcacggtgggcagttggataagcagctcctgggcacagagcagggatctgaccttgactgtcagaagatcagaatcctctaggggtggatcctgaaatggtggtggaggaaagagagaccagcgatgtgatacagaagaccctgggcaaggggaagggaccataggcaaggccatttccacctcttgcagcctcagtctccccatctgttaagtggaaatagtaaggctgtcccctcccagtgttacttgaggtgaaaggcatgtggatggctcttttcctagttccaggcgcagatgggctcaggaagtggccactgctatttttaggggccacacagcctgaccagggtaaggagcatctgagcaaagcagatctggtgacttcctcttttaccatttcccctttggtagagacagtgaccagggtctctgccctgccctgcccagtccacaggcatgtcatccagaggctgtcatgacagggactccctccctctgcacccataccatgaagggaggtgaaggcatgtgccgcccctgcctctcatggcaccctgaagacactgggatggtgcccagggagggcacgccctgttcagggtggatttacggtcagttcccagtgaatgtccaggagagccaagtgctggtttttcactcaatgatcatggaccctaaacggggatgtgtttgggaagtggcgagagcatggcatgtgggggcaggtgaggcccgaaaggtcaatgggagtaacgagactgtgaagggctttgacgcagtggggagggatttgggtgtcaccagggccccagagttctgagtacactgaataggatggctgggatggagagaagtcaccctagggcctggactgtggtgataatggtgctggttcagggtggctgtttccaatacgggctcccagccatgctagggccctccagatgatctgctctctggcaccttactggactctggcctttagtaaggcctgggcccttggtaggctggcgggtgccaatgtaagcttctctcagctgtgtttctgttcatttccctcccaccagcctgtcctgcatactttgtctggttgaattttagctgagtggcccagggctctgttctgtttccttcttcctctctcagggcgaacaggaccctgtcttctatgtagcctgggatagctatgggtggaagacttttgggttcaagcctccagggtatatatctttttttttttttgagaccgggtcttgctctgtcacccaggctggagggcaatggcacgattttggctcactgcaacctctgcctcccgggttcaagcaattctcctgtcttaggctcctgagtagctgggattacaggtgtgtgccaccacaccaaggtaattttttgtatttttagtagagatgggctttcaccatattggccaagctggtcttgaactcctgaccgcaagtgatccactcacctcggcctcccaaagtgctgggattacaggcatgagcccctgcgccctgcctcgaaggtatatatctaatgacaagggccttggccaaactttggaggttctggaatgcaaaggggtctccaagcccctcctcccaggcagagctcccatcggggtccattaaccatagaaaccatgtgtagaggtgtgtctgtgtttgctgggggtgattcagaccaagatctcatttaacagatacggaaactgaggcctagtgtggggagtgacttcaccctgaacccccttccaataatctgaatggcccaggaggatgttccagtgaaaatccaggagacttactttatctggagttggagacaatgttagggcccttccccaaacatgtcaggcctctcccaagccccccacaggcatctctgcaccacacagcagtagcagcttttctgcacaaagatggttccctggcctttgggtcaaggtccctgctctctgaatttcctgccaccagcactgtgctttaatttgagatgtggaactgcacaggtctgccatattatctgtggctcttcagggggtctgctgcagacatcaaagttcttgggagtcttgaacctgccgggctgagggctcacacatgtcctgtgccccctgcagtccctggtgatttgggtaaccaactggaagccaagctggacaagccgacagtggtgcactacctctgctccaagaagaccgaaagctacttcacaatctggctgaacctggaactgctgctgcctgtcatcattgactgctggattgacaatatcaggtgggggctggggcacacagaggggggtgctgctcaccaacagtgcctgagaggcctccagagtctgttccttctatcctcatctcgaggtcactgacctctctccttccccaggtcctcggtctggtctggtctggtctggttggcaccacctctgcactcccaggcagaactaactttcccttcctgctgcccttgttcctctactctccagtcctggcctctcatgcctacacacaattttttttttcttttattttgggatggagtcttgctgtgtcactcaggctggcgccatctcagctcactgcaacctccgtctcccaggttcaagcgattcttgtgcctcagcctcccaagtagctgggattacaggtgcccgccaccatgcctggctaattttttgtatttttagtggagatggtgtttcaccatgttggccatgctggtcttgaactcctgagctcaagtgttctgcccaccttggactcccaaagtgctgggattacaggcatgagccactacgcctgcctacacaaaatttctgtgtcccagcccctattcagagcctcggcatggcccccacccctttccttgtctgtgcctcggcctcccctacctctccagctgcttattcttcttgggacatgccatgtctttgtacctgctgttcttttggcctggaatctatttctacaccctttgcctgataaatggcttccattcacttttttttttttttttttttttggagacggagttttgctcttattgcccaggctggagtgcaatggcgcgatctcggctcacaactcttttttttttttttaacttttattttttgagacagagtcttgctctgtcgcccaggctgggtgcagtggcgctatctcggctcactgcaagctccgcctcccgggttcacgccattcttctgcctcagcctcccaagtagctgggaccacaggcgcccgccacagtgcccggctaattttttgtattttttagtagagacagggtttcaccgtgttaaccaggatggtctccatctactgaccttgtgatccgcctgcctcagcctcccaaagtgctgggattacaggcgtgagccaccacacccagccccattcactctttaaaacatgaccctaggccaggcatggtggctctgctataatcccatcactttgggaggctgaggcagtcagatcacctgagctcaggagttgaagaccagcctgggcaacttggtgaaaccccatctctaccaaaaatacaaaaaaattagctgggcatggtggcatgcacctgtagtcccagctacttagggggctgaggcaggagaattgcttgagccagggaagcagaggttgcagtgagcagaccactgtacccagcctgggttgcagagcaagaccctgtctcaaaacaacaaaaacctgaccctggtccctttgtgacatgtcccttttgactccccagagcggtttgcctctcctcccaggccccatgcttgcttcctctaaacatcatcatgtgcccgaatttgtctgcaggcatgtttgcccaaattgcacaggcactgtacattttatatactttctttcagttagtcttacagcaaccccgttttgaaataggtgctgttttctttttttttttttcaccagtgttacttgccaacaggtggtttttaaacctgctttacaactgcgaaatctggaggctcaatgaggttacaaaattgactgtgctcactcagctaataagtggtagaatcagaattcaaatccagaatgtgtggcgttgagctgaggttccctcccaggctgagttccgtgaagggagggagtgtgtgtctgttttatccttatagcagtagaaccagaaacacagttggcgcctgataaatgtttgagctgaatggagtctcccaaattaaaagtttttcctggtcgggtgcggtggctcatgcctgtaatcccagcactttgggaggctgaggtggacagatcatgaggtcaggagttcgagactagcccggccaacacagtgaaaccctgtctctactaaaaatgcaaaaattaaggccgggcatggtggctcacgcctgtaatcccagctagtcaggagtctgaggcaggagaaacgcttgaacctgggtggtggaagttgcagtgagctgagatcgtgccattgtactccagcccaggtgacagtacaagactccatctcaaaaaaaagaaaatacaaaaatacaaaaatgagccgggcgtggtggcacacgcccatgatcccagctactcgggaggctgagacaggagaatcacttgaacctgggaggcagaggttgcagtgagcagagatgggggcactgcactctagcctgggtgacagagcgagactgtctcaaaaaaaaaaaaaaaaaaaagtttttcccagagacccgctagctgctcctccaggtgccctggcctgccggctgtttgtgatgcccattttgatgactccttcctcctctgtgtgttgtgtgactggggttatttctgggctgttgatgtgcatttctatttttatactggggacacagcctcaggtgctgccagttggaggtgccagctgataccaagaggggcctgtctgccttcactgcttctctgacccgtttagattttcacccagcgcagaactgctttggctttccagaacagttttctgcattttgctgtttgataatttatttttagtagcaacaagctactttgctatgtggtcattgggataatctacaaattgccctggagagaatgggcctccaggacctgttatctgggtcagttgtggggatcctgtcagcttcagtggctgatatctaagtgggcaagtgggactcaggaccaccagaaactccaggttcctgtgttttgggggcacatttgcttcttcagtgtgtggcgaggccagagcaaggttcccagcctcgcacagaggcacaaggcttttctcctggtataaggtgtctcccctggcccatcaccctgttcccatcatttcttcaggccttgacaaccctcttcccacaggagatggtgcagcagctgtgtactgagccctgaggcggggtctgtcctgtctggttctgtttggcactgcagctacagaaactatgagatcacgtgtgtggtgttagaagctgctgagtctgtggtaatttattacacagttctagaaaactaataggctgggtgcagtggctcacacctataatcccagcactttgggaggctaaggcaggaggatcgcttgagcccaggagtttgagaccagcatgagcacatagtgtggccctgtccctacaaaataaataaacaaataaataaataaattagccagacctggtggtgcctgcctagctgttcaggagggtgaggtaagaggatcacttgagcccaggaggttatggctacagtgagctatgatctcctcactgtgctgcagcctgggcaacagagtgagaccctgtctcaaaaaagaagaagaaagaaaagtaagaaagggctgttagggatcttaagtcagtagctggtggtccatgtcctatgtcatggcgcttaggaatttgctgggcaagccctgagccttgtggctgcagtctgacagttgatacagccctggggtactgggaggtcataggagcatggttcattcccttcctccatggaggatgtgtttggaggttggctggctgctgtgtccaatgcgcagaggaagcgggacccaattatacctacctggggccacacaaggccttcctcctgtctctccccaccagctcccatcatttctctgggccttgctccttctcctacctgcctacccacccatacagcagccctgaggcatggtgcctttctagggtttgtttttgtttgtttgtttgtttttttgagacagagtttcgctcttattgcccaggctggagtgcagtggcgcaatctcggctcactacacctctgcctcccaggctcaagcacttctcctgcctcagactccggataactgggattacaggtacacgtcaccatgcctggttaatttttgtgtttttagtagagatggggtttcaccctgttggccaggctggtctcgaactcctaacctcaagtgatccacgtgcctcagccttccaaagtgctgagattataggcgtgagcccctgtgcctggcctagtgtgttttgttttgttttttttttttttttgagacagggtcttactttgctgcccaggctggtgtgcagtggcatgatcacggctcactgcagcctcaatatcccaggtgcaagtcatcctcctgcctcagccttccaagtagctgggaccacaggcctgcaccaccatgcctggctaattttttatttttagtagcaacaaggcctcactgtattgcccaggctggccttgaactcctggcctcaagcattcctcccaccttggccttgcaaattgttggaactacaggtgtcagccactgcacccggcccctgtctggttctgttgtgtactgcactcaccacctccttcacctgggatacgttgggctggcaggagctggatgcaaggagatggagcgatggaaagctgaaagagggtagactgcctcttggggtccagtgtgaagttcacggcagaatcaggactggtacttccttctcccaaccaggtccaagaccctcattctagagtagggtcacgggggagaggggaatgttgctttgacaggggtcctggggtcagtatttggagtaagtatgccttggtggggtcctcatttggatgtaattactctgatctgtgctttttatttttatttatttatttatttatttatttatttatttatttatttttttgagacagagtcttgctctgtcgcccaggctggagtgcagtggtgtgatctcagctcactacaacctccgtgtcacaggttcaagcgattctcctgcctcagcctcctgagtagctgggattacagtcgcctcccacgacacccggctgattttgtatctttagtagagatggggtttcgccatgtttgtcaggctggtctcaaactcctcactcaggtgacctgccagcctcagcctcccaaagtgctgggattaacaggcgtgagccactgcacctgggcaatttttgtatttttagtagagacagggtttcaccatattggccaggctggtttcaaactcctgacctcaagtgatcctcccacctcagcctccctaagtgctgggattacaggtgatctgtgctttatcaacctgctttgttacttttcggtctctcctatccatctgaccaaacctgggcatgagaagggagtatgactcaggacatgatgcactgttgggacacaccaagctcagtgtcccctccgggtcactggctcaatatcctctcacaacaggctggtttacaacaaaacatccagggccacccagtttcctgatggtgtggatgtacgtgtccctggctttgggaagaccttctcactggagttcctggaccccagcaaaagcagcgtgggtatgtagcccttactcaaggcctccgggagctgggatggggtttctgccggactggagctggagctggaggaactctgctggtttgtagggacagcctgtgagctgtctctgatcagcgtgggcacagagccctgtagcattcttccaaggacctgctagctgtcacagtctccatgctgggcatagtgtaggtggccggcactagctgtatcttttcttatcctctgtatttctgtctacaggttcctatttccacaccatggtggagagccttgtgggctggggctacacacggggtgaggatgtccgaggggctccctatgactggcgccgagccccaagtaagcaggcactctcattccctccctgacgtctcgggaggtaggggtgaggtgatcatgggcaccacagaccttgggctctccccttgtccttggctgtctcctgtccctgggcctctggcatccagtctagtggtcacagccaccacctttggtcagtcttatcctgtcctccatttcccaccctgggacctctgggcctgtgagccctggggagaaatataaggcttcctcccttcatggaaggcggggggacccagaccgctctgtttgaatgtgagcaccctcccctccccctctcgtcttgtgtctggcctgagaaaagctcagtggttccggctccaggacccttcccacctgacccctgcctggctctggcctgcagatgaaaacgggccctacttcctggccctccgcgagatgatcgaggagatgtaccagctgtatgggggccccgtggtgctggttgcccacagtatgggcaacatgtacacgctctactttctgcagcggcagccgcaggcctggaaggacaagtatatccgggccttcgtgtcactgggtgcgccctgggggggcgtggccaagaccctgcgcgtcctggcttcaggtaagaccctacctggcccagcgtggggggctgttgccaggaattctgccctctcttcccttcctaagtgtcctcctgggccagcatgcctcgtgtctgtcccacggtgtgtggggtctatgcaaatctacccctaaaagtccaaagaagaaagaggctgacaaatctagtttctcagagaaaagcatttaatagggacatacgaatagaagccacatctgtgtctcaggtgggggcaagacaagatggtggatccccacactattagcccccagacccagagcttatattctgtagggaaagggcgactccgatgcgatgtgttgaacattgaaggatgataacacagaggctgttttgatttatggttaagtacgtgcacaagaaacagtagataaagtggaaatctcagtggccttcctggatctggggttaatcagaagccaacatggtggattagtatccaaaatggagttgctttggtctccacaatgactattctcttgggtcagccctgttttttttttaatttttattttttgagacagagtctggttctgtcacccagactggaatgcagtggtgcaatcttgtctcactgcaacctctgcctcccgggttcaagcgattctgcctcagcctcctgagtagctgggattacaggtgcccgccaccatgcctggctaagttttgtgttttagtagagatgaggtttcatcatgttggccaggctggtcttgaactcctgacctcagatgttccactcgcttcggcctcccaaagtgctgggattacaagtgtgagccactgtgcctggccatccctccctcttaccccatccttacttcttcatccccaccttcaccgcagaggaggaaggctagagcattttttttttttttttggaggcagggtctttctcactctgccatccaggttggagtgcagtagcgtgattttggttcatgcaacctccaccttccaggttcaagtgattctcctgcctcagcctcccgggtaactgggactacaggcgcgtaccaccacacccggctaatttttgtatttttagtagagactgggtttcactatgttggccgggctagtctctaactcctgacctcaagtcaggaggatctgcctgcctcagcctcccaaagtgctgggattacaagcatgaaccaccgcacccggccagatttttttgtatttttagtagagatggggtttcaccattttggtcaggctggtcttgaactcctgacctcaaatgatctgcccaccttgacctcccaaagttctgggattacaaggatgagccactgcacctggcctctagactacagttttttatttatgagttgcgcctccatctgtgggcagcacggagcctctgtaggcaacacagggaggaagcaggtgcagatctggctgggcctgcttgcctggcaattgggaaagccaccccttttatggctcctcccccgtcttttcatgactgttgcagctcaccagctgcagctgtagagtagagcttcttcctctagaagggagctttcctccctctgctaggacttgggggaggcttatggaccctcactttgggagctatgagccagggctgtgccaagcatctcatgagctcaagtgcctgccactgcttgacctgcttggtctactggcattgtgattgggtcaggcccagtgactctgagttggctggaagacactcagatttagtgaggactcattatagccaccacttcggtctagcctgggcctggagggacggatgtgggcataccctgagtttagacaggtagccccggcccctttcagagtttctctgtgagtccccttagagctttgtttcaaaggctgggaagctgttctgtcctgccttggcagtccaggactgggtgtgtggtgcggggaggtggaagtccgtgcacccctaggggctttccttgcctcaggggtcccccagccaggccacagcaggcagagctgaggccctacagtcagtctgagaggcctccctgctttcagatacagggtggggtgatgggtgaccatggatcctgaacaggccagaggcccctgttcccaagttgcagcttttacttcctggaggcctccctgactgccgggtgtttgtgttgttcacattcctgtgtatagggactccgcctccatctgcagcctcccctcgtgccctgtctccagcacgcctggctgcccaggtcagcgcacatgcaagtgggtggaatgaggccacggctggctgaacgctggtctgagcttaggaaaagaaaaactggtacacagttcagtgtcataaaagggaaagcagaacatgtcatctccgagttgccaacctgctgactcactttagactaggtcagtgcccacaggcctgatcagcacttggaggatggtagagtttacaggcaaggaagcatcataaatcaccctgtgggtatgtgccgccttactccctggtgaggaaagcaaaaaaaacaaaacatagcttggatgtgtggttcccagatgtagcaaaaataaagagaaacaataaaagccaaggcaagcaaactgggcaacatagcaagaccccatctgtataaaaagtggaaacatttttagcccaggcgtggtgggacgtgcttgtagttccagctatgcaggaggctgacataggaggatcacttgaacccaggaggtggaggttgtagtgagccaagactgtaccactgcactccagcctgggtgacagaatgagaccctacttcaaaaaaaaaaaaaaggaaaaatttgccaggcatgaggcatggtggcgcatacctgtagtcccagctactccaaaggctgaggcgggaggattggttgagcctgagaggttgaggctgctgtgagccgtgatcatgccattatactccagcctgggcaacagagtgagaccctgtctcaaaaagaaaaaaaaagagccaaggcagggatgggagtcacagtgattacaatgatgataaccgggtagagatgcgggactgtggactgggcccctggctggggtctggcaggggcctggtggtgaacatgctgcccaaccagctggcattcctaagcacagactgaccagagccttctccctgcaggagacaacaaccggatcccagtcatcgggcccctgaagatccgggagcagcagcggtcagctgtctccaccagctggctgctgccctacaactacacatggtcacctgagaaggtgttcgtgcagacacccacaatcaactacacactgcgggactaccgcaagttcttccaggacatcggctttgaagatggctggctcatgcggcaggacacagaagggctggtggaagccacgatgccacctggcgtgcagctgcactgcctctatggtactggcgtccccacaccagactccttctactatgagagcttccctgaccgtgaccctaaaatctgctttggtgacggcgatggtactgtgaacttgaagagtgccctgcagtgccaggcctggcagagccgccaggagcaccaagtgttgctgcaggagctgccaggcagcgagcacatcgagatgctggccaacgccaccaccctggcctatctgaaacgtgtgctccttgggccctgactcctgtgccacaggactcctgtggctcggccgtggacctgctgttggcctctggggctgtcatggcccacgcgttttgcaaagtttgtgactcaccattcaaggccccgagtcttggactgtgaagcatctgccatggggaagtgctgtttgttatcctttctctgtggcagtgaagaaggaagaaatgagagtctagactcaagggacactggatggcaagaatgctgctgatggtggaactgctgtgaccttaggactggctccacagggtggactggctgggccctggtcccagtccctgcctggggccatgtgtcccccctattcctgtgggcttttcatacttgcctactgggccctggccccgcagccttcctatgagggatgttactgggctgtggtcctgtacccagaggtcccagggatcggctcctggcccctcgggtgacccttcccacacaccagccacagataggcctgccactggtcatgggtagctagagctgctggcttccctgtggcttagctggtggccagcctgactggcttcctgggcgagcctagtagctcctgcaggcaggggcagtttgttgcgttcttcgtggttcccaggccctgggacatctcactccactcctacctcccttaccaccaggagcattcaagctctggattgggcagcagatgtgcccccagtcccgcaggctgtgttccaggggccctgatttcctcggatgtgctattggccccaggactgaagctgcctcccttcaccctgggactgtggttccaaggatgagagcaggggttggagccatggccttctgggaacctatggagaaagggaatccaaggaagcagccaaggctgctcgcagcttccctgagctgcacctcttgctaaccccaccatcacactgccaccctgccctagggtctcactagtaccaagtgggtcagcacagggctgaggatggggctcctatccaccctggccagcacccagcttagtgctgggactagcccagaaacttgaatgggaccctgagagagccaggggtcccctgaggcccccctaggggctttctgtctgccccagggtgctccatggatctccctgtggcagcaggcatggagagtcagggctgccttcatggcagtaggctctaagtgggtgactggccacaggccgagaaaagggtacagcctctaggtggggttcccaaagacgccttcacgctggactgagctgctctcccacagggtttctgtgcagctggattttctctgttgcatacatgcctggcatctgtctccccttgttcctgagtggccccacatggggctctgagcaggctgtatctggattctggcaataaaagtactctggatgctgtaa

SEQ ID NO: 1748 - DNA, 5404 bp, Homo sapiens
tttcaatatcacacaggggcctcagccccatttatttgcacagccaggggttcctgccacaaacagcagttttcgattatcagtagctgtttccctctagcctgggcaggggctgagagagacacacacagaaatatgatatttcagactcctttgagatctgaagaaatcatttcctcctttcttgccatctccataagaccacctctggaagtatgctatgctcaacttatactcacacatacagatttgctcataggttgaacagtgaagtttaagtaaaacccattgcacagactgttcctttcatcacagacacaaagaaggtgagagtaagatgctatcaaggaactagccaatcttggaccaagcgtacatgctcccttccttcttactccatggaagagactgctccatgggcctctcctggacctgttgccacggggagatttaggaggccatccaaggagtgactgagccttggccctcttccatggctacaggaatattgttcctgcaggtactatccagatttcagctctagatgtaactgaaaaaacctgaaactctgaggaaaggaatctaaggcttatagtgcttgagtactgatggggaacaactgcagcgaacagcaccagggaagctggaggatgctcagtaggtgaatcgcatcttttgtgagtagcccagtttgtccaagttgggatggcaggccagctgcaccattgggggtggcccacaaagcagtaccagcacatcatcccctggagcgggcaggtgttcccggatcatgtcggcagtcacaaagcccttgctgtaggcccaatctgaagtatggggagaagaaagtacttaatactccagatacatgctggcaagggggtgtggtgccatgagactggggagggccctgaaaggctctggagaaagtgtcaagtggtagcagcagctgggaatgggtatactcagcctgcctcaagctgagccttagcagcaccgccatccctgtcacccacctggtaaacaggaacccaaaggaaagggaccaggagatcactgtgtctgtgcactcagacttccgagttggcagtgtgaggcaaggttgatttcaatgaagccagaattcacaaaggggcaaggctttgattttgacgatgaggggatagtgggatgtccagaaatgggaaggataccttttgggggatgatccagagtgaaccagagcttaaagcgattgggatagcgggcctgcagttcctctaagtcctcccgcaagatgatatccttttctgtctgaaatgcaaaggggaaggaaagtctttaggagtcttctcaggcccacataaaaagttttctgctatacaactttccaactaagaaaaagaatgttaagggaaagcaaaagttctaggaaataagcaagacttgcagtgcttttagggagttaggatgaggagaagaggggaacagcctttatctacacattatgaaggaacaaagatgaatatttaaccaagaagatctaagtttctgtgctccagactagataccttaaaagttttcttctttccttggggaccagggaaggaatttgattcagtgctctgtccttttcctccttattgaaagaggaccctgtgccttacagaggggaccttgggcagaggctaaaacagggcactgggccagttctgcccatccataccacgtctctcagccctacccacacagcaactttgaagtcttagggtggaggaaaacaaaccaacctggttggcaaaaagcagaaagcactgggttggatcttcagggactttcaggatggcccggatcagctgtagcattggggtgattcctgcatgaagataccccacagtgaaatgtagtggccacactctctgccctgtcctggctccttagctgaccagccctttcatcttcattctgctcattcaccactccactccattttcctttagcattctcatcctctaaactcttcctgcatattctccaacatctgtatttccgggcacccttcaaattcatctaagttcatattgtagaaatctttcttaggaactaatctaagactcttctgaaagtcctttggaggctaggactccagtgtcacaaatgactacaagtacctccggattcaatgatgagggttctagaacactgtatttgcagaggttaagtgcatgtacttaggcactaggcagagccaaatactaattttgctccaggccattaccagtgaaataaccctgtggaaatcatttagcctctctggaaccccattgtctctctgtaaaaggaaaaggctagtacctacttcatagatacctatatatgtgtctaatttttgtgtctaatatatagtagtgtattagactacacagtgtctaatgcacagtagtgtccaatgctaattttctttcttcctagctagtcattcctagctgcttctctcttctctcacctaaaactattagatccattcaaaatgaggaaagctcatttaatttgtttctctaattccatcagttaaaattttttttggtttctacctgcttatgattttgtttttcagatactagggagttctaagcattgctggaaatcccctgatgaacaacagcttggctatggttaccagtcttcagagggtcacctaggaatttgcatggcaacagtcaacaatggtgggagagaaaggccctcagtgtaatgcacctgtcccgccggcaatcattcccagtttcttcgccactcggggttctggtggagatttcttgttgggctgaatgttaaaatgccctgagaggtcaggtgaagagagcagtggaagaataaagtcaatacagcgaacttagaaaacaaatgcagagttgaaaatatgcctgaggccagttgagcagctgctatgacatctgatcctggagcttgggtggaagcttgagttgagccagccctgacaataatatagttgagggacaatggggccagggctatctgtgagtcagttcagcgccacacaatgtatcagctgcttctggcaaagtgtcactccctggtgaaggagacaggcacagagccaggtgtgaatctattttcccaagtggcacacagcagctccagggacttgctaatgcacccagctgttcccatgggaagggctgaaagctatctctggctcactccacagctcacccaggggggcaaatttttgaaggtggggaagaggggcacatgtttgctttagtaatctccacagctgccatggctagggaattcaagtggaggaggaactgcttcctgtggcaaatggggctgagaaacatgcctttctattgtatcagcgctatgtttagaaggaagggcggccctggcccttacgtgcatacacatgtgtacacacagccatactgtgccaagaggactatgggaactgataaagtgggagacaggctcaaggagaagacaggtcattaccttttccagtgtaagtgagcaacccgcttggcccccgaaactccaccacatccccaaccttcaggctatccaggtactgagacatcttccctccctcaggaaatttggggtgcacacccttcaggtagaccttacaagacagagagaaaaataccttatttggaatgtcactggtttctgagccccatgttgactaaacctccctgaggctggggcagggatcagatatgtgctatcttttccccgtctacatactttctttctttcttttttttttttgagtcagagttttgctcttgctgcccaggcttgagtgcagtggcgcaatcttggctcactgcaacctccgcctcctgggttcaagtgagtctcctgcctcagtctcctgagtagctcatactttcttcacatccacagagtacataccatttcctgctgtcaggcaaatcttagaaatttctacaaatcccagaaagaatgggtaagcagcccctgggtcccttcctagccccttaccttgatgacaagatccacatagccttgatcctcatcactggtgacaggagtgtatggcctgatgaccaggctgccatcaattcgggtggagaggtagatatgtttgcctggggaccgtgcagagagctacataagggttgtctgtgatgtgctgcatccctcaaaatactcaaagagatttgagagaacaagatgtcttgcttcctgctgtggtcccaaggagctacaaggcagggaagatttgccccattgagccctcagttggatctcttataagcgcccagttgaggaaacacttatttccagcgtttcctgccagttactgccaggaccttgacagatgagccaaaagggtctgggcaatgggaaaaagttagtagtgcttgctcagagggagtaattagcaaatcctgcagggaagaggcaagactgttgagtgttaaagctggatgggggtcatggaagccacactctagaggggcccagtggcacctcacagcttggaggatgcagagccaagtgggggaaggggaatggtgtgtggagcaaaccggttgaagcagcgtgtttcatgagatcccaggaggggagtcaccttctgaggataccagggaaaggagcccattccacactttccttacccacaggcagccccagagtgtggtgggcggtgggcagggcaaagcggaacctcttggtgttgtggctcacagtctggagggtggaggacacaagtgtttcaccaagcgcgcctggcgctgccacgtcccttggacatcccaaccaccgtgggtgctgtaccctccatgccaggagcactctggtcccctccttcaccctggccctttcttccccaacttaccgtcttgtctagcagtcgtagcaggtacttttcattggggtccaggagagtgacctgaggccggcgggacctccgaaccaagtaggagcccacagccaggccgagcagagtgaccagccccacccccagggaggccagcaggacggggctctgtgggtagaggaggcagcgtgaccgccaggctgggtaagagcccggggcttgggtggtgaccgtcccaggggtggcgatcccgagctccagcgcggaggcatgccaagggcagaggggtaacctggcggagtcccgagcccggatgtgcgggatcgggaccccagcatccacggtgggcccagagccctgcggggcggggtcggcagcgacagcccctggtccggagctgagtggccagaaccagatggggaggggtcccccagtggaggatactgaatgagggtcttaccgtctggatccccatgacggagcgccttttcctccaccacctgacaagccgacagatcccacaatgcgccgcggggcgggtcggag

SEQ ID NO: 1749 - DNA, 6172 bp, Homo sapiens
atggaaggacttcagataccatcttattctagagacgtagctgaccaaaaagtaggggaggggctgggtctgcaaattaataaatagaagagggggtaagaccttcctgggaccgcagccgctcagtcctcgttcttctcatgcatgaaggcatccatcttctgggcaaaggtttcagccacaagcagggggaagaccagggaggcgtcagcatagacctgggtaggggggaacctgggtaagccatgggacccacactcatcgtcccagagaccctatgccccacccagccagcgcttaccttgacgggctgtgcatccacccggatcttgccccaggagacagcctcgtctggtcgggcacctgagtcagagccatcaaactcctgggctgtgttgatgtaaacagcgtagtcggccccgttccgctgtggggaggcgggggcacggtgggcccagtcagccagtcacaggagacagacacagagggaggacaccgtagccaaacaggctgagaggtgtgtcccagatgaaggaagcccttcacagacattcgctcccagacagggcccatgtcaatgtctggggtcactagagctgctgggcaacgatggctgtgtttccccagacccaacagccaggtgtcaacaaccctgccccatctgcaaggcaggagctgccagcaactctatcttcagaagccctccaaatccaaccaccgcctgcctcctgatccctgcatggtcaccactgtcctggactggagttctcactcacctgccaccatctgttcaccacatggccaccagggggagcatgggaacccgagtcaagtcctctcccacttctctcagtgcaaaagccaaagccccgcctcagcccacagggcccagcaggctccctgtggcacctccctgcatcacctcctggccctcaccactccaccttcccctcaccaggtacccagctgttcctggattacttcaggcgccccagagcctttgcaatggctgttccctctcctgggaactttgcaatccagaagctcaatgctagtacagcagcacaaactcctggcacgggagacaaccacatagctcctgggagatgcctccccaaacccctgctcccagctcacacttccagaagcctccttccaaaacctcttgttggacagcacccctttctcttctcatgccatcatttagtattccccgtagcaatgactgccccctgacgtggatgtcacttgtttgctatctcccctactagaacatcagtcccggggagcagggatcctggcctgtctagttcatgctgtctacccagcacatggcataggcccaccacacagcatgtctgcagagtgggccgaagcgccacccccactcaccatgaggttggcattggcaatgtggtgcttgaccacgcccccgcccagaatgatcatcccagtgcacttggcaaagatggcctgtgtgttgatgagcctcaggtctgggggaagagcgccgaagtcaggccttggactcagccagccctccttcccctctcctctgtggccctagcgcctcaccctcaacgatgtccaggaccaggcccgggttcttgtaggaatggaagaagatcatgtcgcccagcgagccgtctgtaagtgcgggactaaacacagggatgtggttctgcagagaacatgacaggacagtggctggagctcagagcctcgtctccatgctggctatatgactatctgactgtggatggggtgcctaatttctctaggactgtttcctcaattataagcataacagaaacacctctcacagatgaggcctatatgagaaaacccacagaaaacacttagtatagtgcctggcacataaagaaccagcctattcttagcttgctgagctgtttctctctctttttttttattccctgagacggagtttcactcgttgcccaggctggagtgcaatggcactatctcagctcactgcaacctctgcctcctgggttccagtgattctcctgcttcagcctcccgagtagctaggattacaggcgcatgccactatgcccagctaattttgcattttgtttttttagtagagacagggttccaccatgttggccaggctggtcttgaactcctgacttcaggtgatccacccgcctcagcccccaaagtactgggattacaagcatgagccaccgtgcccggccgtctaattcttttttaaagagccagcttgtggccgggcgcggtggctcacgcttgtaatcccagcactttgggaggccgaggcgggtggatcacctgaggtcaggagctcgacaccagcctgaccaacatggagaaaccctgcctctactaaaaatacaaaattagccaggggtggtggcacatgcctataatcccagctacttgggaacttgatgctgaggcaggagaattgcttgaacccaggaggtagaggttgctgtgagccaagattgcgccattggactctggcctgggtaacaagagcaaaactccgtctcaaaaaaaaaaaaagagccagcttgtgcaacatggtgagttcccatctctacaaaaacaattagccaggcatggtggcacgcacctgtagtcccagctactcagcaggctgaggcaggagaatcgactgagcccagaagctcaagacagcagtgagccattattgtgccattgcactccagcctgggaaacagaatgagaccctgtctcgtaaaaaagaaagagtaagtaggctgggtgtggtggctcacccctgtaatcccagcactttgggaggccaaggcgggtggatcacttgaggtcaggagttcaagaccagcctggccaacatggtgaaaccccatctgtagaaaaatacaaaaattggccgggcatgatggtgggtgcctatagtcccagctactcaggagggtgaggcgggagaatcacttgaacctgggaggtggagggtgcagtgagctgaaatcacaccattacactccagcctgggcgacagagcaagactctgtctcaaaaaaaaaaaaaaaaaaaaaaagactatgtagctttttttttttttttttcaggttctgattctctaattaaagggagtgggtagctcttattttatagcatctgggagtgtgggaccctgagccaggccccaggagagttgctaagtgttgcctctactgttccagagatagtctgggaggagcataaggatgctgaggccccactagttatctgtgtgacttcagacaaaattacctagcctggctgggcacagtggctcacgcctgtaatcccagcactttgggaggccaaggtgggaggactgcctgacgccaggagttcaagaccagcctgggaaacacagggagacccccatctctacaaaaaatttttaaaattagctgggcatgatggcatgtgcctgtggtcccagctactcgagaggctgaggtgggaggactgcttggccccaggaggttgaggctgcaatgagctgtgatcacaccactgcactccagcctaggtgacagagcaagatcctgtctcaaaaaaaaaaaaaattaccacgcctatctgtgtttgagtctcctcatctaagagtgaggatgctgagaataacagtactgaatccccaggaggctggaaagatgaaataagttaacacatgccaaagtctggctactttgctcccgcttaggtcctcaccttctgggcccagtaatacacggactctgggttgttgatctccttgcccagccgggcgatcatcttagaaggcgtccactttacaccctaggagaggatgtgaccttcaggccatgcctcccctgactcccactgaactggcccctccaggttgccccagccccacctctgtgttctgctccatcaccatctggtccagaatgggcatcagccagtcctcaaacttgcagtaattctcattgggcaccagcaggtttccgatcctgagaacaggaggcatgtaggcatcaggccccaggacccttggtccagctcccctgcccaacaccactcagggttctcacctattgatcccgttctcccggagctccttccccctgaggctaaactcgcccaagtatgtgggcgccaggcacttgatgaggtcttcctccacgccgccagctgtggtcaccaatacgtccacctgcagccacaaggcagtgaatttggcccaagaaggaagcccctgccctcattctgggcagaacttctaacctcatccttgtccagtgactcttatgagggagctctgctacaaaacaaaacttgattctattcctctgcttataacagacccctatctgcccatctcacttaaacgatcaataactgcattgcccattgacccagaggccaaggccacggcctcaccaggtccccaccatgttgtgctgcacaaggtagcgaatggtctcacggatgcctgaactgatgaggttggatgtatatcccaggaaaatggtgcagctggtaagtgggcggcggctctgggtcaggtccgcgtgctggtcttcatcctgtgacagtggttccagcttcttctcgatctgtgagtaagggccaagtcaagttaagcactggccttaaatcccagactcaggactccaggtgggctccagaaacagatttcaccccaggccctgcacattcagggatacaggaccagttctacaggggaccaaggaacatctcctgtgtaaactctgccccttcccagaccagatctcaagacacacgttcaggatttgcccccacccttttttttttttttttggacggagtttcactcttgttacccaggctagagtgcaatggcgcgatctcggctcactgcaagctccacctcccgggttcaagcgattctcctgcctcagcctcccgagtagctgggactacaggcgcgcaccaccatgcccggctaattttttgcattttagtagagacggggtttctccatgttggtcaggctggtctcgaactcccgacctcaggtgatccgcccgcctcggcctcccaaaatgctgagattacaggcatgagccaccgtgcccggcctttttttttttttttttttgagacagagtatcgctctgtcaccaggctggagtgcagtggcgcaatctcagctcactgcaacctccacctcgcgggttcaagcgattctcctgcctcagcctcccgagtagctgggactacaggcgcgcaacaccatgcccggctaattttttgcattttagtagagacagggtttcaccatgttggccaggcttgtctcgaactcctcttctcttgatccacccgcctcggcttcccaaaatgctgggattataggcatgcgccaccgcgcccagccagcccccacccttttaggaatcagagagcatctcctttcagatccggtcccttccccgctgggaaaagcaaatctaaattcaagaaccgcccagacttaggctcctcctcccatatcctcccttaatttgtcttgccccaggctccgcccattccagaaagctttaaatgtacctagaacccgcccccacaccaagaatcagtcctcgcctcctcaggttaccgtaccagcatgtaactaccagagtgcaaaatccccttcccaggacagaaactcccgcccagaataggtcccgccttcctccaactattgggcaactcaaataaaagacatatcccctccactggaaacgctgcccccgtctagtaccgcgttggttctacaagccacgcccctccgcgtccctagaaattccgcccggtcctcaccatggcattgacttgctgtacagcgcgcccgaagttggttgcttggaagccggtggtgccgaaggcctccagcagtgcgcggtaattcacaccgcggttgaagtcgtagccccggacctgggtgctttcgggcggcaacgtcgagctgtgctttagcacggcggccagcgcccccgctggcgcctcccgttccagggaaccttccatgcgcctatagccggctctcgagtcaaagctgcccctaggccgggcttacggcggcccagaaacgcgttaaaccccgacgcgcgcgtctccgcaagagcacaggaagtagggaacgtgcttt

SEQ ID NO: 1750 - DNA, 6172 bp, Homo sapiens; identical to SEQ ID NO: 1749

SEQ ID NO: 1751 - DNA, 5496 bp, Homo sapiens
atggaaggacttcagataccatcttattctagagacgtagctgaccaaaaagtaggggaggggctgggtctgcaaattaataaatagaagagggggtaagaccttcctgggaccgcagccgctcagtcctcgttcttctcatgcatgaaggcatccatcttctgggcaaaggtttcagccacaagcagggggaagaccagggaggcgtcagcatagacctgggtaggggggaacctgggtaagccatgggacccacactcatcgtcccagagaccctatgccccacccagccagcgcttaccttgacgggctgtgcatccacccggatcttgccccaggagacagcctcgtctggtcgggcacctgagtcagagccatcaaactcctgggctgtgttgatgtaaacagcgtagtcggccccgttccgctgtggggaggcgggggcacggtgggcccagtcagccagtcacaggagacagacacagagggaggacaccgtagccaaacaggctgagaggtgtgtcccagatgaaggaagcccttcacagacattcgctcccagacagggcccatgtcaatgtctggggtcactagagctgctgggcaacgatggctgtgtttccccagacccaacagccaggtgtcaacaaccctgccccatctgcaaggcaggagctgccagcaactctatcttcagaagccctccaaatccaaccaccgcctgcctcctgatccctgcatggtcaccactgtcctggactggagttctcactcacctgccaccatctgttcaccacatggccaccagggggagcatgggaacccgagtcaagtcctctcccacttctctcagtgcaaaagccaaagccccgcctcagcccacagggcccagcaggctccctgtggcacctccctgcatcacctcctggccctcaccactccaccttcccctcaccaggtacccagctgttcctggattacttcaggcgccccagagcctttgcaatggctgttccctctcctgggaactttgcaatccagaagctcaatgctagtacagcagcacaaactcctggcacgggagacaaccacatagctcctgggagatgcctccccaaacccctgctcccagctcacacttccagaagcctccttccaaaacctcttgttggacagcacccctttctcttctcatgccatcatttagtattccccgtagcaatgactgccccctgacgtggatgtcacttgtttgctatctcccctactagaacatcagtcccggggagcagggatcctggcctgtctagttcatgctgtctacccagcacatggcataggcccaccacacagcatgtctgcagagtgggccgaagcgccacccccactcaccatgaggttggcattggcaatgtggtgcttgaccacgcccccgcccagaatgatcatcccagtgcacttggcaaagatggcctgtgtgttgatgagcctcaggtctgggggaagagcgccgaagtcaggccttggactcagccagccctccttcccctctcctctgtggccctagcgcctcaccctcaacgatgtccaggaccaggcccgggttcttgtaggaatggaagaagatcatgtcgcccagcgagccgtctgtaagtgcgggactaaacacagggatgtggttctgcagagaacatgacaggacagtggctggagctcagagcctcgtctccatgctggctatatgactatctgactgtggatggggtgcctaatttctctaggactgtttcctcaattataagcataacagaaacacctctcacagatgaggcctatatgagaaaacccacagaaaacacttagtatagtgcctggcacataaagaaccagcctattcttagcttgctgagctgtttctctctctttttttttattccctgagacggagtttcactcgttgcccaggctggagtgcaatggcactatctcagctcactgcaacctctgcctcctgggttccagtgattctcctgcttcagcctcccgagtagctaggattacaggcgcatgccactatgcccagctaattttgcattttgtttttttagtagagacagggttccaccatgttggccaggctggtcttgaactcctgacttcaggtgatccacccgcctcagcccccaaagtactgggattacaagcatgagccaccgtgcccggccgtctaattcttttttaaagagccagcttgtggccgggcgcggtggctcacgcttgtaatcccagcactttgggaggccgaggcgggtggatcacctgaggtcaggagctcgacaccagcctgaccaacatggagaaaccctgcctctactaaaaatacaaaattagccaggggtggtggcacatgcctataatcccagctacttgggaacttgatgctgaggcaggagaattgcttgaacccaggaggtagaggttgctgtgagccaagattgcgccattggactctggcctgggtaacaagagcaaaactccgtctcaaaaaaaaaaaaagagccagcttgtgcaacatggtgagttcccatctctacaaaaacaattagccaggcatggtggcacgcacctgtagtcccagctactcagcaggctgaggcaggagaatcgactgagcccagaagctcaagacagcagtgagccattattgtgccattgcactccagcctgggaaacagaatgagaccctgtctcgtaaaaaagaaagagtaagtaggctgggtgtggtggctcacccctgtaatcccagcactttgggaggccaaggcgggtggatcacttgaggtcaggagttcaagaccagcctggccaacatggtgaaaccccatctgtagaaaaatacaaaaattggccgggcatgatggtgggtgcctatagtcccagctactcaggagggtgaggcgggagaatcacttgaacctgggaggtggagggtgcagtgagctgaaatcacaccattacactccagcctgggcgacagagcaagactctgtctcaaaaaaaaaaaaaaaaaaaaaaagactatgtagctttttttttttttttttcaggttctgattctctaattaaagggagtgggtagctcttattttatagcatctgggagtgtgggaccctgagccaggccccaggagagttgctaagtgttgcctctactgttccagagatagtctgggaggagcataaggatgctgaggccccactagttatctgtgtgacttcagacaaaattacctagcctggctgggcacagtggctcacgcctgtaatcccagcactttgggaggccaaggtgggaggactgcctgacgccaggagttcaagaccagcctgggaaacacagggagacccccatctctacaaaaaatttttaaaattagctgggcatgatggcatgtgcctgtggtcccagctactcgagaggctgaggtgggaggactgcttggccccaggaggttgaggctgcaatgagctgtgatcacaccactgcactccagcctaggtgacagagcaagatcctgtctcaaaaaaaaaaaaaattaccacgcctatctgtgtttgagtctcctcatctaagagtgaggatgctgagaataacagtactgaatccccaggaggctggaaagatgaaataagttaacacatgccaaagtctggctactttgctcccgcttaggtcctcaccttctgggcccagtaatacacggactctgggttgttgatctccttgcccagccgggcgatcatcttagaaggcgtccactttacaccctaggagaggatgtgaccttcaggccatgcctcccctgactcccactgaactggcccctccaggttgccccagccccacctctgtgttctgctccatcaccatctggtccagaatgggcatcagccagtcctcaaacttgcagtaattctcattgggcaccagcaggtttccgatcctgagaacaggaggcatgtaggcatcaggccccaggacccttggtccagctcccctgcccaacaccactcagggttctcacctattgatcccgttctcccggagctccttccccctgaggctaaactcgcccaagtatgtgggcgccaggcacttgatgaggtcttcctccacgccgccagctgtggtcaccaatacgtccacctgcagccacaaggcagtgaatttggcccaagaaggaagcccctgccctcattctgggcagaacttctaacctcatccttgtccagtgactcttatgagggagctctgctacaaaacaaaacttgattctattcctctgcttataacagacccctatctgcccatctcacttaaacgatcaataactgcattgcccattgacccagaggccaaggccacggcctcaccaggtccccaccatgttgtgctgcacaaggtagcgaatggtctcacggatgcctgaactgatgaggttggatgtatatcccaggaaaatggtgcagctggtaagtgggcggcggctctgggtcaggtccgcgtgctggtcttcatcctgtgacagtggttccagcttcttctcgatctgtgagtaagggccaagtcaagttaagcactggccttaaatcccagactcaggactccaggtgggctccagaaacagatttcaccccaggccctgcacattcagggatacaggaccagttctacaggggaccaaggaacatctcctgtgtaaactctgccccttcccagaccagatctcaagacacacgttcaggatttgcccccacccttttttttttttttttggacggagtttcactcttgttacccaggctagagtgcaatggcgcgatctcggctcactgcaagctccacctcccgggttcaagcgattctcctgcctcagcctcccgagtagctgggactacaggcgcgcaccaccatgcccggctaattttttgcattttagtagagacggggtttctccatgttggtcaggctggtctcgaactcccgacctcaggtgatccgcccgcctcggcctcccaaaatgctgagattacaggcatgagccaccgtgcccggcctttttttttttttttttttgagacagagtatcgctctgtcaccaggctggagtgcagtggcgcaatctcagctcactgcaacctccacctcgcgggttcaagcgattctcctgcctcagcctcccgagtagctgggactacaggcgcgcaacaccatgcccggctaattttttgcattttagtagagacagggtttcaccatgttggccaggcttgtctcgaactcctcttctcttgatccacccgcctcggcttcccaaaatgctgggattataggcatgcgccaccgcgcccagccagcccccacccttttaggaatcagagagcatctcctttcagatccggtcccttccccgctgggaaaagcaaatctaaatt

SEQ ID NO: 1752 - DNA, 6172 bp, Homo sapiens; identical to SEQ ID NO: 1749

SEQ ID NO: 1753 - DNA, 8071 bp, Homo sapiens
gatggagacgctgccaggcttgctgcagcggcccgaccccggggcgcttagcgcagcgcagctggagcagctgcgaaaattcaaggtgggtgcgcccgcgcccccatccagcgtccaccaaagtgtagctgccccaggactggggccccagactgggaagagagccgccgagagaaggggagcgggagcctgttccctgataaagtggggagggcgcaggggagacccccggcggacctctaggcgtctgatcccagcacagagcgcgacgggcatctgagagtgcaggaagaactaactcagggactcggccagagaaatgggccgaaattactgccagacacatccgaccttagtaaaggcccctcatcctgaacaagcggcagaatgatattttatctgtaagaagatgggtggcttaaactttcaagcatcctggggaaagacttgggttaaatgcgcacgccgtttcccgcagcccttcacatctccagggctgaaccctgaatctgtctcctaatggaagtgaccctttgttcttgccccccagattcagactcggattgctaacgaaaagtacctaaggacccacaaagaagtagagtggctcataagtggtttcttcaggtaggtggttttccaggctctgggatttgtggcacgcagggttttcttcgttatctctagaggtttccttcagttatctctaaattcttaaaaatatgtctattcatttactttaaccataaggataaatacataccttatgacacttggaagagggaatttggcgttgcgaaacccaacagccatccactgggtgtagaacactattctcaaccataggagcttaacaaaatcactagttgaacttaaaacaaaaatcagttgtctggttggcccttccctacttgaaaacattactgtagaaaaattccaagggttggaagccactcttttcttggggaagagaagacaatttaccagcgtatcctggaatatgttctttccttcccccaccctcctttcagcctggcatttgcttgaatggaaacatatcctaatgggatgaagaaggagaattaaaaaaataaatcacggagcatcagtggatgaaaacaatagagctatctcaaatgctgtttggttatagacaaatagacaaggtttaaataattataatggcacccatctccaggcattgtgctgttcccctacattagcacttaccacactgtattgtaattgagctgtcaatcttctgttactggtccaaagctccgagcttgtggagtgtgtttgtgttctcagtgcccacgcagtgtgtggcatcttggaacacttttgctgatcctcccagcacctccacaaaagacaggtgattgtcatttttattttataagtgagaaaatttaagcttagaaaggtgaagtaccttcccaaagttgctgaaccaggattcaaacccctggttttcccactgtattgtgctgtaagcagtcggtccccatttcccctctggactgtgtgcttatagccagaggtgggccctcccttgtcttctcaaaagttggcgaggtcaggcaaggtggctcatgcctgtaatcccagcactttgggaggccgaggcgggtggatcacctgaggtcgggagttcgagaccagcctgaccaacatggtgaaaccccgtctctactaaaaatacaaaattagccaggcgtggtggcacatgcctgtaatcccagctacttgagaggctgaggcaggagaatcgcttgaacccaggaggcaaaggttgcagtgagctgggattgctccattgcactctagcctgggcaacaagagcaaaactccatcgcaaacaaacaaaaaaaagttggccaggcagatgcgttggctcacgcctgtgatcccagcactttgggaggctgagaggggtggatcacttgaggccaggagttcgagacctgcctggccaacatgaggaaaccctgtctctactaaaaatacaaaaattagtcaggcgtggtggcacgtgcctgtaatcccagctacctgggagactgaggcaggagaatcgcttaaacctgggaggcagaggttgcagtgagccgagattgcgccactgcactccagcctgggcgacagagcaagattctatctcatgaaataaaaattaaaaaaactcactattcatattatagacgtttctccaagtggcaacaaattctcagagggcagataggggaaggaaacagagaaaactgaaacctatccagttatgaaggttggccagggataagccttgggcaaaagagagtttagggatcctctgtcaatatcagacctgaggatcaggccgtcaccttttgcaacttttcttctaaagggaaataagatgatatcgttcctatcctggggagcttgctctccaagttagtagtagttccagcagagagattggggatagaagttaaaagctgaaactaaatcaacatttgcattgctcacaaacaacaggattagaatgcttggggttgatgaataagaatgagttgtttcagtcacctgtcagagatggccttgattctctctttgtccaggaacagtttccaggagcagcctgggtatctgagactggctgctgtgggaacagccccagatacttcctttcctttcttaccatgttcctgtcaaggccaggtaggccaccaggtttttctttttgctgtccctaaagctactctacctgaaattcttctgacctcttttcctgggtggagcttgcagagggtttagtgtttgaagttttagggtttacttttgtttgtttggtgtcattgttccctttgattggtaccgggatgaaccagaatcagcttctgtccctgctggccacctcacatggtccttcctatgagaaaagaagaagggagaagtgagggcagagtcctgagcaccgtgcctgtccttgtctgttctgcagatatctgctgttgatacattccaagccaaaagaagctctgaagggttctttctgggaagcaaactccccacttgggttttttagatcctaatgatttatggccattcagccacaattctccagcctatattggtaaatacagcgtaccaaactcttaacaccttgagttttggacctgaaaaatggaaagagtaggaatctgacttattttaaggtacacagaaacctcaggttttgtgctgcagatatgatagatagccaggtatgaaattgtagaaagtattttttttttttttgagacggagtctcgctctgtcgcttaggctggagtgcagtggtgcgatctcagctcactgcaacctccgcctcccgtattcacgccattctcctgcctcagcctcctgagtagctaggactataggcacccgccaccacgcccggctaattattttgcatttttttttttttagtagagacggggtttcactgcgttagccaggatggtcttgatctcctgacctcatgatccacctgcctgggcctcccaaagtgctgggattacaggcatgagccaccgcacctcgccttttttttttttttttttttggagacgaagtctcccactgtcatctgggctggagtgcagtggcgcaatatcggctcactgcagcctccacctcctgagttcaagctattctcctgcctccacctcccaagtagctgggattacaggtgcctgccaccaggcccggctaattttttgtatttttagtagagatggggtttcactatgttggccaggctggtctcaaactcctgtcctcgtgatctgcctgcctcggcctcccaaagtgctgggattacaaatacagcagtaatcatgtccttccttggctggaaaaatcttcagtagttccacaacgttgcttttttgggtttgtttttaaaaattctattgaaatatactgaaaagtgacatatcctaagctggatgaactgtcagagggtgaaaatacacatggtactattgttcagatgaagaaatagaaccttaccaacacctcacatcctttgtgcccctcccagtcactccccttaaaacagtagccagtatcctgacttctactagcacggatttattgtgcgcttttgtattttatatgaatggaattttacactatgtgctcttttgtgcctgtttccttttgctcagtcgtatcttgtagatcctccattctcactgctgtataatattccagcatgtgttatgccatgttttgtctatttccattgtctttcagattgagtataaatgtccctccccagcattcaaggctctccgtaatagaacctcttctgtttcccactactccctgcatgcgtccctcactcaagccagaccacatttctgctcattctgctgaccctatggagctcaggcacagatgcctcttgagtgctcttttggactcaagatagaaaggtgtctacaacccacttcctactctcaaggaagtcatagtctatagaacacaaactgtttctctttctgggcctttgctcttgctgtttccctggatctggaatgtttttgtccctcaaccctcatcctgcctactacaatcccatgtgtacttcaagggtcctctcaaatgccagctgctctgtgaagattgttggggtccccctctcagtaacctctctccccactctgatctcccagagcactatttaatactcctctttagcacttgtcagaggttccttggccttttggacatttggaaactaacctcttcctttttacttacctgtaaattatttgaggtagggctatattttattttattttgaaaaaagcagtcactcatatctagtgcaattacttgcacataatttgtgcccaataattatcaaaatgaattgaaggagaaggggggcaaaattcttgaaggttaggaaggaggggcttcttggggagttgggaggccttggccaagagaacatattatagagggcactgaccttggagtcacaagacctgggccctctttacttcatttaccaagtttatgaacttgggcaaatcattaatcttttgaaggcttggtttctttggatgtaaaatgggggcataataatggttgtttcacagggttgttgtaaagtgagacaatatttgtgaacatactttatgaaccataaaactctatgcaatgtaaggcattttcaactctctagtggcattggccctgcaggtgttaccacagtgtctccttgctggactgaggggccaataaccatctgcggtccatcttttagctctgtttattgtatctccctctgccccttgaattcatggttaagcttactcaggacattgtggggctgcatatctcccaccattcgtgggccggccggcatgttcttcatctttgcctcttgcccctggcttgagatctggttcagtgaaaatgatcgttgaggccgggtgccgtggctcacgcctgtaatcccagcactttgggaggccgaagtaggaggatcgcttgagcctgggagttagaaaccagcctgggccacatagtaagactctgccgctacaaaaaaaaattagccatcgcacatgcctgtagtcccagctagtcgagaggctggagatgggaggatctcttgagccagggaggttgatcgcgccactgtactccaggctgggtgacagagcaagacgctgtctcaaataaataaataaatgcacacataaacaagattgttgacggaatgacaagccccacttggctgcagcacagctctttctcgacgtaagcaatatcctagtgtattgccatttaggatgcttcactccttgccttagatacggagttgaaggaaaatcatgaatgaaagggtctttgtcaggagtctgcggatttattgactcccaagatggttgtgtctcaggttcatctgtgaaagtacaggacctgaaacagtagccacagcctgcgttaaagtctactttacctcccatcctatcccttaatgttttccagagaaatatttttgaaaagaccagacaacatcctagaatttgctgcaggtgagtaaggcagcgtcggttttgggtatctgacaaagccagcgcagggagcatgattgtgagtttagacttgaatgagcccaggattctcccagagtctggggtactccttcacctgatgtccccaaagggagcttttttcagctttttctttcctccatcatcatttcctcaaaatgaggacagacaagaaatgaggcagaacttcctcatggtgaggattgttaagaattttgagattcccaaaggaacatagcggcagtttttcccttgggaatcttaaagcagggttctcaaccctagctgtacatcagaatcacctggggagcttttagaactactgatgctcagtccccaccaccagagagttttatttaattagtctggggtggggcccagcatacatagctttaaagactccccaggtgattctaatggactggctgccttaaggtcaacggtatttagagggaaagggatggattggacgatttcttggttcctgttagtcctgagaattggttacatcccagacctcaaaccattgctaacagaatctcaatacgcctttgctagcgcagcagatgctgcctctgattcacagtatgctgggtgtataaaaaccctcatctggcgtcatcctgcgagagcctggctctcctctgagagggtattctcagagaaggcgtgatagctcagagacaggagctggcaagcggagctgagacaagaataatacttggcatttatttgggccccaagatgggcctggagcagaaaacccagagaatccctgagccctctgatggctctctgtgcgtcagcaggcggaggagcaaacggtgcgactcggggtaggtggggggtggggggtggggggtggggccaggcacagcgtggaggggaggcagccagcctctgggagcccttcctgggaatgttggagctggcagaatcagaactgctcgggtgggggcagtgaccgttcattttaccatattacattgtaaagcagggccaccagtagtagcagtcctgcgtaccaagccatcctaactttttggtggagtaagctgtctccttccatgggtaaatcttttccctttgggtatagatgatgtcttctttttgatttttatcccagactacttcacggatccaagacttcccaacaagattcacatgcagctaattaaagacaagaaagcggcttaattagcaaaatcatgatgctcagctgttgggagagaccagacggaatccagcctcggggtgggtgttaacctcacttacagacagaggcttctttactcttgtgaaaataagctctggtttattggtccagggtgtgaaagaaatcaagtggagaatttaaagagaagtttaatgtaaatgtttagtttttcctctactgttttggggaattagggactgtgaagagaggcccagggttgatctgtcatgtcagtagcaggaagcttcttaatgtagtggaatggattaagggaatggaagtggaagtacagtagttcaggggtaaagatggcaacagggaaatggggagggggccattagcatcaatatgatgttcctgctggtggcctttcctgtgtgaccttggtggtgagaggggagacggttccattgcttctggaaggggtgtgagcagtttccctccttgcttcttggattgggcactttcccactcctgcctcatcttcaagccaggctgtgccattaaggccaccacacgtttttcaggcagaatgattcctgaaatgatattgaaagctgggatttaaaaaaaaaatgtgaggtgggaaaaggtcacactcctaatttggtggaaccatttctgttttgcagggtcatctggaggcatgagagccctactgccatcagtgtgggtttccaagctgccttgggctctgtctactgtcgcaaaagcttttaaagatattcattaaacacggaccttcctgctc

SEQ ID NO: 1754 - DNA, 7727 bp, Homo sapiens
gcccaagcaccaacatgtcaggtttatttctccttcgctctcaactgagagcggggcatccaaatcataacaaaaccagggcccaagagtgggaagcggccccctgggtgggcctgaaccccaatttcacccttcccccgggcatagggcccaggccaggacgctcacccgaatgtggctgggactccttgtgccctaggcccacggggcggaggcagcaccaacattggggatggtcccccaagaacagaggaggaagcccagcctccggcaggcagtatccacatccacgcccacctgctcaggcctgcagcctccagacctctagcgacaggtctccagagccggccaccaccaggttgccctcagcacagacctgggaagggggaggaacatgaggagtcagggacgatggcgctctggccagctgggcagggcacatggggcaggaccttaccctattgagcccattgtcatgccttcgggtgcaaatggtccttggtgggtctgtgggcacgtgcacctagtgaggggcaatgggcgaggtcaagaggtgtgcccctggctgatggaggtaggggagaggcagggactgtcctggggtgggggctgggcaggagcctcacccggatggtcttgtcagtggatgtggtgtacaaggctcccacggagtactggatcccagtgatgggaaagctgtggcccacatcaaaggactgcaggaggaggatcaggcaacactcagtcgaggctctcccaaggcccgccctcccccacaccaccaggggctcgggtaggaaggaagcccggggggagggacagtcaggggcaggagctccagcagacccggataagctggaagcagccgttgcggttggcgaagacgtgcagcaggccctggttgtcaccagcccagagctggggttcctggtaggacatgcagagcaggtaggagtccagctacgagagggacaagggacgggacagctcaggccgggctgggcctgcaacagtccccatccctccaggcccctggggagggcccacctgcagacgctgcaggacgctgttggctcggcggtccaccaccaccagggtgtggtcctcgctgcctgagatgatgtgccggtcatccgccagcagggtcagcacgggtctggagtgtagttgctggtgcttcaacagggctgggccggcttcatgggtgatgggccggtgaggagggatatcagagcccctcgaaggccccccccagcccatgagagcatcccgggtctccatcctgtctggcaaaaccctcgatctgctcattcccccaccccacagagtgacccatctctcctctcccgcctcaggtaaatccaggcttccacaggagccccaggcctctgcccatccccgtccacatcccatatccctcctccgatcccatctactgttcttagcacagagctgaccaaggtggtctcagtcttgcatccaccctcaggttggcctgaaacatgcctatcccgcagccccgctccagctctgcctggacaaggtacactggcccttcaattaacaaaagtagaatgaataaataggccaggcacagtggctcacacctgtaatctcagaattttgggaggctgatatgggcagatcatccgagcccaggagttcaagatcaccttgggcaacgtggcaagaccccgttctccatttaaaaaaaagaaaaatggccgggcgcggtggctcacatctgtaatccctgcactttgggaagctgaggtgggtggatcacctgaggtcaggagttcatgaccagcctggccaacatggtgaaaccttgtctctactgcctcagcctctggagtagctgggactacaggtaggcgccaccacatccagcataaaaaaacgtagttaatccaccactgttcctattatcatcttcccccattaaccccatggggctgctgtggtattattatctggatttcaaagatggggaaaccgaggttcaagcttgtctggaggtcacacagctaggcagtgggacagccagaactctaacccgcccccagggctgcccaagcttcaccttcacccgctgcccaagttgcctgtattgtaccagcacagcatggccactctgagtggtgagtatttggttaagtgactatgaccccagccaggctgtgaagccccagtgtctccttccctaacatgacatctcccaacctgggccccaggacccttggcccacctctggggtcgtagatggtcaccttcttgtcataggtgccagtcaccaggatgtcaggcaggtaggagaggcacagcacggctgagctggccctagggacacacagaccacagggctttggctgtggccagacagggtcctatccccgcaggccccctgcccaggcccccacacactttatctcgccgaactgctgcccatccgctgccatgtcccagagcttcactgtgctgtcccaggagccggagcacacgcggtggtcctgcgctgccagtgaccacacccagccctgcaggacaggagcagcagtcacacacctgccacagcccatgggggtcccagactgggatcgttctgtttttgcaggtaaggctcagagaggtcaagagactcacccaaagccacatagctcttcctccccagtgcccatggtgatagatgctgcagcaagtacaacacccaactctggctccaggtgatcacccccattgcatagatgaaaccagagcaagttcaagttgagtacagattaaagtttgtgtccatgggtcagcctgacttcagagtccaggaaaggcacaccccacccagaaactttttttttttggagacggagtttcacttttgtcatccaggctggagtgcagtggcttgatcttggctcactgcaacctctgcctcccgtgttcaagtgattctcctgcctcagcctctctagtagctgggattacacgcttgtgccaccacgcccggctaatttttgtattattagtagagacggggtttcaccatgttggccacgctggtctcaaactcctgaccttaggtgatccgcccgcttcagcctcccaaagtgctgggattacaggcatgtgccactgtgcctggcccaggaactctttttttttttttgagacaaggtcttgctgtgtcatccaggcatgaatgcagtggtgcgatcatggcttattgcagcctccacatcccaggctcaagcaatccttgtaccacagcttcccaaagagctgggactacaggtgcatgccactacactctgctaattttttttttttttttttgagatggagttttgctcctgttgcccaggctggagtgcaatgatacgatctcggctcaccacaacctccgcctcccgagttcaagcaattctcctgcctcagcctccctagtagctgggattacaggcatgtgccaccgcgccagctaattttgtatttttagtagagccggggtttctccatgttggtcaggctggtctcgaactcctgacctcagatgatccgcctgccttagcctcccaaagtgctgggattacaggcgtgagccactgcatccggtcttttttttttttttgagacatagtatcgctctgtcgcccaggctggagtgcagtggcatgatctcggctcactgcaagctccgcctcccgggttcatgccattctcctgcctcggcctcccgagtcgctgggactacaggtgcccacgcaccacgcctggctaattatttggtattttttgtagagtcagggtctcccatgttgcccaggctggtctcgaactcctgggttcaagcaatcctcctgcctcggcctcccaaagtgttaggattacaggcctgagcaactaactgcaccctggcccaataacatttctaagtcaagttctgcaagaactcagcaccagtggtggtttgaagccacatgacaagtgattaagagtgtggcctctactttgtgacctggcaaaccatatcacctccctcagttcattcatcagcaaattgggcagaaaacatcccttgcctcaggagctaatatgcacagggtgctgaatgctgactttttgcccaccaatcccgctgaggagggcaatattgtgtatctcattttacaaatggggaaactgggccccagagaggttgagtttctcactcaaggtcacacagccaggaagcagcacagtgagaatttgaacccagcatcctggccccaagcccaagctctcagctaccggcctgaccaccttagcgactggtggagatgctcctccacagccacctctcacgagatgacagtcatgctcagagttggctgatctccaagggtagtctcataactgctttacactgggcctctcaaggtgtacctgacgtctattgagcacctactgtgtgtcaaagcctgagcttggctgggcaccgtggctcatgcctgtaatcctagcattttggaaggctgagtcaggcagatcacttgaggccaggagtttgagaccagcctggccaacatggcgaaacctcgtctctactaaaggaaaaaaaaaaaaaaaaaaaaaaaaaaaaatatatatatatatatatatatatatatatatacacacacacacacacacacacacacacacacacacacacacacacaaaagaaattagctgggcatggtggcacatgcctataattccagctactcaggaggcaaggttgcagtgagctgagattgtgccactgcactatagcctgagcaacagagtgagattccattaaaaaaaaaaaattagctgggcatggtggcaggcacctgtaatcccagttacttgggaggctgagacaggagaatcacttgaatcccggaggcagaggttgcagtgggccgagatcatgccattgcattccagcctgggtgacagagggagactctgtctcaataaaaatataaataaataaaggccaggtgactcatgcctgtaatcccagcactttgggaggctgaggcgggcagaccacgaggtctggagatcgagaccatcctgaccaacatggtgaaaccctgtctctaccaaaaataaaaaaattagctgggcatggtggtcctagctactcaggaggctgaggcaggagaattgcttaaacctgggaggcagaggttgcagtgagccgagattgcatcactacactccagcctagcaacagagtgagactccatctcaaaaaaaaaaaaaaaaaattagacaggtgtggtggcatgcacctgtagtcccagctactcaggaggctgaggcaggagaaccgcttgaacccgggaagcagaggttgcagtgagctgagatcatgccacactccagcctgggtgacagaacgagactccgtctcaaaaaaaaaaaaaaaaaaagcctgagcttaatgcatgtccacattaatgcataatgcatctccttcatcctcatcctaatcacccactggacagaagtagaaactgaggcacagagaagtcacacatctcactcaaagtcacaccaaggttagaaaagtcagattcaaatctatgcggtcctgtaccaaaacctggggccttaaccaagatgccctactcaggcctcatacctcctatccccacctgactcctcacctcatgggtactatttcgcttagtgcctaaggtcttgatcagaacctggttggactccgtccccagctgccgcaggtcccacaagttgacgttgcgatctcgggagcccgacagacagagtgacccaccctggaaagggagcaaggtgatgttgtcagggccaccctggcccaccctgcctggccccccacagaccccgtctcacctggagcagcagcactgagtcaacggaagccacgtggccttcggccaggcagaagtattcgacccagcgcccatcctctgcccagcgggacaggtgctgctccagcgcaatgcaggctgccggccagtcaaagttcttctctgtgggttaccacgagtagggtgcccagtgggcagggaccctagcacccatgccagctggccaagcccaaccctggcttccagggagcccacactacaccagacttggacagaaccccatggagatccctactcccaccccaagccgacccaggctgtggtcttgggaccacctgcctgcccatttcccaggcaggtctaggactactcactccaatttccagaaattgggaactggggtctcagaactacctctccaggcgccatcccccaacccaaactcagggcagagcagtctcaggatgttgaggtctgacctcaggctcagcatagaagctgggacctcatgactaacccttcctgcctcagccatctgaaccagaccaagggggctgtttctcaaacagtatctggaaaccagggagccttgtcaagatgcagaatgcaagccccagatgcagattctgtgatatggacggggtccaagcatctatgtttattaagctgtttgggagagtctgacctgggggttggatggcaacaccttgagaatcactgatcccggagtgatcctgattcctctctaagcagaatcaaagcttccaggttaagggtatcaaacacccaagctgtaatacatcttggcttaagggcctgaggatccagctgtatcaggatcaacaatatcgattcaaaggtcccaagctgtcttccctcaggaaccaatcaactcagggccaagagccactgtctcacccctaactgggtcaaggctctagggctcaggagttttgacatcaacaggtgctgtctcagcttctaagctggactcagaacctgaggatccttgggctcactttgagccccagcataaactccagagcctaagacttcaagtccctgtgtcaatccccaatcaggggtcagtggcttagtaccacaagaccccaagactgaggatatttggatcctgagtcgtccaggaaccacagccccatgttagggtttcacagcctcaggaccccaagtgcctgactgcctcgtggtccacccagaggtcctcaggggcttcggcaccaccagtaactaccttagcctccagcctgagccaggacagccacgaagcctgcaccagaggctgcatccggaacaccccatgtacctcttccccgccccaagcctgacctgggcgggcgcccccggcccccggtccccggcccccggccccgcgcaccttccaccactgggtagggcgcgcgtacgcggcgtagcgcgcgtagcctccaggtgacatggtcagacacgaggtcgcggagcgcgtggcacacccgcgacaggacgtggagcacgaggcgggcgtccaggtaggagcagatctcgagcagcagctccgggggaaggctcagaaggcccggctcacttacggccgaaaccctggacgcggcccgaggctccgaagcgctcggggacgcggcgggtgtggatagctgcgaggggcgcgagaacgccagcccggattttggcggactgagaacgcgggccacgtaggccttggcctgcgcgtctgggtctgtctctgactctgggtccgagtcatcgtcccaggtgcgggaatcatcgcaccgccctaggggaagctccattgcgaccgggtgggcgctgccggcctcgcgtcttgtctcctaggcagcacgagggcactt

SEQ ID NO: 1755 - DNA, 368881 bp, Homo sapiens
gaacttgacccgttagcagccgcagccatggcggcgcgttcgcctccctcaccgcacccttcgcccccagcgcgacagctgggccccaggtccccacgtgttgggcggggagctgaagtacacgcaatgcgcagcgaggcctcgggttttgccggcgcagcgcgggaggtggtcgcggacgaaagtgataaaatctgggtgggtgaagaagggtcagggggccggcgagggcctgggggggcagctccggctcatgctcccctcctcagcgcgcccatggggtccagacggctagagggcatctcggtagaggaggcgatggtgacccggacgcagctgctggaggaagagctgagcagcctaaaggaggagttggccctgtgtcaggtatcgaggagtctcgcagtccccctttccccaccacagcggggccgggacccgtggggaggcgcgcctttctccctctgccttgggacctaccccgcccagcgacgctccctggcagatgcacaccctgcttcgctcgcggccgggggctggagggacgcggctgcgcccggctccccaaacccgggcccctgcccctttccgaactgcggccagacaggcttcgcctccgcgcccgggtttggttttggtcacttggatactcgcagtcgcatcctctccgcttcccccccaagcccaagttcttggtggtgacggtagctgatacctgccgggggcccaggagtgacatgcagtccactagttgaaatgaacaggaaagtgtaaacacttcggttagagtaaaatccatcgatgaaggagcctgtttttaaaatttcaaacccacacttggctttgtttttacccagtcaaacttaagttgtaaacacagacgagtaacgtttagaaagtctcagagccgggaacttaacaatagatgatgcttggtacttgtttattaaccagctatggtaattccgcggtccttgagtgagaaatcacattttcatgtgatcttgccagtgaaaaacatttgctaaatcaattgcattaaaattactttcctgtttgtagagtttttgtaaggatggacttgactatactcatgttcaaagagattgaattttcctttagttttgcatccttaccatcatctcttttgattttaccagaacctttagatagggttgggagattggatgtgggaaactcactgaacagtagatctttaagtcactctgtcttcaacttagaaaccaattaggagctgctgaacatcaaagtaactttgtgaacagtatcatcagtttaataaaacagttcatgaaattcattctctgtcgcccaggctggagtgcagtggtgcagtctcagctcactgcaagctccgcctcccgggttcacgccattctccagcctcagcctcccgaatagctgggactacaggtgtccgccaccacgcctggctaattttttgtatttttagtagagatggggtttcaccgtgttagccaggacagtctcgatctcctgacctcgtggtccgccagccttggccttccaaagtgctgggattacagaaattcattctctcatagtttgttctgttggattcttttgcccattttataggtccttgctgactgagtgaagggtgtaaaaatgggaccatcttcaaattgaatgtgcctttggttaaacaaggttgggacatttaatatggtgccctcttttcgttttaccatttttctgttcttcgttggataaggagcaaagggataaataaatgacaacaatgaattgaagcatttgtcatctgcagacctcaccctttggggagttttaagatgtgaacccatgataaaggcctttgatactctgagtcctaatctaagacactctttggcatattttccgcactctttcctcccacttctgcctccccacatagttaggcctttagctggctaaagagctaagatacttttttatgaccgacttggttaaggaagtcagtctattggaaacagcctgatgaacctcttcccacaaatacttacattctttaaaaatgtggctccaaacatggtgttggcttttgtgacctcggacatatatagactaggaaaatgattgacatactcttggcaaatgtaagaatacagagatggtcataatagtctagaatgatgatctcttagattttgtaatattaatactcttatataattgtaggcagtatcccgcaccataaaaatcttagtcaaatcagactcctgctcttcgggaatcttggggaaaaatagtaattgaactcccaattgttttgtaaaaagcatttaggtgattaaatattcacttttatatcttttaaagtatactctcccgcttatttattcagctagagatcacagtacccaagaatacatagcattaaaactgctgaaaattacaactcgaagtaaaattttgtatctcaatctagtaagtacacacatatacaaacatatattttcagaaagaatacatgccctaatactgtgtgggctgatattttttcagttctattcctttaaaaaatgctgtccagatctaaattaatttcagaacccaacaaggcttgaaacatacagtttaggaaaaagaacactgctaattagtccatggtcataagtagtagcttcatttaatttgttttgctttcacattcaacttatgggaattcagtgatgtgtgcttggtgaagtttgagtaattccccataccattctacatcattggaatgcctcagaataagcatgtaatagaaagcaatcaaatgtttctcttaatatcagcatctcatcccactctaagtgattgtattatctaattaaactttaaaaaaatatggccccctgattagcaactgaactataaataatgcttatatgaagaaaaagtgattaatttcaatgagggaagaaaagctatctgtattggacttactgagggtagtaggtaagcttccaaatgtagctttttcctaaggaatttttcaagggtgttccaaagggtaattttgcatccatggcatttaatgccctatttcactaatttagaacctaactccactacacttttaattttgattatatatttcaagaatgtgttctgtttgtgataaaggatgctggggcatgtgtatttgtacatttatcaccatttatagagtgagatgagaaaaaagtgttatgtttacatagaaagagtaatatgtttatatagcatttataaagcttattttttggtatcaggcaaaaatattgactaaacctataagccagttttaggaaaaaaattagggtatttaaatgaaatatgaaattagtttcatcattaaagctcatccactttaatgatgaaaccaacttttgaagcaggcgatgttggaattgtatgtgatcagagaagtcagccagttatattttatgttagaaatttagatgtgttaaaacttcatttattcacaaagaaaaacaaatttgagaacttactgtgtaattccaccagttgtttgtagctgtattctacttggcgagtctttttgtgaaattatttttcatgctaataatttactaagtggctacctggtgccatattttgtaagtaaactcttgacatcctttgccctgagctctgatgaccaaatatttgtttagatttaggaaacagtttcaagtgtttgttgagttcattcctccagtagaggtcaattgagggcttaatatattgccaacactaaattattttttgtgggactaggtacccagtgaaaaatggcaatttggggtgtctgtgtttgtatagatggtatctatttccaggtcagttgatgaaagacaaaaccaatccacctccagggaaatttagacctagtatttagtatttagtcaactgtttcatagcccaagtttaataaactttgtgaaaatgattaggaatttttatttttaatttttaaaaattattatttgattctgtttggaagttctatagtgagaaaaaagaattattattttatttttattttttatttttagatgcagtctcgctctgtcgcccaggctggggtgcagtggtgcaatatgggctcactgtaacctctgcctccctggttcaagctattgtcctgcctcagcctcctgagtagctgggattacaggttcatgccaccacgcctggctgatttttgtatttttagtagagacggggtttcaccgtgttggtcaggctggtctcaaactcctgaccttgtgatctgcccgccttggcctcccaaagtgctgggattacagatgtgagccactgcacctggcctgagaataaagaattttataatgacagtagtttgggaggctgagatgggcggatcacttgaggttgggagtttgagaccagcctggccaacatggcgaaacccagtctctactaaaatacaaaaattagcggagtgtggcagcatgcaccattaatcccagctacatgggaagctgaggcaggagaattgcttgaacttgggaggcgaaggttgcagtgcactgaggttgcgccactgcactccagcctgggcaacagagtgagactttgtctcaaaaaaaaaaaaggaattttatagtgagtaatgttaggtttttattttttgttttcattttatttgtgacagtctccctctgtcacccacgctggagtacagtggtgcaatcatggctcattgcagcgttgacctcctgggctcaaaggatccacccacctcagcctccagagtagctaggactacaggtgtgtgccaccacactaggctaagttttgcattttttgtagagatggggtctctgtctccctgtgttgcccaggttggtctcgaacgtctggacttaagccatttgtccatctcagccttataggggtgagctaccgcacctggccaaggtttttatttttgttatttaaaaagaacatctttaagtgcctgaaggaagggaaaatataaagagaatatgagtgattgataatagtttccttgtattaatgtctggaacagtttggaaactagttctgtgttttttcggggggggactttattttttgtatatgaaagtttttttagtaattctaggtgtaatccaaattgaccatagtatagcatttaaataactgaaaaactcacaaaattcatatataacatagttccacaatccatttgtaacattttattgttcacaaaagaatttactgtttttcatatcaccagacttactgtacagcatggtgttatagttaataacaatagattgtgcacttgaaaattactaagagaatagattttaagtgctctcatcacaaaaaaatggtgggtgtatgaggtaatggttatgtttttttctttgttttttgagatagggtcttggtctattgcccaggctgtatggtttcatgatcatggctcattctagccttgacctcccgggctcagcaatcgtcccaccctcagtctcctgagtagctggaactacaggcgtattccactatggctagctaatttttaagttttttgtggcgatgggggtctcactatgttgcccaggccagtctcaaactcctgggctcagatgatcccctcccatcttggcctcccaaagtgattacagatgtgacccactgtgctcgccctaatggttatgttaattagcttgatttaaccattctaaaatgtatacataaaacattatgttgtatgccataaatatatgcaatttttatttgttgattaaaaaatattaaaaaacaaaaattccagaagaagaaatgggtaaatatatttctaatcttggaatagagaaggcttttctaactggtacataaaatccataagccataattgaaaagatggatacatttgagtatgtaaaattaataacttgctttttcaaaaaaatcatcataaataagcagcaacagactgggaagaatatttctaacaatgggtagacacaagtctaattttaagatttcctttaagtttccaacagcacttatatttcattgacagaacttagtcatataacccataaggcaagggaggttggtctgttacttgggcagaattgtttctgtaactaaaaagagagaatggatgacggagacagaaattgagatatctgccacacaagtaaaaccaaatcactaaacatacaggattattaaatgaaatgtgctgtgaaaaaaaattgtaactggaaaaggggttgctagagacttggggttttggtggctgtgatagtagtcaggggagaattcacttgagatattatttaagaaaaggcttgaatgaagtgagggaatactctatgtgaaagtgtgatggatgatgcagtatgtgcattggccctggttcaagtagagcaagtagagtaagaaagtctgtgtgaacaaggaggaaagtgacagatgaggttggggaggtgtatatgggccaggccatatggagtcttgtagccttgacacagagtttggattagtttcctaatttaatggaaactcactggagagttttgagttgtaaggctatgagaccatgatacatagctgggcaagagacggaattgacttggactagggcgatagtggtagaagtggtgagagtggtcagaatttgcctatcatgtagataaggacagtagggtttattgatgatttggatatgaagtatgaggagaaaagaataaccaagattggctgggcacggtggctcatgcctgtaatcccagcactttgggaggccgaggcaggtagatcatgaggtcaggagttcgagaccagcctggccaatatggtgaaaccctgtctctactaaaaatacaaaaattagctgggtgtggtggtgcgtgcctgtagttccagctactcaggaggctgaggcagaagaatcacttgaacctgggaggcagaggttgcagtgagccgagattgcgccactgcactccagcctgggcgacagagcaagactctgtctcagaaaaaaaaaaaaaaaaaaaagaagaataaacaagattgactcctaagttttagatcaacctaaccctaacacccggctcataggtgggccgcatgcagcccaggatggctttgaatgcggcctaacacaaattcttaaactttcttaaaacattatgagatttattttgcaattttttttagctcattaactattgttagtgttagtgtattttatatatggcctaagataataattcttcttccactgtggcccagggaagccaaaagattggacaccactgttttagatctttgaataaatgaatagatggcagtatcaatttctgggagggagaggggcagatttgtgagagggtaaggaaccaataatttttttttgaacaagttaaatttaagatatctattagattttcaagtggaattattgaatatgcagttggagatgtaagtctggacctaagagtagaggaaatggctctagatagaaatgtgcgagtctcagtgtagagttggtacttaaaatcatgggcctgatatgaggtcacctagggcagtggttctcaacccagagtgcacagattcactcgaggcacttttaaaacatactgatgcttggctctaacctaaggccaattaatcagaatctctaattcatccctattttttaaaagctcctcaaaagagatacctgtcagccaaggttaataacaactaacctaggtaataaggactgaaactacccattgtcctttggatttggcaatatagaggaccttgaataatgattttagcataatggtggttaggaaaatcttactaggaagcattatagagtgaatgggagataggaaacagacatagtaattacaggcaactctttcaaggagttttgataaaagcggagctgaaaatggggcagcagggagggaagtttccttttagagcaagtttaactagatatttagcatttcaacagttgcatcccaaaatataggtgatagaaatagtaaaagtgaatatggattatctgtgtaataactttttaaaataaagttttaccccattcctttaaagagaatcagttgatgtagttatacaactagggatcaagtaattgttttttcattttaaaatttaatgtagtatcttatttcactaccactacaaagcaatgcatctaaattctcttttatttctttaaggctgataaagaatttgtatggtctttgtggaaacgtctccaggttacaaacccagatctcacacaagtggtcagtttggttgtggaaaggtgagctctcaaattattttttcatgagtatttggtgtgttgagtttgtttctcttcattattaaagttagtacttatcattaatctcctaaagagattcatttaatttctgaataaatgtggagctaaaaattaaattgttggatttattatgaagggtgccagttcaccaagtacaggtatgccctgttcctgttcatattctgacatatttggagagtgtgtagctaagagataaaactatgtcttaaatactgtgtgtgtgtgtgtcttgagctgttacagttcaaccttaaaagttggcgaagtccctgttgtttgactttttactccatggactgcctctatagggaacttactagacgtgactcagttttccccttagataattgcagtgtgtaattgaaagccggggatgaccttgccagtgtagagtaagtgttctggaataggttaaaggattttacttagcactccatattatcctgtaggaactgcccagtcatttaactgtagattgttgggcctctccttggttattagaaacagtggaatgatgctgggttctctctatcaaacatttggtatacagtattcccatgacacttagcacagcaatgaaaacacttgctttcttagtaaatggatttcattatactttttaaatgagaagctaagcatatggataccttttccttttttaaaaattggaatcatgatcctaaaatctgaatatcattttttattacttgaattatattcacccttgtagtctctagtcctgggatcattccagcgttgtctgagatttgacttgttaaaaatctgtgatacatgcctgagtatgtctaattttaccatctttggttattatgaacacttaaaatagtataatcagtttcttctcatgttgcttgtacgtctaattcatcaatcatttttttccttctgatgatcagaattaagtcttttgttgaagtacccttgttacttcctcaatcatttttgagatgaaatgtgatcactctcagactccctctgtttttttagtagaataagccttctagagaagccttgggacttcaattgtcatttccgtgattctttattctcctctccttttatttgttattttttaaaactttctaaacctatccataatttttacttttctcttggttaaacagaagcagatattaaattattgttaggtcattttcctcattctttacaatgtctgtttttcatatttataatatacagagtatatattcatataacataaaatttataaataaatgtacgtatgtatattagacgtaggtgttcaaaagtcttttgttgataaggtgtaatgagaaattttggagattactgctttataactatgactgtcaaaatttagtgtgcacaagttatacttggagaatttatttatttattttattttattttttttattttatttttttttttgagacggagtctcgctctgtcgcccaggccagactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcacccggcctggagaatttattaaaatgaagatctctgggccttttacctgatctactgaatctctagggggtgggacctagatttaaaataaagtttaaaataacatttccaggtaattctgatgtctgtagattacactgtgagatactttggattttgagtctatttttgaaattggaaacgataagtggcatttataattttatgactatgtaaatacttcctagagaaccatgtagtatgttcacatccattgagaagtgaaaatgatatgctgaatattcaacctatgtctgttaaaaagaatattctaaatatcaaggtcaaatagatgatctttctgtatagtccattagttatccaaattatgatccatttaggtctgtttaatttttaaaccgtggacttcctggacagcatttcccccctggaatttctcattgcccttctctttactttttcttataaagaatgtctacgtcctttgtcagacatttgtataacaggctgagaacatttttccttttcctctttggcttatggtatggatttggacgaattaatttctaaacctactcacgtttgtcatcataggttttcttttcgttgtacagctgaacttattacacagtttctaggatgccagattatccgtttcttttttgtcggattattttcaagtattttttttctcagaaaggatggacaggtggtacgttttctgactccttaaatgaccgaaaatgtctttcttttgcccttaagcttagttggcacttcagctgaacataatattttatgtccatgtatttttgccttggatttttgaaagcatagttctgttatctaaattgagcatacagtaatgctaccaaggagcccatcagtgtgattcttgtttcttcctagataacttgcttgaagcttgtaggattttctctttaggtgcactattgtaaaatctcaacatcatctgtttatttgggtcctttgaaaatttatccttcttagcctttggtgggcctttccatttcaaaacctaagattttcttttcattgataaaatgttctcatattttttcttcattgtattctttgttttagcactctgttagaggttggatcttatggatttgaccttcttctctcttttctctcttatctcatgttttccatctttttatcttttgttgtatctcctcagtggcctttgtactttttgttccatcaataagtggaattcttctgtttgctctatgctatgatctgaatgttggtgtccccccaaaattcgtatgttgaaccctaatacccaatgtgataatattgatgaggccttttggaagtgattacatcatgagggctcggccctcataaatgggattagtgcccttataaaggggtttaaggagcctcccttctcttctgccatgtgaggatacagaaggtgtcatttacatggaacagacccttaccagacactgaatctgctggtgccttgatcttggacttttcagcctccagagctgtgagcaatacatttctgttgtttataaattacccaatctaaggtattttgttatagcagcccaaatggatgaagattctctttgattatttgaattttaaaattttagaaatcaaattattacttctaaaaattacttattttttaattttttcctttttcaaagtagctttctttaatagaataattttttaatctttctgattataatttttgaattcttttctgtttcttgcattatctttgttttctgttgggtaacttctgtttgttcttcctagtctttctctgttttaaattaaaaaaaatttccttgtctttctctttgatgctgttgattttcttcaagtgtataatgaaccttcactgccttgctttatataggtatgttgctcatatgggtttgctttgtgttttttgtatatctgtttaccagaaggtttctcctttgaatgtaaggtttgcctatgggctttttgtaaggcttggggaagggcctatccacaggctttcctgaaaggtgtgtagtagatagacttcattgtagtgaatgagagttaggtcctttaagtcaggcccttttctaattctgttgcttgcccaacactctgagtagggatcttttctggacaaatgattttgaatgcagtttttggccatttgatgtaggcaaatgctgcaggtagctgttctgaacatggatgagtgggaggctcagctttttttggtgaatggtttcttaattaattgttttgattcctgtgggcttctgctctctatacttactaattgggtacttataagcctttctggggcctcttctatgaaaagcagcatcctcttctgtagacttctatttaggttttggattatagtttttctccctcggtttatttgtctctatgagtctatgcttctgtttttaagatatttgtcaaatttatagttcatttatggctgctgctgttgtttcccatgctgataaggatttatttaatgtggtgtgacttgggattgtcagtgttgtgttgttagctcatcccctcagaaagaagtataatatcatttttagggttatagtatattctattatttagatatagcatatttgtatttaaccactgtaattttgttgtacattagggctatttttaaaaatagtataataatgccgtgatgaatggctttttggataaagtttgccctgtattattggtttcaaccggttgtgctaccgacctagtgaatagaggctgagattgctaaacatcttgaaatgaaaagaataatcctgcccaattaaagaattatactactatacttcatatgccagtagtacccatttggactgtctgtgtagatgtgttgtgtgtatatgctttactttttattatggagaaattttaattagatgcaaagacagagagaatacattattgaacactcgtgtacccatcactcaccttgaacagttatcaacacacggacaatcttgtttcatctataaacctctattctctctctccttctaccactaatggattttgaagcaaatcctagatatcatgctattttacctacagttactttagtgtttacagacaattctagttattaacagtaatgttctgtaaagtcactacaaatacttaattagctaacactgaactattactcctagaggaagtaaggggttaggttcctgtaagcctctggtcacaacaattttgtcaactgatcaatacatagcctcattttatgtgtgtttctgtttaaagatacttcatttattgttgattcattgacgtcgaactcttggccaaaagcactgttaactcatgcctgaacaaagcttatctaacccattgttttctccctatggcatgtcacaaccttcttaggaacactagccagcacttcagcactgtgcttgatgatcatttgaaggactgaagtcatcaaaaacaagcaccaaaatgtgacaaatgtggtactaaataaaccgtgaaaaggaaacttgtgtttatagtataagagctgaagcagagtgtcactttatttgacatcagttggaaacatgtgggttgtgtgactcaaattttttgccactttgtgtgtacctgcaaatgactacaatagtgccacaataatttttttatttttatttttatgattatactttaagttctgggttacatgggcagaacgtgcagtttgttatgtaggtatacatgtgccctagtggtttgctgcacccatcaacctgtcacctacattacgtatttctcctaatgttatccctcctgtagcccccacctccgacaggacccagtgtgtgatgctcccctccctgtgtccatgtgttctcattgttcaactcccactaatgagtgagaacatgcagtgtttggttttctgatcttgtgatagtttgctgggaatgatggtttccagcttcatccatgtccctgcaaaggacataaactcatccttttttatgtctgcatagtattccatggtgtatatgtgccacattttctttatccagtctatcattgatggacatttgggttggttccaactctttgctattgtgaatactgccacagtgaacatatgtgtgcatgagtctttattgtagaatgatttataatcctttgggtacatgcctagtaatgggattgctgggccaaatggtatttctagttctagatccttgaggaatcgccacactatcttccacaatggttgaactaatttacacccccaccaacagtgtaaaagtgtttctatttctccagattctctccagcatctgttgtttcctgactttttttattttctttctttcttttttttttttttttttttttagagactgggtctcgctctgtcgcccaggctggagtgcagtggctcgatctcagctcactgcaagctctgcctcccgggttcatgccattctcctgcctcagccccccaagtagctgggactataggcgcccgccaccatgcctggctaattttttgtatttttagtagagacggggtttcaccatgttagccaggatggtctcgatctcctgatcttgtgatctgcccgccttggcctcccaaagcgctgggattacaggcatgagccactgcacctggcctgtttcctgactttttaatgatcacaattctaactggcgtgagatggtatctcgttgtggttttgatttgcatttctctaatgaccagtgatgatgagcattttttcatatgtctgttggctgcataaatgttttcttgtgagaagtgtctgttcatatcctttgccaattttttgatggaactttttttttctggtagatttgtttaagttctttgtagattctggatattagccctctgtcagatggatagattgcaaaaattttctcccattctataggttgcctgttcactctgatgatagtttcttttgctgtgcagaagctctttagtttaattagatcccatttgtctcttttggcttttgttgccattgcttttggtgttttggacatgaagtctttgcccatgcatatgtcctgaatggtattgcccaggttttcttctaagatttttatggtcctaggtcttacgtttaagtctttgatccatcttgagtttatttttgtaaaaggtgtaagtgaggggtccagtttcagttgtctgcatatggctagccagttttcccaacaccatttattaaatagggaatcttttccccattgcttgtgtgtgtcaggtttgtcaaagatcagatggttgtagctgtgtggtgttatttctgaggcctccattctgttccattggtctatatatctgttttggtaccagtacatgctgttttggttactgtagccttgaagtgtagtttgaagtcaggtagcatgatgcctccagctttgtccttcttgcccaggagtgtcttggctatgcgggctcttttttggttccatatgaactttaaagtagttttttccaattctgtgaagaaagtcagtggtagcttgatggggacagcattgaatctataaattactttgggcagtatggccattttcacgatattgattcttcctatccgtgagcatggaatttttttccatttgtttgtgtcctctcttacttccttgagcagtggtttgtagttctccttgaacaggtccttcacatcctttgtaagttgtattcctaggtattttattctcttagtagcagttgtgaatgggagttcactcatggtttggctgtttgtctgttattggtgtataggaatgcttgtgattttcgcacattgattttgtatcctgagactttgctgaagttgcttatcagcttaaggaggatttgggctgagaccatggggttttctaaatgtacaatcatgtcatctgcaaacagagacaaattgacttcctctcttcctatttggataccctttattgctttctcttgcctgattgccctggccagaacttccaatattatgttgaataggagtggtgagagagggcatccttgtcttatgctggttttcgaagggaatgctttgagtttttgccctatcagtatggtattggctatggatttctcataaatagctcttattattttgaaatatgtcccattgatacctagtttattgagagtttttggcatgaataggtgttgaattttattgaaggccttttctgcatctattgagataatcgtgtggtttttgtcattggttctgtttatgtgatggttctgtttatgtgattacatttattgatttgcatatgttgaaccagccttgcatcccagggatgaagccaacttcatcatggtggataagctttttgatgtgctgctggatttggtttgccactattttattgaggattttcgcattgatgttcatcagggatattggcctgaaattttctttttttgttgtgtctctgccaggttttggtatcaggatgatgctggcctcataaaatgagttagggaggagtccctctttttctgttgtttggaatagtttcagaaggaatggtaccagctcctctttgtacctctggtagaattcggctgtgaatccatctagtccttgactttttttggttggtaggctgttaattactgtctcaatttcagaacttgttattggtctattccaggattcgatttcttcctgtcttggaattgggagggtgtatgtgtccaggaatttatccattttttctagattttctagtttatttgcgtagaggtgtttatagtattctctgatggtagtctgtatttctttgggatcagtggtgatatcccctatatcattttttatggcatctatttgattcttcttgcttttctcctttattagtctggctagcagtctatctgttttgttgatgttttcaaaaaaccagctcctgcattcactgagtttttgaagggttttttgtgtctctatttccttcagttttgctctgatcttagttatttcttgtcttctgctagcttttgaatttgtttgctgttgcttctctagtccttttaattgtgatgttagggtgtcaattttagatctttcctgctttgtcttgtgggcatttagtactataaattccccctaaacactgctttagctgtgtcccagagattcgggtatgttgtctctttgttctcattggtgtcaaagaatatctttatttctgccttcatttcgttatttacccagtagtcattcaggagcaggttgttcggtttccatgtatttgtgcagtgttgagtgagtttcttaatcctgagttctaatttggttgcactgtggtctgagagactgtttattttgatttctgttcttttgcatttgctgagtagtgttttacttgcaattatatggtcaattttagaataaatgtgatgtggtgctgagaagaatgtatattctgttgatttggggtagagagttctgtagatgtctattaggtccccctggtccagagctgagttcaactcctgaatatccttgttaattttctgtttcattgatctgtctgatattgacagtggggtgtcaaactcacccactattattgtgtgggagtctaattctctttgtaggtgtctaagaacttgttttatgaatctgggtgttcccatattgggtgcatatatatttaggatagttcactcttgctgcattgatccctttaccatcatgtaatacccttctttgtctcttttgatctttgttggtttaagatctgttttatcagagattaggattgcaactcctgcttttttttgctttccatttgcttggtaaatattcttccatccctgtattttgagcctatgtgtgtctttgcacatgagatggttctcctgaatacagcacactgatgggtcttgactctttatccaatttggcagtctgtgtcttttaattggggcacttagcccgtttacatttaaggttaatatttttatatgtgaatttgatcctgtcatgatgttagctggttgttttgcccattagttaatgcagtttcttcatagtgtcaatgttctttacaatttggtatgtttttgcagtggccgataccagttgttcctttccatgtgtagtgcttctttcagaagctcttgtaaggcaggtctggtggtgacaaaaatccctcagcatttgcttgtctgtaaaggactttatttctcattcgcttatgaagcttattttggatggatatgaaattctggtttgaaaattgttttctttaagaacattgaatattggccttaactctcttctggcttgtagggtttctccagagagagatctgctgttagtctgatgggcttccctttgcgggtaacccaatctttcttactgcccttaacattttttctttcatttcaaccttggtgaatctgatgattatgtgtcttggggttgctcttctcaaggagtatctttgtggcattctctctatttcctgaatttgaatgttgtcctgtcttgctaggttggagaagttctcctggataatatcctgaagagtgttttccaactcggttccattctctccgtcactttcaggtacaccaatcaaatgtagacttggtcttttcacatagtcccatatttcttggaggctttgtttttcctttttattcttttttctctaatcttgtcttctctgtttatttcattaagtggatcttcaatcaatgatatcttttcttccgcttgatcgattcggctattgatacttgtgtagtcttcgcaaagttctcatgctgtgtttttcagctctgtcaggtcttttatgttcttctctacattggttattctagttagccatttgactgactctttttcaaggttcttagcttccttgcattagtttagaacatggtcctttagctcagagttgtttgttattacccaccttctgaagcctacttctgtcagttcgtcaaactcattctctgtccagctttgttcccttgctggcgaggagttgtcatcctttggaagaggagaggtattgtggtttttagaattttcagcctttttgcactgttttttccccatctttgtggatttatctttctttgatctttgatgttggtaacctttggatggggtctttgagtggatgtgctaatcctttctgtttgtttcttttccttctgacagtcaggcccctcttctgcaggtgtgttggagtttgctggaggtccactcctgaccctgtttgcttgggtatcagcagtagaggctgcagagcagcaaagattgctgcctgttctttcctctggaagcttcgacccagtggggcacctgccagatgccagccagaactctcctgtatgaggtgtctgttggccccaactgggagatattgacaggtgaagccagctgggcttctgggttgggtggggacttggagaacttctctgtctagctaaaggattgtaaacacaccaatcagtgctctgtgtctagctaaaggtttgtaaatgcaccaatcagcactctgtaaaaacggaccagtcagcactctgtaaaatggaccaatcagcgctctgtaaaatggactaattatcaggacgtgggcggggccaaataagggaataaaagctggccatctgagccagcaggggcaacctgctcaggtccctttccatactgtggaagctgtgttcttttgctcttcacaataaatcttgctgctgctcactctttgggtccgcactacctttgtgagctgtaacactcactgcgaaggtctacggcttcactcctgaagtcagcaagaccacgaaccactgggaggaacagacgactctggatgcgccacctttaagagctgtaatactcactgcaaaggtctgcggcttcactcctgaagtcagcaagaccacgaacccactggaaggaagaaactctggacacatctgaacatctgaaggaacaaactctggacacaccatctttaagaactgtaacactcaccgcgagggtccgcagcttcattcgtgaagtcagcgagaccaagaacccactagaaggaaccaattccggacacagtatctcctagtcagtatacatgggagtcagggacccatttgaggaggcagactgacccttagcagacctggaatgctgtgctgggaggtccgctgctctctttagagctgtcagacagggatgtttaagtctgctataagcccctgactggggctgctgccttttttatagagatgccctttccagagaggagcaatctggcagtctggccacagcagttttgctgagctgcagtgggctctgcccagttcgaacttcccagcagctttgtttacactgtggccgtgaaactgcctactcaagcctcagcaatggcggacgcccttcccccaccaaccttgactgtcccaggtggatctcagattgctgctgtgctggcagccagaatttaaagccagtagatcttggtttcttgggctcagtgggggtgggacctgctgagccagaccacttggcttcatggcttctctctggcttgtgttctgggcgccagtagggtatggaaaaaaaaaaagctcctgcagctagttcggtgtctgcccaattggctgcccagttttgtgcttgaaacccagggccctggtggggtaggcactggagggaatctcctggtttgcgggatgtaaagaccgtgggacaagcacagtatctgtgctggagttcctcagactcagtccttcatggcttcccttaggtaggggagaaaattcccccaccccttgtgcttccaggtgaggcggtgccccaccctgcttcggctagccctctgtgggctgcacccactgttcagcgagtcccaatgagatgaaccgggtacttcagttggaaatgcagaaatcactcaccttctctgttgatcttgctgagctgcagaccagtgctgttccctttcggccatcttgaatctcagtagtgccacaattattgagtttcgtgttaacaaataaattgtattgagtaggccagtttacaaattctgaatccatgaataaggactatctctaaaagataaggggtgttttaacagaaccatcgtatcatcatcatgctttgaattctataattattctctattataattaaatatctagtccgttttcacatttctcggattgtctaataccttttttaaaaaaggttggtttgttcctaggaggatcaaacatggatagtctacctgctgaatatataggttcatttttttcctcttccatctttctcttactctttttttccttgcaatttatttttggaataaattgggttatttattctgtagagtttccccaaatctgacttattgtagtactctgtaccctatagttgccataaataggatcttattcagattcatttttgatattttggcaaaaataatctttttagatgttactatttacaaggcttactgtggagattttacaggttcagttccagaccactgcaataaagcaaatattgcaataaagcaaatattacaataaagcaagtcacacaaattttttagtttcccattgcatataaaagttatattcagaatgatttataattgaaataataaaatagaattgaaagcactctatattagctagcctatggacttaatcctttgggaagcaatgtaattgtgtaaagtagcaattaatgttgctaggtacaaagttgtatttaaatttgtaattatgtagaattgatatcacactatgtagaaagatactggaggctgaagtggacgccacaacaaataatgttagtgataacactgtctactgtctcctcgatagaaaataaagaacggaaggagaatgcagcaaaacacattggggtcttggttgagtgttagtgttgttcattgagcaacttcagccagcatgttttgagaagactctttttctgataccatttggcctgaatccccattcttcagtcatagtgtcatgacttaccatgtttcaaaaccatagcataatatatttgctgataacaatcaatacgtaccaaatattagtaatgatttatctttttccattagagaggtttcaggattatcctttgctaataccattactttttactaaaatttcttgtgctttcctgagtgagaagatgtctgaagaatgagaaggttgaagcaaggtgaaggtagagaaagggggtggggtaagaggaagaaagaagagaaaagagcatttcctcaatgtgaaagttaattttaattatcaatttgactgggccatcagatgcccagatatttggattaacgttagttttggatgtgtttgtgacagtgcttctggaagagattagcgtttgaattgatgaactgagtaaagcagactgccctctccaatgttggtggccatcatccggtcatttgaggcctgaatagaacatgaaggctgaggaaagttgaatttgctctctgctatgataatatgtctttgccaagcatgccagacatgtatgtcatattttttacttagtacttatttgtgaataagtataagaaaatgatcgcttatcagtagtgcataaatttagattcaggaaggatagtgatgcaaagcaaccacaggttgtccacatgggtagctgagatagtgacacctttgctttctgagggatcagtgttcacaaacattgttttaagcacaaaatcattaaaaaatattaattaaaactaccttcaggctatgtatgtaagatatatgttaaacagaaatcaattttgtgtttaggcttggttcccattgccaagatagctcatttatgtatatgaaaatattctgaaatccaaaatttgaaacacttctgatcccaaccatgtcagataagggatacccaacctgtatcttttctgtctattgagatgatcatgtgatttttgttttgtattctattgatgtgatgtagtacataaattgattttcatatgttaactcaaccttgcatctgtaggataaattcttggtcatggtatataatttttttatatgttcccgaatttggcttgctggtatgttgctgaggacttttacatacctatttataagaggtactatagttttcttttcttgtaatgtctttgctttttatatgaggataatagccttgtaaaatgatttgggaagtgtttccttaaattttatgaagaatttttgaagaattggtattaattcttttttaaatatttggtagaattcagtagtaaatccattcaggtctaggcttttctttgtgggtaattttatagttatgagttcattttctttgcttgttataggttgattcagattttctattttttcttgagtcagttttggtagtttgtgtctaagaattttcacatttcttctaggttatctaatttgctgggtatagttgttcatagtattccttacatttttatagttttttaaagattggtaatatcccccccttttatttctgattctcgtaattttaggcttctctttatcatgatcagtctagctaaaggtttgtcaattttgttgatctttttgaagaaccagcttttggctgtattgttctttctcttctgtttttcttttctctattgtattaatttctccactaatttttattatttccttcattctgcttgctttaggtttagtttgcttttatttttattgacttgagacttttccacttccttgatataggcatttatagttatatccttccatcttagcactgctttagctgcatttcgtaagttgttatattttgtttttattttcgctaatctcagagtgatgtcctctttgacctgttgcttatttagaagtgtgttgtttaatttccacttatttgtgagcttctcagttttccaattttgattctgatttccaattttgttccattgcattaaaattttttgacatttgttttatggccaagcatatggtctatcctgactagaacttctaagcttgaacttctctacactgtgttgcaaataaagtcagtttctttggaaagagattaggccttgttttacatactgcttttcctttcaagcaaagtctctgagtcaggcctctggagctgaggatgtgaacaatattatgcttctctttgagtgaccccccaactctaggagctgattgcttagtggaagggaggcagcagcctaaggttctcttggcttgcctctcctggcatgacacccgtgcatcacaagctggggtctcaatatgctgcacccaaagtagagcctatattccataatttggagctggacagaagaaaggagtacccactgctcaattgcacttgcgttggacttagcctcagcagcagttagctggggacaggatgagaattgctgatatcctgttcttcccgggaagaaaaccctccaactgggaacaggaggaagagggagccctgtgttcttggctgcagctgtctggaatggagactacaccgtgttgagctggaaaggtggaaggaggcagtggttttggtttagataccacaaacattgcctttcatactgattgatagattttcttggatagatgtttcttcatttgctgtttgatcttaggaccatttttagaggctttaggtgattgttaataattttcaccagtttcactggagagtgggtcaggagagctcttcaatcatcatctctcaatgtttgttgttttaaaactgctcaattttggggtaatttgttatacttcaatagataaatactggatcaaaagatacaatggcaattgtgatagagattgtgaattcactgactttagaagttgtaccaacttacacttccaccagaaaatataagaaggtgcttattttttctacattcctggccatcatattgtttttaaactttttaatttttttatctgaaatgtaaaaaatgatatcctgaagtagttttcacttgcatttctcttattatttgtaagtgaactctaagggccattttatatcgttttctatgggatttttcttttatatatctttgtatatccattgtcgtgccatgtctaattcatgtcctatggtgcccttcaaactcactatattatgtaaagaacttattggcttcttcttttagttattttactacctaactttctcactatcacaggcatgacattttcttccctttctttaaatttcacatcttgagggtaatctttgataccttttggactctttgaacagaaaatcaatgcccaagttcagtcacttcctcttttgcagtgtcactcaaatttagtaattcctctgtgtccttaactttcaaatcctctatcttggttctcagtagctcagctctgaacatcttattgatttcttttccaaatatcagttctgttttacatctttactttgagacaaaggaagatataagccaccaaagaaaataatttgtaaaattcaagttaaaggtagccaatgaaaattctaggactttcttaatgaatatctggaggaaaaatgtaacctttaagcttggatgcctagaggatacctcatgttgcaaagtaacctgactgtgagatttagacatgcatggccatcattaaaacagatatttccaccacatttacccattcatcaggtatcaattgaatgtcatttgattgtcagaccctctgaaaaagttagagaaagagatagctctgcatttagctattaaagaatactctctaataggaaagacatttgtagaaagagacaatttataataagaatttgataaatactataatgatattcatattaatgtaattatttgatctctggaaaaagttaaaaaagttctcactctcactaattctaagtaattagaagtttatgttgttgaaagtcaaattttgatttccttagtagaataatatcatactagaaaatatttttatagtatgattttattcttataaatttgtagaaaatattattttctatgatatgtagatatttaagtttacctgtcactttatgagtttgttataaattactactggaaaaaggacattttgaatatatcatttgtttattagctctacaaatctaatttccttgctattatatataaactctcactttagattattggtatcataagagtacaaccactgtattttgtctttaaatgcataaggaaacataatctcaggaagcaggagtaataaacattgaagaaacagtaacatggagtttcatagaaatataaatacattaggagccataagagcttgaattgttcaacttttctttgaataactacaaatgtgtgccaaactccagtatctttgccttagacacaaatttcatcctggctttaaaaattagtattagtaatacgttattttttccataaagaactttgagtttggagtaaagcaagaacaactgctattatttgcctgctaaaattatattgtgaataattttgtagacttatccaacaatgtgctgtcctgcattttgtgtaactctaggtactgcagcttgtaatccacctactgttacaaataatctcaggaagtgaattactgtgtttctttgctgctgcagatccatccagagttgagctattaatctgtttcctccagtcctttttttttcattacatttgcttctatggttaatcttttttgtgttactttctgttttttcttttccatcaatagttatttgacatctatttgtcttagggcagtgatctcagtatggtctgtctgaagacctgtgctagtaaggagaatgtgccagaatgtatagcaacctcgtgccctcttcactgagaaagctttgatacttgtctttctttatttcttttttcttttttttttgagacagagtctcgctctgtcactgaggctggagtgcagtggcgcgatctcagctcactgcaagctccacctgccgtgttcacgccattctcctgcctcagcctcctgagtaactgggactacagacacccaccaccgtgcccagctaattttttgtatttttagtagagacagggtctcactgtgttaggcagggtggtctccatctcctgacctcatgatctgcccgcctcggcctcccaaagtgctgggattacaggcgtgagccaccgcacccagcctcgtcttgctttcttttatggccaactagtaacaaccaattcacagtcctgcattttgaatagcattgccttaagttcctatactttgttacacactaccttcactagagatacactaagctttgttggtagaagagaatacagtatgaagagaactggaatagtggtcttcagggaatcaccaaatgctcttgaggacctcattaaacatataggtggtataattaattatttttccatctggatgtttccttgagttgttgcatttgctttacttttattgcacctgaggatggagggagggaagtggtttggtgggcaggagagtgcacagactatggggcgtagaacagttaccataaagtcagtcaatagaaacatttctaactgggcagggtgaagctctttttcattttggtttcaatggatggagtgacttctcacattaattactgatttggaattagattggaggatgttaactgtatttttaggcagacttctggttttgatgaggtattagtctgttctcacactgctaataaagatgtacctgagactgggtaatttataaaggaaaagaggtgtaattgattcacaattccacatggcttgggagacctcacagtcatggcagaaggtgaacgaggagcaaagtcacatcttacattgtggtagacaaaagagcatgtacagtggaactcgcttttataaaaccatcaggtcttgtgagacttgttcactatcataagaatggggttgaggggctaagattcctccctgtgattgagttaccccccagctgggtccctcccaccacatgtggggattatgggagctgcaattcaagatgagatttgggtggggacacagccaaaccatattagatgatatatgaatctactaatgcattgttttattgttatgataattatgctcttccccccatttttagaaatttttctagaaataagagtataacaaagtacaagttgatactgtgtttttgtgattcattagatatcattggcaaatcatgcatagatagattctgcttattcagtaatctcttgaatattgatttaacagcatttatatttcattgtaattatttctgtgtgtcagtttgttgccttttccattgaacagtgggaggaccatattgtgcatattttccacagtgcttattacagtcgctggcacaaaggcactgaataaatgaatgaataactgaacaagcaaatgcatgatattataatacaaggtagtggaaactagtatcttgaagataagaataaataagtgtatttgcatattgaaaaacattgatctggctgggcacagtgactcatgcctgtaatcccagcactttgggcggctgaggcatgtggattgcttgagctcaggagttcaagaccagcctggccaacacagtgaaaccctgtctctacaaaaattagttgggtgtggtggtgcacatctatagtttcagctacttgggaggctgaggtgggaggatagcttgagcccaggaagtgtaggttgcagtgagctgaattcatgccactgcactccagcctgggcaacagagcaagactctgcctgaaaaaaaaaatggccagaagcagtggctcacccctgtaatcccagaactttggaaggctgaggccggcggatcacttgaggccaggagttcaagaccagcctgtccaacatggcgaaaacccatctctactaaaaatacaaaaattaaactggcatggtgtcgcgtgcctgtaatcctagctcctcaggaggctgaggcaggagaatcacttgaacccgaaaggcagaggttgcagtgagccaagattgcctgactgcactccagcctgggcagcagagtgagactctgtctcaaaaaaaaaaaaaaaaaaagttgatctattgaaatgatctttcattctttcaaaaaaaaaaaaaaaccatttgttagctttaatcgaatatgtataagaccaagtccggatttaacatcaaatctatagaactccttatttttatgtttttttttttttttttttttttttgaggtggagtctagctttgttgcccaggctggagtggagtgacgctacctcggctcactgtgacctctgcctccctggttcggcctcccgagtagctgggattacaggcgtgctccacaacagccagctaatttttgtattttttgtagagacagggtttcactatgttggccaggctcgtctcgaattcctgacctcaggtgatctgcctgccttagcctcccaaagtgctgggattactggtgtgagccactgtgcccagccaagaactccttatttttatgtaagactttaacctctctactagaataaaagtccagattcttagaacatttttctttttttttctttctttctttttttttttttttgagacagagtctcactctgtcgcccaggctcaagtgcagtggtgcaatcttggctcactgcgacctctgccacccgagttcaagtgattctcctgcctcagcctcccaagtagctggtattacaggtgcctgccatgatgcccggctaatttttttttgtatttttagtagagatggggtttcaccatgttggccaggctggtcttgaactcctgacctcgtgatccatcctccttggcctcccaaagtgctgggattacaggcgtgacccattgcgcccggcctcttagaacattttcctaagtgacttttcttaaaataattaatttcaacctttgatcccatgtattgagagaataccacattttttttcatgtgaagtgaaaatttgaaactatgacagtaggaatttaggttaaatgtgatgggttaagcataagtatttatctttacctcctccccaaatcccactaaaatgactagtagagttttaaaagtgtagaagcacctaaagagaagtagagaaaaggtgacagtggatgacagatgttagtaaattctagaatgatgtaaggtgaattgataagtggtaactgacttagcagaatggggaaagttgaaatacatagaatgtagaaatttctagtaataggttacatcagtaatctgtgatggttggagtgaaggatgaggctacaaaatgggaaaattgaattaaagtctatataaggagcatgtagactctctggtcctcctctcattaaggcaggaggcaggaagtttatttccttgaaaaattgaaataagtatcttctggacttagggacctcaggcatatcaaggtacaggattagctattatgaaaactgggggaataagtgaatgcctattctactgaacagtgggacactaactgaattattcagcctcagagttgctggaagcagagtcctgatctatccagtcataagacaaaataattcttctctggagaaactaagcatccctagagaaacaacagagacacactgacaggtcctaacaaaatgacacttcccccacactgttaactatagagacctttgggcaagccctccacccccatcctaggtcaagtaaaactatccaacatcatttttagttcctcattcttaaatatgaatgtgaaacaaatgatcataagacatttgagtaaaacttttaatatgaaggataagaaaccagaagtaacagaaaaatggagttcagagaagacagagatatgctgaataaaacaaaggaaaaaactcctatgattaatattgtaagacatgtaagggaaaatttggtggatgtgaaacatgaacaggtgacaaaaaaagagaaagagtacttggaaattaaataaatataacaataaatgattgtcaaaataaaaaattaactagaggggctagaagacgaggttgaataaatattccaaagattataacagagacaaaggagtagtaaataggagcaaaaggaaaagaataagaatcaatataggtgctataacagtcattaataggaatttcagtagcagagaacagagaaaaatggacattttaaaggaagtaattcaagaaaattttcaaattcaggctcaggagtttaggattgaaagcatccattgattgtccagcacaaagaactattgcaaggcacattattatgcaattttagaatgttggagatagtgagatcatgaaacctcttagaggggaaaaaatacagccacatacatagagttaataattagaataacagtgattgtctcaattgctagaagctggaagacatggagcaatgcttttgtaattctgggagataaattgttttcaacctaaaattctataaccagccagatattaatcaagtttaaagtaataataaagacgttttctgtaacacatggtctcacatctcccattacatattcttaggaggccaccggaagatgtgtaccaccaaaacgaagaatataccaaaaaagataaaaagttgggattgagaaaatgtgagatccaacacatgaataatataaagatattccaaggtgaagatgaaagaagattgagaagacttggtagcagtagttctcaatgaagcaggactacagcagttctttaagaaggatgactctgaaaaaattagcagtgatagattgtaatgtttttgagaaagatatttcatactttttgagaattttagaaaggattagtgataagtaaacagaaaactgcacaaataaaagtgacataatttttgttttttaaaaaaggtaaaagagctttattaacatttctctccattacattaattaacacaactactaaatcatcacttacttgcaggattccaaatgtgatgccatattgattgtaaggggtatgtgtaagtttcttgagagttcctactctagatgagttcactttaaaaaaattcttttcaatatcctgttctttctcatctctcagttttgcctcttatctttcacatgaggaatgagaaaagctgtctatactgattttcttttgagatccacacacaattcaaggaccaaaaggtcagcataaatttatgcttctcttagcaagcatgtgtttaatgtcagaaggaagggaaggtgcataggctgttaaggcctgatagaacctaaaaggcagaatataccaaaggtatttgtaggggcactagaatgcaagcaagacattttctgctctgatgttaacagttgtcagtaagtgaaaaattctacaatgaggtatagcatgtgtatcttcacggtgagattaatgcagtcagctaaacagtgaggttgttaataacagagtgatgcaatttttaactgttcagaaaaaacaaaaagttatatatgaaaggaagtgtcatcatagtacaccgtgttgcttagctgtgaaccatacataataagtattatgttaaaaaactagactaaaaatcaggatttacacctgccatgtaaacactggtcagacggcacagcccccagaagtgctggggtagtgtaccctgaggaaaactcacagagaggggctccctggcaagtgtgtaggtactccattgtcctcttccttctggggcagtataaagcagtctgacaagattacacatgtcagactctgggaaaattaccccgtcacttctggtatgatgagagactgggagacacattataaaatgtatataatagtttttgctattcaaatatgtttatttcctgagtgtgactagtaaaaagttagataataaggcatgttgagttattggaatcctcttttgattctatgtgttggttagcagatagcaaatattataatagcaagggatactagccctctcaaacacacaaaagaaaatctgtctaaatgtgtttagatccaagcgctatcaatgttgggaggaaatgggtaagaaggaaaaagattatgttcctgtctttcttgatgttagttagcaaagaaagtaaaaaaagaaaaaagttatatccccaaatttaagaaataagtaatatatgacctaatgaatacatttatggatggtacttgggactgcttttttggtggtggtggttgttttttggttatgtcttaataactgtgtttaagttgaaaaaataacatgtaacttggatgatattaagaattaaataaaaatatgtgactgttcatgctgattctgtatgtgatcttcgattaatttgacagttgcatataagttagcatagcagatttttaggctatttattattttgaaactcttaagtttacttgttgaataaatgtcctgtatagcaacatttattaaccacaggtatctatttattttgttatactttatataccatttatgataaagaccttttttttcagttttggtttatttgaaaccatagatggctctattgaataaggattatgaataagagtgggttatagtagagtaggtgatgaattgtgaagttttgtgttggatctagtgaaggtgatagttttaccgaaagaccaggtcagcaacaaattacaggggcaggagttatggaaagtttgttcactgccgtagtctggcatccattttttaccttttatttgaatagatttagagtctttttattttttaagtgaccgcatcttgctttgtcacccaggatagagtatagtggtgtgatcatagctcactgcagcctcgaatctctgggctcaactgattctcctgcctcagcctcccaagtagctaggactacaggtgtgcacccaacatgtttgtctaattttttaaaaattttgtacacatggggtcttgctgttttgccaggctgttcttgaactcctgggttcaagcatcctcttgcctcagccttagaaagtgctggggttacaggtctgagccaccacacttggccttagaatcttgagtaatcctaaacctgatagaacataatgacagccttgtgaatattaggggtctcttttgattgctccagatatccttggtacattcctttgaattgttgaatatggttctcactctagttctatgaattgaaatcaaatattaaactggagattataaaatctttgacaagaccgatgtcaaggagcttttccctattgttttttctagttttgtgatttcaagtcttaggattaagcctttaatccattttgagttgatttttgtgtatggcataagataagggtccaattttattcttccacatgtagctatctagttttctcggtaccatttattgaagagactttcctttgcacattgtgtattcttggcacctttgttgaaagctagttgaccatttgtgtatggatttttttcagattctctattctgttcaattggtctgtttatctgtgtttatgccagtaccgtgctgttttgattactatagctttgtaatctgatttgaaatcaggaagtgtgatgcttcagctttgttcttattgctgaagattgctttagctagtcatgatcttttgcagttccatatgaattttatgactttttttcacttgtatgaaaaatgccattggaattttgatagggtttacattgaatctgtagattgttttgggtaatatgtatattttagcaataaccatccttcgaatccatgagctatttttccagttatttgtgtctttaatttctttcatcaatgttttatagttttcagttatagatctttcatgtagttggttagatgtatttctaagtatttatttttgattctgttgttaatgggattgttttattaatttctttttcagagagtatgttttagtgttatagaaacacaactgattttcatatgctgattttgtattctgaaacttaactaaatttgtttactagtttctaacagttttttgttttggaaggagtctttaattttctttatataagattgtgttgtataaagacagtggcagttttacttcttcctttctaatttggatggcctttctttctttttcttgcttaattgctttgggtaggacttccagtagtatattgaataaaagtggcaagagtgggttctcctgatggtgttccctaagtactgtagtctttctttacttttacattcctttttacattctttctgttcctctaactgggtaatttcaaattatctgtttttcagttcacagattcttctgcttgattaaatctgatgttgacactatttcattttgcatttcattgttatattcctcagcttcggaatttgtttctttttaatgatttttatctgtctgttttcattcttttgttcatgtattgttttctttatatatcatttaatcatccatctgtgttctcttgtagctcggtgggcttccttgaaacaattagactcattttcctcattacaatgttttggtcaatgatggactatatatctgatggtagtcccataagattataataccgtatttttactgtactttttctatgtttagatatgtttacatgcacaaatacttaccattgtgttacagttgcctatagtattcagtacagtaacatgctgtacaggtttgtagcttgagagttatagactgtaccatatagcctaggtgtgtagtagtctatatcatttaggtttatgtgagtacactctgtgacgtttgcacaaggacagaatcacctaatgatgcatttcttggaatgaatccttgttgttaagttacacgtgactgtattttgaatgctttgacaattcaaatatctgcacatctttgggattggttactggaaaattgtcattttgttttttggtggcattttgttttttggtggcatcttgtttttggtttttttgtgtttgttgccttgcattgatatctgtgcatttattggagcagtcacttctagactttacacattgatttcagtggccaaagactttcacctacagatgggtacaagagtgctggctggatgaggtgccatggttccaagctttggtgaggatacagtggtatagtctccatgcagttttgtcagctgaagtcagtatctgctaagattgtaggagtcctcagcagccaaggctgcgtgtgttacaaggtgtctgcagggggagcgagggcttttgggttctttgatggccagggctgctgaggtcttcctgatctctttttctcttgtgcaggaagttgtggttgagggtatccctcttggtgctgggtctagcttagcacagtgcctatggagtggccatggagctgatgtttggagctcaggcatgtgtggagggagggatggtgactccagggtctggggtagcagtggttctagtatccagggcacaggcacccccaccggtttggtaatggtatgtacagtatgggtgctcgtggaatagctagggagccagggtccaaagtgtggttatgtgcaaagttataggtagctccagggtccaggacattgttactctccctgtggtggtggcttcagtgtcctaggtgcaagcacattagagtagccatggagccagggtccatagtgcagttgtgtgcagagtgaacagtggctttaagatctgggcacaggctagcctgctgtgttggtggcttcaatgtttgaggcatggatactcatggatcggccattgagctggggtttggagtgcaggtgaatagtgcagctgtagttctgggatctgttgcatatgtgaggttgcggcgggtggcagcttcttctagggggtggttatggctactgtttatctcagtggtgaaagctgctggtgtcctctgaggagcaggttgctggagtttgtacctatgaacactaaggagacaaaatgcagagagtctgtgactgcttttgggactgttaagctccttagcagtaatggctgcaagagtaatctgcagagtaggctgttggggaccatggtagcacctgctgtgtagctgatactgattttcctacacttcttctttgttcctagttgtccccagacattttaggttttatggaataccccatccatcctttctgtgcagttattcaccaatttttcctccatttttcttgtgtagattcttatttagactcttgagacctctttgggctattttgcttatggataactttctagttatttttaggggaggaagacgaaggctggtatttcttactctgtcatcttgctgtatactgcctttaaataatatatttttcataattgtaaaaagttttaatgcctaacatttttctattttcatttttatttcctggatattattctaaaattgcctaatttaaaaaaagggaaattttacttagaaaaggctgaacttagtaaaatacataataggtcaaatataaacttctaggtttcagtgcactttattgctaagtctacttataagtgtgtacacattccttcataaactatttgatctgactagcctttacatcaaggcctccaacatgattaatatcatatttatttatgctgatgtttcatctttgatatcatatactataagggaatcactcagggaaacctgagggaaaagctttttgaattttggaaaaaataatggttatatcctgttggaagatttctacaaattttttgtggagaaaaggaaagttaatggcttcagcatcagtgaagaccagcatattaatttcaaagaagtcactgtcaaaaagaacgaatagtacatcttttatcatttattggaaagccagaaatgttgagtactacctaaacattatgagtatgaagttatagctataatgctgaataataatatctaatatttgtatattactttaattttaatgtaaaatatctcattggaaatttcatgtcttctaacctgatagatgaatagtaaacaaattagggtatacattttcttaatcaccagtgttatgaagacagatttgtcctttaacataataactttatgaaatacatgtgcgtatgcatatttaattttaaaaatagtttctaccatttgataccctgatgcgtcttattttaaggaaacaatttatgtaaaacttgttttcttgtttctgccatagtcttaaaataggggtattgtagaagcgtggacagatgcttatcactcttgagctcataagggttaatccgtggctgaaattatggtattaaaagttttcaacattcttattcctgatttttttttcttaaattggaattgtaacggtgattcacagtaattaagtcagaaatttgctttcttctcatcaaaacaaagaaacattgttggagaagactagtggaagacttaaagggtgttttcaattgattttagggtcagcgattttttaaggaaatagtaggtagccattttttaaaaattaaacttttcattttgagataattgtagattcacatgcagttacaggaaataatacagagatttggcatatgcttgaaccatttctttccaataataacatcttgcaaaactatagtacagtatgaagacaggatattgacatttatacagtcaatgcagaacaattctgtcaccataaggaccccttttataaccccactcacttcactctttatgctccacaccctagcctgtttgtaaatcctggcagctgcttatttgttctccatttttgtaattttatcatttctaaaatgttgtataaatggaatcagacagcatgtaactttttagtataggcttttcattcagcataattctctggtgattctttcaaatttttgtatatatcagtagttcatttatttttattgctgaagagtgtcccatagtatggatgtaccacagtttagccattcacttgttgaaggacatctgggttgtttccagtttttgactattatgaattagttgctatgaatatttgtgtacatacttttttgttgtaaacctaagtttttatttatctgggataaatggccaggagtgtaattgctgggccatgtgattgttatagccttagtttgttaagaaattgccagctgggtgcagcggcttatgcctgtaatcttagcactttgggaggccgaggtgggtggatcacctgaagtcaggagtttgaaaccagcctggccaatatggtgaaaccccatctctaccaaaaatataaaaattagccggacgtggtggtgggtgcctgtagtcccagctactcgggaggctgagacaggagaattgcttcaacccgggaggcggaggttgcagtgagccgagattgtgccactgcactccagcctgggcaacagcacgagactccgtctcaggaaaaaaaaaaaaaaaagaaagaaattgccaaaccgtttgtcagagtgtctataccattttacattttatccagcaatgtgtgagagtgatttggtttatctgcttcttcaccagtatttggtgtcactatgttttcttttagccattctgctgatgtatagttatacctcattgaagttttaatttgcatttctcatggttaatgatgttgaacatcttttcctgtattcatttgccatctgaatgtcctcttcgatgaggacatgtcttttgcccatttcctatttggatttcaaaaaattactgttgagttttcaaagttcttttcatatcccagatactggtcttttgtcaactatgtggtttgcaaatattgtctcccagtctatagcttgtgtttcatcctcttaacaaggtcttttgtagaacaaaatttaaaattttgatgaagtccaattttaattttttcttcaatgggtatgtttttggcgtcaaattgagattttgtttttgcctagctctagagaccaaagattttctcttattttttttcctaaaagttttatagttttatgttttgtacttaagttcacaatccattttgagttactatttgtttaagaagagatttaaggaggtcaagtttcttttctttttttgcctgtggatgtctaattcttctagcacaatttgttaaaagtatcgtcctcttcccattgaactattttgcatctttgtctaaaatcacttgggtatatttgcatggttgtatttcttggttcttcattctgttctattgatctataggtctgttttctgtcaataccataccatcttgattactatagctatataatgcatcttaaaatctgctagaatgatttctcctgctttttcttccttttcaaaattgttttagatatttcagtcctgtgcttttccatgaagtttagaagactcttgtctctattttttaaaaatcttgttcaggttttgagttgaacctagatatcaatttgggggagaattgttgactcctaatccatggacataagatgtctctccatttatttagatcttctttgattgctttcactaccattttgtagttttcagcatgcaagtcctatatattgttagatttacacctatgtatttaaactttttggtatgatggtaaatgatactgtatttttatgtttagtgtccgtgtttgcattactaatatatagaataaggatttccgtgtgcacttattatttctaagattttatttttttaatgatcccttgatttttctacataatcatgttaattatctattgtaattatctattgtaattgtaagcaagtggagttttatttcttcctttctgatatgtgtgccttttattttattttattttcccttattgtgttggctatattttccagtactatgttgagtaagagtggtgagagtggccatcattgccctgctcctattttagagagaaatcagtctttcactaaatggtccctgcaagttttttgtaaattttttttttatcaagttgaggaaattttctgttcctagattgctgataattttttttttatcatgaatgggcatttgattccatgaaatgcttgtactgcatcacttgatatgaccaggagatttttcttcttcagactgttgatatggtggaatacatggatttatttttgaatactgaaccagctttgcctactggaataaatttcacttggtcgtggagtacaattatacattgctaaatactatttgctaatgttttgttaaggattgattgcatctctaatcatgagggatattggtgtatagctttcttttattgtactatctttggtttttatatcagagataagtagcttcataaaatgaatcaggaagtggtgctttctcttctgttttctggaacaaattgtgtagagttgatgttattcttcttcaaatatttggtggaattctttagtaaattatctgaacctggagggttcttttctgggagtttccaaattgccaattcgctttccttaatagttataggattgttcagttatctatttcatgttggtgaagtgtggtagtttgtgcatcttgaggaactggtttttctaagttgtcaaatttatgtgtatagcgttgttcacagttttttcttgttatggttttatgtctgcagtgtctgttgataatcctgtttcttgatattgataacagatgtgtcttttccctatttttttcccttgtcagtctgctagaagtttttgcaaagtattgcacttccaaaaagttcttagtttcattgattttctctattatttttctgttttctattatgttgatttctgctttttattatttcctttttgttgttatctctgtcaataattttcagtttcttggctgggcgcggtggctcacgcctgtaatcccagcactttgggaggctgaggcaggcagatcacgaggtcaggagaccgagactatcttggctaacatggtgaaaccccgtctctactaaaaatacaaaaaattagcctggcgtggtggcaggcacctgtagtcccagctgctctggaggctgaggtaggagaatggcgtgaacccgggaggcggagcttgcagtgagctgagattgtgccactgcactccagcctgggcgacagaacaagactctgtctcaaaaaaaaaaaaattattttcagtttcttgaagtggaaatgtgtccggaattggtgggttcttcgtctcactgacttcaacaaagaagctgcggacccttgtggtgagtgtcacagttcttaaaggcggtgtgtccgaagtttgttccttctgatggtcggatatgttcggagtttcttccttctggtgggttcgtggtctcactggctcaggagtgaagctgcagacctttgcggtgagtgttacagctcttaaggcagcacatccggagttgttcgttcctcccagtgggtttgtggtctcgatggcttcaggactgaagctgcagaccttcgcggtgagtgttacagctcataaaggcagtgtggacccaaagagtgagcagcagcgagatttattgcaaagagcgaaagaacaaagcttccacagtatggaaggggacctgaatgggttgccactgctggctcaggcagcggtgcttttattctcttatctggccccacccacatcctgctgattggtccattttgacagggtgctgattggtgcatttacaatccctgagctagacacaaaagttctccacatccccactagattagctagatatagagtgttgattggtgcattcacaaaccctgagctacacacagggtgctgattggtgtgtttacaaaccttgagctagatacagagtgctgattggtgtatttacaatatcttagctagacataaaggttctcccagttcccaccagattaactagatacggagtgtcgattggtgcattcacaagcactgagctagacacagggtgctgattggtatgtttacaaaccttgagctagattcagagtgctgattggtatatttacaatcccttagctagacataaaggttctccaattccccaccagactcaggagcccagctggcttcacccagtggatcccgcacccgggccgcaggtggagctgcctgctagtcccgtgccctgtgcccgcactcctcagcccttgggcggtagatgggactgggcgccctggaatagggagtggtgctggttagggaggctcgggctgcccgggatcccacagcagggcgggggcggggggtgcatgggggactcaggcatggcgaattgcaggtctggagccctgccccacagggaggcagctaaggcccggtgagaaatcgagcacagcagctgctggcccaggtgctaagcccctcactgcccggggcctgccggctggccggccgctccaagtgcggggaccaccgagcccacacccacccggaattcacgctggcccacaagggttgcgggcagccccagttcctgccagcgtctctccctccacacctgccttcaagctgagggagtcagctctggccttggccagcccagcaagggctcccacagtgcagcggtgggctgaagggctcctgaagcgtggccagagtgggcgccaaggccgaggaggcgccgagagcgagggagggctgtgagagctgccagcacgctgtcacctctcagaagtgtagattattggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaagaagaagtgtagattattgatttgagatttttcctgttttgtaacgtacacctttaattttataaattttcctctcagctgctttaacttcatcccccatattttgatatgctgcctttttatttttattcagttctatgtatttttaactttcctgtgagactctctgtatgaccaaggattatgtagaaatgtgttatttaattttcaagtgtttggcgatttttcctttgccagatttttagtttgatttcatatggtcagagaatgtactctgtgatttaaattctttaaatttgacaaggtttgttttgtggcccaaagtatggtttatctttgtataaatctatgggcatttgaaaataatatatattttgctgatgttggtggattgttccataaatattgattagatcctataggttgattttgttgctgagctcttctgtacctttgataattcactggctagttctatacattgttgagagaggcattttgaagttgccaaacataattattgatttatctattactcttttcagttctatcagttttttttctgtatattattttgagctctaaagtctaaagttggtacgtacacatttaggatcactacgtcttcttggtagattcttttatcattgtataatgtcccttactttccctagtaattttctttgctctgaagtacactttattcaatgttaatataaccactcttctttcttttgaagaatgattacatatcttttttccttccttttactttcaacttacctatattgccatatttgaaatgagtttcttttagttactatatagttgcatcatattttaaaatctactctgttgagcacttttgatttgtatattttagattatttacattcagcttgattattgatatgttagcatttacgtgtgtcattttgcttttttttctgtttgctatctctgtttttttttttttcctgccttcctgttggctattggaacgcattttagaatttcattttgatttatctgtattggttttggtggtatctctttgtatatatctttagtggttgctctaattattatattatattatattatattatattatatatacataacttagcacagtgtactggtatcaatattttactactttaagtgacatttataatagaaacctttctctctattttccttttctttcccctatataatatagttgccatgaatattttttgacccacatttagaaccacataagatattattatactttttgtttcagccatcaaacctaatttagaaaactgaagaagacaaggaaagtctgttgtatttatgcagatttttgcctttactcttttccttcttccttcttgatgttccaggatccctccatttaaaatttcttttctatttagaaaacttactttagctatacttttttgtttggtctcatgacaaccaattcctagatttcccccctcctattttttaagaatgtcttgatttcctttaattcctaaaaattattttcactggttatattatagaattgtgcgttgattcttttcttttctttcggtatttgaaaaatgccatgccccttccttctggttttggtggtttccagcaagaaatctgctgtcatctgaatcattgtttttaggtaataatggtatttctgtgtcactatcttcaagattttttcttagtttttagattttggaagttttcgtatgatatgacttggtatagatttatttgagattattgtgttcgggtttgttcagcttcatgaatctgtatgattatgtcttttgccaaacttgataaattttgagtcactgtttctttgtatatttattgacctgccttctttctcttctacctaggctcaggtgttgtaaatattagatctttgacaggcctctgaggtggtgttcgttttgtctattttccatgttgttcatatttggtaaattctgttgttctcttttgcttttcactgattctttcctgtcctctccagttggctgttgagcccatctattgagttgggttttgtacttttcaggcataaaatttgtatttgttttttcgttgtatcttctgtctctttgcttagactttctgtttctttgctgaggcttccaatttgtttcttttaccttcataactgctcattgaagcattttcattatggctgttttgaaattgttgtcacataattctgacatctctgtcatcttggtgttggcatctgtggatttgttaacaattcaagatattcctggttcttggtataacaaatgattttctgattgaatctggatgctttgggtattacattatgaactctgtatcttatttaaaccttctattttctctggctttcactgatgacattctatcagaggaggagttagcccctcctatttactgccggaagagtttagaagtttaggttcccctctggtctctgaagacacctgaggaatatgatgctcttttttattgctggatgggtgtattctcaccctttattaggccttcactaatgccaccctaggtggaaggggcaggaatgtctcccatgtggcttccactgtcatcacgggaggaagggagccttgttattgctgggcagaggtgaaaattctgactcttccttggcctcctctgacacagttccaatggggagcaggggctggaggagtgggtaacctcattacagtatcgtgaatatgaaagtcctggctctccacttgtccttctctgaaattcttctggcagcaattagggaggctggggagcctcattatatagacttgcaaagattgaagtctaggctcctctcgtggcctttgctagcatgagtggtggtagggccacattttttttttttcctttggtacttgtcaggagtagagtggttaatgtctaaaagttttttgtttactagcctactcctttcctggtccgtagggtagagagcagactttcgttgaggcttttttctttctgtacttagtggtgtttctaggttgtcaactttttctgttccatatctgctgtgcatgaggcaaaaggaaaacccagggaacttattgctgtttaataacaaggtcccaaggtctctagtcaatctgccttttttcccccacttcagagttttctcatgtttattttatatgtagtattcagggtttttagttgtgttctgagggaggaatcaggaaaatacttctaatccattttcctgggaatggaagctgaccatgctttagaaaatttattttgtcattgtatttggtgagttaattgaagtaggtaacttgacattgttgacatttgctctttagagtaagattaaaaagtttgatagatgacgagtttaccctagagggaaggtggcaaatacctgatccttgtgccacttctcttacccttatataccatagcagtctttacttattgttctccattcttcttcctgttgagtcgtgaattaaaacagcattccagatagcacattgctagagttttggagagaagagaaaacttatttgccatacttgccatgaagctgtattcagttgggcataattagtcatgtgaattctagtgggaggggcccagttgagatagattctagtgcgtgcaaaattgatgcagttactcacgaaaacaagtgaaacaggtcattagttgttactggaggtctgtgtcttcaaagtctggtgtctgcatctgtgagtagataatagtatgatagaatctgtatttactaatgattctagtagttaagtgtatctgtgagtagataatagtgatggatagaatctgtatttactaatgattctagtagttaagtgtggaccttcaagtttggtcatcaggaattatcatttacatatttttttgaggggagataaatttataattagtaaaccaaaatgttttaaaattcatccataaatccaaaccatcttatagacatgaatgggacatatccactctgtcatttggaatatcacagaataattctcattcttttaacaaatttatcattttataaggttattcaggagaataaacctagaagaaaagagtgtccacaaaaactcattgagtagggttgcagtcttatatgtagacttttgaaaactgtcttgttgcattaaaaattaatgaacacttttttctatttgttttttttttgtaaaaaaggagaagaatataagtgtttaaatagaattgcaaacaataaaaactgtagttatggtaactttaaaatgttcacgtgaaacactaataataatctttggccattcggtaagattgataaagtcttgcctattcctttcaatgcctttggttaatttttatgttatcatcaaaaataaatgtttcaaaggcaaatgaactagatataattatatataaacaatgctgagatcaatagtatttaaagtagttgggaagtatactaaacatgaaatacacttctgcatccacttatttgaaaatacctggaggccttttcttatcccaaaggcatttctaatttgcatagtaaagatagtattatttatattttcctttaatattcagatatagttatattcaccagataagaaatgtacctaccctgtgaaagctagtatctaaatttgttcttaagaaccagtcaagtgtaaagtaagtaatttctggttgaaatggaaaatagtgagctttttgaagtttcacattgaggtcatgagataacctgatttatgatagcatatgagaagcaacgaataatctgaaatgttcatcccacactgtagattaaactgagtttttaatagacataactaattttgaggaagattttcgtgaaatagctttaaagtatttggtgatttttaccgacaaacggacttattcgaatcataaatgaatttaattatttgaaaatgatcaagcatatatatgtataaaaaattcttgctattttggaatttgaattttcaaattacgtaaacatgaatatttgttataacagagcacatttttgtagtactatttcaacaaatttcaaacatttttattttggtagttaaaatcagaagcaattgtattttaaagtgcaatacgtatgataactagctatttcaaaatcatacgttatgcataagatgttacttttcaagaatgaacattaatgtagggaagaagtactattaaaagataaaaccagacactctttcacttgagaatgtggatagatgtgaggtaggaatttgcttttagaattatgaattgtattgggggagaagtggagagttattactatgatcgtgactacagttgccattgccattgtgaattggcttcattagtgttcaatccagccactttagcagaactcatactagcataattgctattgcaggattaattcattaaaacaacaataggaatactcacacaataaccatattcagaaaattaacccctttgaaatgaacacgtctttattcaaaacctgataaggactaagaggatcacttaggcaaaaatttgaaatggtggaggaaagtatccataaattattaccgtatttttctaaaggattgtaggttagagtgaattatgataaaagcaaatctggtatttaaactcacagtgtatttttggatatcctctaattaagtctcagaactttataaaagctttagccaataacatttaatttatctactcttgaagtctgaatagaatattctagccaaatgctcctttgttagagattcttaagctggtgtgaatgttttcattatactggaaaatagaattcttttggaattctagaaatgaaattttctgttgaaacctgtcttctggtaaaacattcaaacacatttacaatttatattccaaggtgaagtgtgtattctttaatttccacggaggttatcaattttattgcaatagataatatgtctaaaacatgagtaaatcaaaagaatatcaaaagtcattcaacttctggtacgtgttcatgattttgccagaaactggatggctccaaacaaacatgacatttactttcaaagggtttatcaaaagataataatacattcctaactagcatgttggcacagcattgtttctaagataagtcactatttgtcacagcaaacgttttctttttaattgtcatttggctcagatctttctgtgattgcttttaaatatatgctaattcttttagtttacttttttttcttctagtttacttttccctgttaatatctcttggtttgtgagtttgtgaatgacgggtgggatctactataagggttccccagagcattgaagaggtttcagagaccaaggaggtgagggagatgcaaaacacatggaaagatctttcctatctatgccttgcacatttcactctgttagaaaggcttttctctcctctttgctttttgaaatgtttcccatttgtgtgtgtgtgtgtgtgtgtgtgtgtgtgtatctgtgtgtgtcagggtcctgctctgttgcccaggctagagtgcagtggtgagctcatgccttactgtagcctctacctcctgggctcaagtgattctcccacctcagcctcctgaggagctgggactataggcgcgcaccaccacacctggctaatttttaaattttttgtagaggcaggtctcactgtgttgctcaggttggtcttgaactcttgagctcaagttatcctcctgccttggcctcccagagtgccaggaccacaggtatgagccaccgtgtcagcccctcccattctttagttatcagaataagctgaggataatttatttcatcttggactttgtttataattttcttataggattttccatattctgccacatgttcatgcacactgagtagagatgaattccttgaaaagggtattcatctttgaatgactggtaatagtacatcattcatgttgtgtagtgtctgttcagtgcttttttagagttggtctcagcatgtctctttagaaactgggtagttgtcatgttaaaagaatctcagcaacaaaataggattcatgttggtaagcattaggaagtattgggagcatatggtagaattcatcttgattttctcaattgaggacatttgttaactctaaggttatcaatctgttgttcaaaaatatttattgaatatctacattgtatatgattttggattagaaattcttgccaggccaccttgcttagtgtagtttaatagtaggtgctcacttctctatctcaaggttgtagctgttattagttttttttcctggttcttgtgattcttagtttatagcacacttttagctgctaatcatgtgtatatatttaggttctgttaccatttataaggcacactaagcaaacattaccttatttaatttagatacttattgcctgaaatgtttcagaatatcatttgatcctccatatatggatagttctgataagtagtttctttttcatatttaatataaatattactatcctttctatataatgcttgagtcctacattttatgcccttccagactacctacttaattttttatatgcaaaactgaatttgatggattaggattcctatatgagacttttggatggagttgcaaattgttttagttttagagttgtgtctctgatgtctggattgtttggttcttgataatattatatacattaatactttaccttgaccagcaacatgatttctgacccctgatctacctgcattttcagaaagattttgtcataagatggaatgagcgcatacatggaattaaaaacatgtttgaattttggctttgttacttattagctttgattttgggtaagttacataacttctaattattataaatttcctaatctgcaaagacaaatatctgctttatctactttctgtgttaataggagctaatttgaaaatgtcaaactcttttgtaagttattacatactctataagtttaagtggctgccaatattccttctacctggttcatttgatggcaatcttagtttattcctgcgctttcatgtttttaaggttgagaaaatgagagtgtcagaggagggtttaattttttttataagaacaagtagtaatggggtcattatagaaaatttgagaaaataatcatagacctactatctagggataaatcacttctctaatagttcacatatattcccctagtattttttctgtgcaaataaattatttacttttgttttataaaagttggatcatgtttttgtagtgtgctaatatgactagcattttcttattttccccttgctttgaaaactttatttttcaatgcctgtgtagtatttcactttatgaatttaacataatttattgttatgttattgttttgatatttatagagtgtcatatttttactgttagaaatattgcaatgatgaatgtatttgaacataagtctttgcttgaaaatcttgagtccaatattggaactttaaaagaacctatgtaatatgtaaccagaagcagtttatgagaccttttgtggcatcctctccagctttgtgtgagttttatcatgaaatattttgagtgtgtgaaaatgtataaggaataatttaatatttatatactctctactttgctcaataattatatatacactatatatatacaccatatatatatatatatatatacacagcatatttatgtatatatataaattgtagtttcctttgaattctttcccacttcatgcttttcctccgcaaagtttcatatctgaagataaaaagaattaacaaagtgtaatgtcagttttaaataaagaacttgctagatttttaagaagaattctgaaggattatttctataaaatataaatgtctcatcaatgtttgtgagagaaggcatggaaaaaaatcacgtttagatttgttatttgtatttctgtgtgaaattctgaagattagcccagttctaccatgagggtatatatcatggagcatatttttcatattgaaggcaaagcaaagatagttttcaaaaactatgacccttacatttatattgacaacatctgtagaccataaaaaagcccattgtctttttttggcattctttgcaaatgacttattttaccgataagaattgctagtgatccaaatgaatataatattgtttaggcaatattgtttgggaaagactatgatcctcatttatgaagcagtatttcagtgaaaggatcttaggcaatgggaagcaaataattcaactctatttcgaataatttttattcagtggtttcaagttttctgatattttcttctgtactgtttaatctgctgttcatcccttctagtatatgtttcatataagattctatatttttcacatctagaggttccattaaaaatatatattcactttctctccattatgttcatgttttcttttaaattattgagtatcttttaaatgtttataaaaactgtttcaaggtttttgaattgcttaatttcattatctgagtcattgacttttttttccctccagattatggattatgtgtttctacttctttgcatacctaataatttttggtttgatacttgacattatgaattttatcttactgattgtttgatttttgttgtattcctttaaggaattatgaattttttttcttccatgcagttaagttacttgttaatcaatttgagctttttgggacttagtttttttttttttttttttttttttttgagatggagcatccctctgtcgcccaagctggagtgcagtggcgtgatctcggctcactgcaagctccgcctcccgggttcacgccattctcctgcctcagcttctggagtagctgggactacagctgcccgccactacgcccggctaattttttgtatttttagtagagacggggtttcaccatgttagccaggatggtctcaatcttctgacctcatgatctgccctcttcagcctcccaaagttctgggattacaggcctgaaccaccgtgcccggccaggacttagttttaaacttcattagtgcaggcttagagcgatagagcagctttttttctaatctagggtgaatttaatcccactattaagctttttgttgttgtttttgtttttttttttgaaacagattctcactctgtcacccaggctggagtgcagtggcgtgatcttggctcactgcaacctccgcctcccaggttcaagcgattctcctgtctcatcctcctgagtagctgggattacaggtgcccaccatcacacctgactaattttttttgtatttttagtagagacggggtttccctatgttggccaggctggtctcgaactcctaaccgcaagctggtctcctgcttcagcctcccaaagtgttgggattacagacgtgagccaccgtgcctgggctcactattaagatatgatcgttctggggactgtacttaatttcttgaatattacgaggtcttttcactctgactgatgggaacacgaactattgtaagtcctctcttacctttaggaatttttcagtctgctgctttccaatgactcctttcctttgtctggagtagcttttctctcaggcgtggactgattaatactcagaacttccggaactctctctctcaatgcagctccatcctctagtatattgcctggcaaattctacctgccttgagcttccttactccagtctgtgtctgcacaacttaatgagacccagagctgtttgggtctcttcttcctttgctgtagctggaacactgtctctatctagtaagccgggggcaatcatagaacttacttcattagttacctttcttcagggatcacagccctttgtttcctgttgtacagtgtctgataatattttgtatattttgtacagttttcaaggttttttaaggcagcaggataaatcaggttcctgttactcccttatgactagaagttaattcagctttgtatgctgaggaatggctcacaactttcagataatttaatacatatattgcattgtgaacagatagtaaatgactattaaattgtaattgtaccatgaaaggatttttttatcttgtaagtttataattttaacatggctattaaaatttttcatttaaattaccagatataaaaagtttagcacatttctgttgttgttatagtgagagtttcaaatatccgcctcctaatgaagttgattgacagatataggtagtgatctttatatctggaatttcttagtggtcaaaaatttatgcaaaaacatctctttttaaacttgaaggtatgtgacttatttctcattaaccgagttgtcatattcttatgccctttgattttagacttgaaaagtatgagtctggtgaaatgctgaaaatggtacaggaagaagtgagattaggaagagtgaggctgtaggaaaattataattatagcaattaagaactaccagggagttgaaagactttttggtaaagacctctgttaccataaatgttgcaattagtaactattcacatattataattcatagtcatttatataatggatctgttttctttaactcagggattcctaaatgttttcagttcataatgcccttactacctctcattttttcatgatgcctcaaggcaaagagaaatacctaatagttccgtggattaaatatttatgtcctaacaacttagtagccattagaagtatatgtataaattaaaagaaacaattattttcttcttaaacagccataactatttactaataggatatgtgagccttttggatactggacagcttctcatactttgaaatcagattggacactgccaccctcatttcctgttttatgttgctttttgctctgtgtttgttttttatcacagcagttgttaaatacccagcttcatgatgccatgcaaggaatgtaaggcaatctaacattgtaatcctaaacttccttttgctagtagtctgtgcagtgtccaatagatgtcaagtattgctgtttctttcaaacccttagaatatttcacagtgcccctgtgtgtctgctacagcacccctgggaaacttgacacacattctgggtactatgggattaactaattttcttctattgttcatcactgttttatatggcattctggcatgattaagatcctaactaatttctgtattttggaatagagaatctttttgatacagtttcttaagaacctgagttagtaatggtgaaattaaggaataatatatgacatttttttgatggaaaaatgcttacagcagaggcttcatggaaaattattgaataagttggttttgtgtaattttacaaataatctgaaaatatgaagagaaatagtgaataaatattgaaatatgatatttaataggataaaaatgaaggaagatgaggtgggatgaataaacagaaaagaaaaacatgaattttattgtgaggatgtgtaagggaaagttatcaaaactatctgtgctattattgggtgtcttggcatcaattattgtcttgtaatggactaaggatgttgctgattgatccttacaggtgtctgcccactgaactgtactaagctgtttttttgactcaaaaatgattttttagaatgatacattttacaaagaagtatattctgtaccttgtgggaaaatattcctatatactatcataagtatacatttgtgattctatgtgttcatagtttaacaagcataatgttaattaatggctaataatatattgagtatttattatgggccatacacagttcttagtgctttccatatattgactgaattcttgcagtagccctctgaggtaggccctattctttttttttttttttttgagatggagtctcgttctgtcacccaggccagagttcagtggcgccatctcggctcactgcaaactctgcctcccgggttcaagcgattcacctgcttcagcctcctgagtagctgggattacaggcgcctgccaccgtgcccggctaatttttgtatttttagtagagatggggtttcaccacattggccaagctggtcttgaattcccgacctcgtgatccacccacctcagcctcccaaagtgctgggattacaggcgtgagccaccacgtcccgctgaggtaggccctattcttattttcatttaacagatgaaggaactgaggtacagagaacatgagtaacttgcttaaactcacagagctaatgaatggtggagtcagaatttgaaatcttgcagtatggttccagagccccttgtttgtaatatactacctaaggggagaattagcttttacctaagtgtcaacaatgaaacactagtcaggaaaaagaagacaacaagtgaatgcaatttacatttattttaagatcctagacttattaaaatcttctattaataaattgattcaaggaaaagaagctgtagtagtttgttttcacgctgctgataaagacgtacctgagactgggaagaaaaagcagttcagttggacttacagttccacatggctggggaggcctcagaatcatggtgggaggcaaaaggcacttcttacttggtggcagcaagagaaaatgaggaagatgaaaacgtggaaacccctgataaaaccatcagatcttgtgagacattttcactactgtaagaatagtatgggggaaactgcccccatgattcagttatctcaccggctccctcctacaacctgtgggaattatgggagtacaattcaagatgagatttgggtggggacacaggccaaaccatatcattccaccccggcccctccgcatgtcatgtcctcacatttcaaaaccagtcatgccttcccaacagtcccccaaagtcttaatccatttcagcattaacccaaaagtccacagtccaaagtctcatctgagacaagacaaatcccttccacctatgagcctgtaaaatcaaaagcaagctagttacttcccagatacaatgggggtacaggtattgggtaaatatagccattccaaatgggagaaattggccaaaacaaaggggttacagggcccatgcaaactgaaatccagtggggcagtcaaatcttaaacctccaaaattatgtcctttgactccaggtctcacatccaggtcacagtgatcaaagaggtgagttcccatggtcttgggcagctctgcacctgtggctttgcagggtccagcctccctcccagctgccttcacgggctggcatcgagtgtcagcggcttttccaggcaaatggtgcaagctgttggtagattaccattctggcatttggatgatagtgcccctcttctcacagttccactaggcatcgccctagtaggtgctctgtatgggggctccgattccacatttcccttctgtgttgctctatcagaggttctccatgagcgcccgccctgcaacaaacttctgcctaggcatccaggtgtttccgtacatcttctgaaatctaggcggaagtttccaaaccccaattcttgacttctgtgcacttgcaggctcagcaccacatggaagctgccaaggcttggggcttgcactctctgaagccatggctcaaactttacgttgactcctttcagtcatggccagagcagctgggacacagggcaccaagtccctaggctgcacacagtacagggaccctgggcccggcccacaaaaccattttctcctaggcctctgggcctgtgatgggaggggctgctgtgaaaacctctgacatgccctggagacattttccccattgtcttagggattaacattcagctactagttatttttgcaaatttctgcagccagtttgaatttctcctcagaaaatgagtttttcttttgtatcacattgttaggctgcacatttttctaacttttattctctgcttcccttataaacctaaatgtctttaacagtatccaagtcacctcttgaatgctttgctgcttagaaatttctcctgccagataccctaaatcatctctctcaagttcaaagttctacaaatctctagggcagaggcaaaatgccgccagtttctttgctaaaacctaacaagggtcacctttgttctagttcccaacaagttcctcatctccatcggagaccacctcagcctagactttattatccatatcagtatcagcattttgatcaatgccattcaacaagtctctaggaagttccaaactttcccaaattttcctgtcttcttctgagccctccaaactgttccaacctttgttacccagttcaaagtcacttccacattttcaggtatcttttaagcaaccccccactctactggtaccaatatactatattatctgttttcacactgctcataaagacatatctgagactgggaagaaaaagaagtttaattggacttacagttttacatggctggggaggcctcagaatcgtgacaggaggcaaaaagcccttcttatgtggcagcgacgagaaaatgaggaagatgcaaaagcggaaacccctgataaaaccatcagatctcgtgagacttattcactaccatgagaacagtatgggggaaaccgcccccataattcaaatggtctcccaccgtgtccctcccataacgtgggaattatgggagtacaactgaagatgagatttgggtggggacacagccaaaccatatcagaagctaaacagaaaaccttgaaactttaaagataaagtaatatgttactttgtgttatttcatttatgtcatgatgaattcaagattaaattggaaggtgtttcatgatgagctcaaggaattggattataaagcaagtagttactgaaagctaagtcggtttgagaggtcatactaatgatttggggaggaagcagaaccatgcttaataataatttgacctgtaatattgctggaaatgaaaggtatttggttagtgggtcagcagtgtgatcttttccttgtatcctttgcttcttgatgaagactattgtttttttcctttttgatatactttcccatctcagaacgaataccaaaacattcaattattatctggttttattgtcttgagtcttcttggagcttgtttttatgagtttttaagttctaggtttatgtagattatagtactgtttgtatacttataggtacttaataaatacttctaaattaattcaaaattatttactgaatggctaatatgtgcccagcattctgccagtagcgtgcctggagagagaatcgggaaggaaaaaagatagccctttttgtgaaggtggttttggtaaaaaatgtaatcattaacttaagagtggtcttccctgacatcccttattgactaaagaaactctcttccctgcatttattctatctccacttcctggttttatttgtggtacttattaaattaaaaggatactttttctgtgatgaaaattttactctgcatggtaatttattatagctttacatgaaatcagaacttttggtgatctacataagattaaattttattataaggaattttgaaaatgatagtaaagatggttaggagcacagaattaaaagtcatatagatcagagttttttattattattttttacttttttgagatggagccttgctctgtcacccaggctggagtgcagtggcgccatcttagctcactgtaacctccgcctcccaggttcaagcagttctcctggctcagcctcctaattagctgggattacaggcgcctgccaccacacctggctaatttttctatctttgagaggcacggggtttcatcatcttggtcaggctagtctcgaactcttgacctcaggtgatccacctgcctcggcctcccaaaatgcagggattacaggcatgagccaccaggcccggcctagatcagagtttatatccttaaatatttctgatttccttattctttagacctcagttttcacatctttaaaaggattttataaagggatttttaaagaattatggaatatatacataaaaatttagtttaaagcttctctagtagtaggtactcaaaaatggcaatgatactttaaaagttatcttgagtggtcagaactttattaggagttatgtaaggaatgacatttatttttaaccactgaagactttaaaaaataagacttatatgaatatttccttcactgagttgtggattcacttaagatttttaaatttaaattaaattaatatttttaatgtttatatattttatatgtaataatacatttttaatattaaatatttttaatttttaatttatgtgggtacatagtaggtctgtttatctatggagtatatgagagatttggatacaggcatacaatgcataatgatcccatcagagtaaatggggtgtacattacctcaagcatttatactttgtgttacaaacaatcccattatattattttagttattttaaagtgtacaataaattattgtttagtcaccctgttgtgttatcaaatgttagatcttattcagtctatcaaagtgtatagttgtgcccattaaccccctccgttccactacatttcccagtctctggtaatcatcattctgctctctgtctccatgagttcaattgttttaatttttagctcccctaaatatgtgagcaaattacttacactcacggtacctcagttccttcatctgttaaataaaaataataatagggcctacttcaaagggctattgtataataagagttcagtcagtatatggaaaatggggtatttatagttattttcatatattgactgttctaatttacgtgttcaccaacagtatacaagagttcccttttctccacatccttgtcagcatttgtaattgtctgacttctggataaaagccatttgactggagtgagatgatatctcattgtcattttgatttgcatttctctgatgatcaatgatgttgagcatctttttatttatttatttattatactttaagttctagggtacatgtgcacagtgtgcagttttgttacatatgtatacatgtgccatgttggtggagcacctttttatatacctgtttgccgttagtatgtcttcttttgagaaatatatattcagatcttttgttcattttaaaattggattattacattttttcctatacagttgtttgagtttcttatactctggttattaatccattgtcagatgagtagtttgcagatattgtctcctattctgtggcgtgtctgctcactttattgattgcttcctttgctatgcagaagctttttgacttgatatgatcccatgtatccatttttgctttggttgcctgtgcttatcgagtattactcaagaaatctttgctcagtccagtgtcctggagagttcccccaatgttttcttttagtagcttcatagtttgaggtctgagatttaagtgtttaatccattgtgatttgatttttgagtatggtgagaaatgagggtctagtttcattcttctgcatatgtatatccagttttcccagtaccatttattgaagagactctcctttccccaatgtatattcttggtgtctttgttgacaatgagttcactgtagatgtatgcctatatttctgagttctgtattctgttccattggtctatgtgtctgtttttatgctagtgccatgttttggttactatagctttgtagtataatttgaaatcaggtaatatgatccatccagtttagttctttttgctcaggatatctttggctattttgggtctttggtggttccatataaagtttagaattgtttttttctatttttgtgaagaatatccttggtattttgatagggattgcattgaatctgtagatggctttgggtagtatggacattttaataatattgattcgtccaatccaagaacatggaatgtcttttctttctttttttttttttttttgtatttttcttcagtttctttaatcagtgttctatagttttcattgtagagatctttcacttctttggttaagtgaattcctaggtatttacttttatttgtaatcattgtacatgggattactttcttgattttttttttttttttttagattatttgctgttggcatatagaaatgctacggaattttgtatgttaatttttttttttaagttctgggatacacgtgcagaatatgcaggtttgttacataggtatacatgtctccctccccttgccccccactccccaacaggcccctgtgtgtgatgttccccttcctgtgtccacgtgttctcattgttcaactcccgcttatgagtgagaatgtgtggtgtttggttttctgtttctgttttagtttgctgaggatgatagcttccagcttcatccatgtccctgcaaaggacatgaactcattcttttttgtggcttcatagtattctatggtgtatatgtgccacattttctatatccagtgtatcattgatgtgcatttaggttggttccaagtctttgctattgtaaataatgctacaataaacatacatgtgcatgtgtctttatagtagaaggatttataatcatttgggtatatactcagtaatgggattgctgagtcaaatggtatttctggttctagatctatgaggaattgccacactgtcttccacagtggttgaactaatttatactgccaccaacagtataaaagcattccaatttcactgcagcctcgccagcatctgttgtttcttgacttttttttttttttttttttttttttgagacagagtcttgccctattgtccaggctggagtgcagtggcatagtcttggctcactgcaacctctgcctcccgggttcaagcaattctcctgcctcagcctcctgagtagctgggactacaggcatgtgccaccacacctggctaattttttgtgtttttaatagagactaggtttcactgtgttagccaggatggtctcaatctcctgacctcgtgatccaccctccttggcctcccaaagtgctgggattacaggcgtaagccaccatgcccagcttcctgactttttaataatcaccattctaactggcatgagatggtatctcattttggtttcatttgcatttctctaatgaccagagatgatgagctttttttctatgtttgttggctgcataaatatcttcttttgagaagtgtcttgtcgtatcctttgcccagtttttgatggggttgtttttttcttgtaaatctgttttgagttccttgtagatggtggatattagacttttgtcagatgactagattgcaaaaattttctcccattttgtaggttgcctgttcattctgatgatagtttcttttcctgtgcataagtttttagtttaattagatcccatttgtcaattttgacttttgttgcaattgcttttggtgtatggtcatgaagtctttgcccttgcctatgtcctgaatagtattgcttaggttttcttctagggtttttatggttttgggttttacatttaagttcttaatccatcctgagttaatttttatataaagtgtaaggaatggggccagtttctgttttctgcatgtggctagccagttttcccaacaccatttattaaatagggaatccttttcccattgcttgtttttgtcaggtttggcaaagatcagatggttgtagatgtgtgatgttacttctgaggcctccattctgttccattggtctacatatatgttttggtacccgtaccatgctgttttggttactgtagccttgtagtatagtttgaagtcaggtagcttggggcctccaactttgttctttttgcttaggattgtcttggctataagcgttcttttggtttcatgtgaaatttagggtagtttttcctaattgtgctaagaaagtcagtggtagtttgatgggaacaacattgaatctgtaaattactttggggagtatggccatttttacgatattgattcttcctatccatgagcatggaatttttttccatttgtttttgacctctcttatttcgttgagcagtggtttgtagttgtccttgaagaggtccttcatatcccttgtaacatgtattcctaggtattttattttctttgtagcaattgtgaatgggagttcagtcatgatttggctctctgcttgtctattattggcatataggaatgcttgtgatttttgcacattgatttgtatcctgagactttgctgaagttgcttaccagcataaggagttttggggctgagctgatggggttttctaaatatacaatcatatcatctgcagagacaatttgacttcctctcttcctatgtgaataccctttatttatttcttttgcctgattgccctggccagatcttccaatactatgataaattggagtggtgagagaaggcatccttgttttgtggtggttttcaaagggaatgtttccagcttttgctcattcagtaagatattggctatggatttgtcataaatagctcttgttattttgcgatacgttccatcaatacctagtttattgagagtttttaacatgaagggatgttgaattttattgaaggccttttctgcatctattgagataatcatgtgatttttgtcattggttctgtttatgtgatggattacgtttattgatttgtgtttgtagaaccagccttgcatcctatggatgaagccgtcttgatcgtggtggataagcttttttgatgtgctgctgtattcagtttgccagcattttattgaggattttcgtattgatgttcattaaggacattggcctgaaattttcctttttttgttgtgtctctgccaggttttggtatcaggatgatgctggcctcataaaatgagttagggaggagtccctctttttctattgtttggaatagtttcagaaggtatggtaccagctcctctttgtacctctggtagaattcagctgtgaatccgtctggacctgggcttttttttggttggtaggctattaattgctgcctcaattgcagaacttgttattggtctattcagggattcgacttctttctggtttagtcttgggaggatgtatgtgtgcaggaatttatccatttcctctagattttctagtttttttgcgtagaggtgtttatggtattctctgatggtagtttgtatttctgtgggatcagtggtgatatcccctttataattttttattgtctattttattcttctctcttttgttctttattattagtctagctagtgatctattttgtcaatcttttcaaaaaaccagctcctggattcattgatttttttttaagggtttttcaggtctctgtctccttcaattctgctctgatcttagttatttcttgtcttctgctaacttttgaatttgtttgctcttgattctgtagttcttttaattgacatgttagggtgtcgattttagatctttccagctttctgatgtgggcatttagtgctataaatttccttcttaacactgctttagacgtgtccagaaattctggtatgttgtctctttgttctcattgttttcacagaacttacttatttctgtcttaattttgttatttacccagtagtcattcagaaacaggttgttcaattcccatgtagctgtgaggttttgaatgagtttcttcatcctgagttctaatttgattacactgtggtctgagagactgtttattatgatttctgtttgtttgcatttgctgaggagtgttttacttccaattatgtggtcaattttagaataaatgtaatgtggtgctgagaagaatgtatattctgttgatttggggtggagggttctgtagatgtctgttagttccccttggtccagagctgagttcaaggcctgaatatccttgttaattttctgtctcattattgacagtggggtgttaaactcactcactattattgtgtgggagtctaagtctctttgtaggtatctaagaacttgttttatgaatctgggtgttcctgtattgggagcatatatatttaagataggtagctcttgttgcattgatccctttgccattatgtaatgcccttctttgtcttttttgatctttgtttgtttaaagtctgttttatcagagcctaggattgcaacctctgttttttttttttttttttttttttgttgctttccatttgcttggtaagtattccttcatccctttattttgagccaatgtgtgtatttgaccatgtgatgggtctcctgagtgcagcacacccatgggtcttgactctaaccaatttcccagtctgtgtcttttaactgaggcatttagcccatttacatttaaggttaatatttttttgtgtgaatttgatcctgtcatcatgatgctagctgtttattttgtgcattaggtgatgcagtttcttcatagtgtcgttggtctttatattttggtgtgtttttgcagtggctggtactggtttttcctttccatatttcgtgcttccttcaggagctcttgtaaggcaggcctggtggtgacagagtccctcagcatttgcctggtctggaaaggattttatttctccttcacttatgaagcttagtttggctggatatgaaattctggttgaaaattattttctttaagaatgttgaatattggtcttcactctgttctggcttgtaaggtttctgcagagagatccactgttagtctgataggctgccctttgtaggtgacctgacctttctctccggctgcacttaacattttttccttcatttcaacgttggagaatctgacggttatgtgtcttgtggttgctcttcttgaggagtatctttgtggtgttctctatttcctgaatttgaatgttggcctgtcttgctaggttggggatgttctcctggataatatcctgaagtgtgtttttcaccttggtttcattctgtcactttacggtacaccaatcattcgtaggtttggtcttgtcacatagtgccctaattcttggaggccttgtttgttccttttaattcttttttggtttgtttttgtttgtttgtttgttttttgagacagagtctcactctgtcgccaaggctggagtgcagtggcgcgatctcggctcactgcaagctccacctcccgtgttcacgccattctcctgcctcagcctcctgagtagccgggactacaggcacccgccaccacgcccggctaattttttgtattttttagtagagacggggtttcaccacgttagccaggatggtcttgatctccggacctcgtgatccacccgcctcggcctcccgaagtgctgggattacaggcttgagccaccgcacccggccaagattaattcttttttctctaatcttgtcttcacactttctttcggtaaggtgatcttcaatctctgatagtctttcttccacctgatcgatttggctattgatacttgtgtttgcttcacaaagttcttgtgctgtgtttttcagctccatcaggtcatttatgttcctctctaaacgggttattctagttagcagtttttgtaaccttttatccacgttcttagcttctttgcattgggttagaacatgttcctttagctcaaaggagtttgctattacccaccttctgaagctatttctgtcagtttgtcaatctcgttctccatccagttttgtgcctgtggagatgaggagttgtgatcatttggagaagaggcattttggtttttggaattttcagcatttctgccctgttttttcctcatctccatggatttatcttcctttgatttttgaggttgatgacctttggatgggttttttttgtttgttagtttttttgttttttttatgtgggggtcttttttgttgatgttgatgtcattgctttctgtttgttagtttttcctctaacaggcccctcttctgcagcttgctggaggtccagtccagaccctgcttggctgggtatcaccagctgaggctggagaacagcagtgattgctgcctgctctttcctctggaagcttcatcccagagggacaccggcctgatgccagcaggagctctcctgtatgaggtgtctgtcaaccatgttgggaggtttctcccagtcagaaggcatgggggttagggacccatttgagaaggcagtctttcccttctctgaactagtgcactttgctgggagaatcactattgtcaggatcagctgctctcttcagagttggcagccaggaaagattaagcccgctaaagctgagcccacagccgcccctccccccaggtgctctgttgcagggagatgagagttttatctgtaatccctagactgggactgctgcctttccttcacaaatgccctgcccagtgaggagaaatctagagtagcagtctggccacaaccgctttgctgtgctgtggtgaattccgtccgggccaaacctcccagcctccttagcactgtcagggaaaaacagcctaggaaagcctcattcattgcaggtgcccctcctatcaccaagctcgatcatcccaggtcgacttcagactgctgtgctggcagtgagaatttcaagccagtggttcttagcttgctgggctccgtgggagtgggaccagaaagctgggctctgtgggagtgagaccacttggctccctggcttcagcccccttgttctgtgtgggaaacgtgagaggggagaataaagagcacacacacttgttacctttaagggtaaacaagctttatcccatgtaaatggcaatgcagatataataaatgatataataagcaaattaacatgataagcaaattggtataataagcaaatgatataataagcaaattgcattgggaacaggagaagggaagagacatacatatatttatgcttaccagactggaagattcaccaccagactgggaagcaacagcctgggcaccagagtcggacaccgaactcaccagaccatgatgtctttatgaggcttgaaattcctgttatgacttgggtcatgagttcccctaaaacacaccagttctgatgaaggaagcggtgggagcagtcagctggctgaactagtagtggtcctctgagctattcaggaggaggccagagggatttgtcacttgtataccaactcttggtcagtagcaaatggccttactacttggatgccccaatggcaacaaaactaatggttaatcgggagtaaagaggtttggggaaaacaatactgggaagatatctgaatcctgctgcatgctaccattatcactgttttccatgttgatgctgatggatctctgctttttcttgacggactatttaatcagcaggcagatcaacaggccaaaattccaccataactgcaaacttaaatgcagatgaatggattacaacatgttcaagccttgcaatgagaggcattataatgtatgatggtataattaatgagaataacctgtctgctagtaataagtacatgggtcattatgtctgaggctgagaatgagttcatcaactgggtagccaccactgcagcaggagccaactgccgtcagtgctgggtatgcctcaagttgctagaggctgccaggaatgggctaccttggagaatcgtccctgctaacatttctggatggatatgccgataccaatgggggtggggtaataacacttgtaatccaacctggacttttttttaaccaaaccaaacagtctatttttgcctaagccctaactaaacacagcacccttgttacttaaattacacattacagcaataagctacatgtagaaaaagatcttaatgatagtatcactggacttatgttatcagatgaatttgctcagctgcgtactgttgtgttgcaaaatcggatgacattaaatacgcttaccacagcccaaggaggggtttgtgccttactgtatactgaatgttatgtgatatacctaacaaatctcacaatattactctccttgcaaagccatggtgggtgtggtttttattaattgtgcttttaattctcctgtgcttatcctgtatctgtaatctatatcaactttgccttccccatgtatctgtaagggtattttcctacaaatgagtatcaaattgagtctgaatgtggaggtaaagttaaatattaaatttgaactcaattgaccatttgaactcaattgaccacaaacagtggtcaccaagtcctggaatgggttgtatgagtgagcccctttaggcgttcatccagtgttgtttcggagaaatctctgtttcaatctattcctatatgttagtcattgaaaaacaatagacaatcacaaaaacaagttgacctttttgtgttccttgagcccagttgcaaagggccctcatgactgggcctcatgccaaacagcttgttaaaaaagagctagggtcccagactgcaccaacacttcatgagacccctccttgtctgtgcactgatgagtagtggactctggagcccaggctgttgcttcccagtctggtggtgaatccgccacagtctggtgagtgcggtgtctgactctggagcccaggctgttgcttcccagtctgatggtgaatcctccatagtctggtgagtataaatgtgtgtctctattttcccttctcctgtttccattgcaatttgcttattatatcaatttgcttattatattaattcgctttttatatcatttgcttattatatctgcattgccatttatgtgagataaagcttgtttacccttaaaggtattgtgtgtgtgccttttcttcttcccttgcgcgtttcccacacagaacaccccttgccaggggagtgaaccgttttgtctcactggggttgcaggtgccactgggtatgaaaaaaactcctgcagctagctcggtgtctgcccaaagagcagctcagctttgtgcttgagacccaggtccctggtggtgtcagcacacgagggaatcttccgttgtgcagactgcaaaaaccgtgggaaaattgtagtacctgggctgggtagcacagtcccttgtggcttcccttggctgggggagggaggtcccccagctccttgtacttcctgggtgaaacggtaccccaccctgcttctgctcaccctccgtgctttgtacctactgcttaaccagtcccaatgagatgaactgggtccctcacttggaaatgaagaaattgcccaccttctgcgttggtctcgctgggagctgcagaccagatctgttcctatttggctatcttttcccctcccttgtatgctgactttttatcatgcaactttactgaatttatcagtcctaataattttcttgtggagtctttaggtttttccaaatataagatgatattttctccaaacaaggttaatttgacctcttcctttccactttggatgctctttatttcattctcttgtctgattgctctagctaggacttccaatactatgttgaataacagaggtgaaagtggacatccttgtcatgttccagatcttagaggaaagacttacagtttttccacattcaatattaatactagcttttggtttgtcatttatggcttttattgtgttgagatatgtttcttttatactcaggtttttgagggtttttatcctgaagcaatgttcaattttatgaactgctttttcacgtgacatcaattgaaatgatcatgtggtttttgtgctttattatgttgataggatatatctcattgactgatttgcatatgttgaactattattgcttccccaggataaatcccactgtgtcatgatgaatgacctttttcatgtgttgttgaatttggtttggtagtattttgttgaggatttttgcatcaatgttcatcaggggtattggccagtggtttcctttatttgatgtgtctttgtctggttttggtatcagggtaagactagccttgttgaatgaatttggaagtgttctcttcctgtttttccaactactttaaatatgattggtattagttctttaaatgtttggtagaattcagcatttaagccattgggtgctgggctcttctgtgctggaagactttttttgttatggcttcaatcttattacttgttactggtctgttcaggttttggatttcttcatgattcaattttggtaggttgtatgtgtcaaggaatttatttgttctagattttccaatttatcggcgtatagttgctcatagtagctgctaataatcctttgaatttctgtggtattggttgtaatgtctcctttttcatctttgattttatttgtgtcttctctcttttcttattaattagtctggctaaggatttgtcaatgttatgtatcttttcaaaaaccatctttttctttcattgttctttttctgtttcaatttcattaatttatgctctgatctttattatttctcttctaattttgtgttttgtttgccctttcctagttctttaagatcaatggttaggttgtttatttgaagttttcctacttttttgatgtaggcgcttataactataaactttcctgttagtactgcttttgctataggtttgttttgttgagtttacattattatttaagaaaattttcaatttccttcttaatttcttcatcgtcattcaagagcatattgtttaattttcatgtgtttttagaggttccaaaattcctcctgttactgatttctagttttattccattgtagtcagagaagatacttgatataatttcaatttgtttgaatttttaggaattttttattgagtcacatatggtctattcttgataatgatccatgtgctgaggagaagaaaagaatgcgtattctggaccagttggatgaaatcatctgtaactacttattagatctatttgttctgcagtgcagatgaagtccagtgtttctttgttgattttctgtctggatgattctgtctaatgctggaagtgggatgttgaagcctccagctattcttgtacttgggccttgctttttagctctaataatattttctctatatgtttgggttctccagtgttaggcacctatataattataattgttatagcctcttgccaaattgacccctctcttattgtataatgagcttgtctctttttatagtttttgtcttgaaatctgttttgtctaagtatagctactcatactcatttgagagattcttgagccacaactataattcacccatgacttctataagaatgtggttcaccaaggtttaggaagagattgaggtatctgcattttaaaacatattcataggcaattttgatattcaccttagggaaaatactatgattttacagaagataatctaaacttgaaaagtaaatatttttccatctttatggatggagaaacccaagatccaatatttaacagttttaaagactactagagaaaatttgtacatctttcattgtaacttgcttaatacttaactctaacatttggacagaagttatttttattatttatttatttatttttattacactttaagttctggggtacatgtgcacaacgtgcaggtttgttacatatgtatacatgtgccatgttggtgtgctgcacccattaactcgtcatttacattaggtatatcacctaatgctattcctccccgctccccctaccccacgacaggccccggtgtgtaatgttgccgttcctgtgtccaaatgttctcattgttcaattcccacctgtgagtgagaacatgcggtgtttggttttttgtccttgcgatagtttgctgagaatgatggtttccagcttcatccatgtccctacaaaggacataaactcatccttttttatggctgcatagtagtccatggtgtatatgtgccacattttcttaatctagtctatcattgatggacattagggttggttccaagtctttgctattgtgaatattgccgcagtgaacatacgtgtgcatgtgtctttatagtagaatgatttataatcttttgggtatatacccagtaatgggatgagtcaaatggtatttctagttctagatccttgaggaatcaccacactgtcttccacaatggttaaactagtttacagtcccaccaatagtgtaaaaatgttcctgtttctccgcatccagcacctgttgtttcctgactttttaatgattgtcattctaactggtgtgagatggtatctcattgtggttttgatttgcatttctttgatggccagtgatgatgagcattttttcatgtgtctgttggctgcataaatgtcttcttttgagaagtgtctgttcatatcctttgcccactttttgatggggttgtttgtttttttcttgtaaatttgtttgagttcattgtagattctggatattacccctttgtcagatgagtaggttgcaaaaattttctcccattgtgcagtttgcctgttcgctctgatggtagtttcttttgctgtgcagaagctctttagtctaattagatcccatttgtcaattttggcttttgttgccattgcttttggtgttttagacatgaagtccttgcccatgcctatgtcctgaatggtattgcctaggttttcttctagggtttttatggttttaggtctaacgtttaagtctttaatccctcttgaattaattttagtacaaggtgtaaggaagggatccagtttcagctttctccatatggctagccagttttcgcagcaccatttattaaatagggaatcctttccccatttcttgtttttgtcaggtttgtcaaagatcagttggttgtagatgtgtggtattatttctgagggctctgttccgttccattggtgatatctctgttttggtaccagtaccatgctgttttggttactgtagctttgtagtatagtttgaagtcaggtagcgtgattcctccagctttgttcttttggcttaggattgtcttggcaatgcgggctcttttttggttccatgtgaactttaaagtagttttttccaattctgtgaagaaagtcattggtagcttgatggggatggcattgaatctataaattaccttgggcagtatggccattttcacaatattgattcttcctatccatgagcatggaatgttcttccatttgtttatgtcctcttttatttttttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgcgatttttgcacattgattttgtatcctgagactttgctcaagttgcttatcagcttaaggagattggggctgagacgatggggttttctaaatatacagtcatgtcgtctgcaaacagggacaatttgacttcctcttttcctaattgaataccctttatttctttctcctgccttattgccctggccagaatttccaagactatgttgaataggagtggtgagagagggcatccctgtcttgtgccagttttcaaagggaatgcttccagtttttgcccattcagtatgatattggctgtgggtttgtgataaatagctcttattattttgagatacgtcccaccaatacctaatttattgagagtttttagcatgaagtgttgttgaattttgtcaaaggccttttctgcatctcttgagataatcatgtggtttttgtctttggttctgtttatatgctggattacgtttattgatttgcatatgttgaaccagccttgcatcctaggggtgaagcccacttgatcatggtggataagctttttgatgtgctgctggatttggtttgccagtattttattaaggatttttctgtggatgctcatcagggatattggtctaaaattctccttttttgttgtgtctctgcccggctttggtatcaggatgatgctggcctcatagaatgagttagggaggattccctctttttctactcattggaatagtttcagaaggaatggtaccagctcctccttgtacttctggtagaattcagctgtgaatctatctgctcctggacttttttggttggtaggctattaattattgcctcaatttcagaggctgtgtttggtctattcagggattcaacttcttcctggtttagtcttcggagggtgtatgtgtccaggaatttatccatttcttctagattttctagtttatttgcatagatgtgtttatagtattctctgatggtaatttgtatttctgtgggatcggtggtgatatcccctttatcattttttattgcgtctatttgattcttctctcttttcttctttattagtcttgctagcggtctatcaattttgtggatcttttcaaaaaaccagctgctagattcattgatttttctgaagtgttttttgtgtctctatctccttcagttctgctctgatcttacttatttctcgccttctgctagcttttgaatgtgtttgctcttgcttctctagttcttttaattgtgatgctagggtgtcaattttagatctcttgtgctttctcctgtggacatttagtgctataaatttccctctacacactgctttaagtgtgtcccagagattctggtatgttgtgtgtttgttctcattggtttcaaagagcatctttatttctgctttcatttcattatgtatccagtagtcattcaggagcaggttgttcagtttccatgtagttgaccggttttgagtgagtttcttaatcctgagttctagtttgattgcactgtggtctgagagacagtttgttataatttctgttattttacatttgctgaggagttctgtacttccaactatgtggtcaattttggaataagtgcgatgtggtgctgagaagcatgtatattctgttgacttggggtgaagagttctgtagatgtctcttaggtctgcttggtgcagagctgagttcaattcctggatatttttgttaactttctgactcgttggtctgtctaatgttgacagtggggtgttatcgtctcccattattattgtgtgggagtctaagtctctttgtaggtctctaaggacttgctttatgaatctgggtgctcctgtattgggtgcatatatatttaggatagttagctcttcttgttgaattgatccctttaccattatgtagtggccttctttgtctcttgatctttgttgatttaaagtctgttttatcagacaccaggattgcaacccctgcctttttttgttttccattttcttggtagatcttcctccttccctttattttgagcgtatgtgtgtctttgcaggtgatatgggtcttctgaatacagcacactgatgggtcttgactctttatccaatttgccagtctgtgtcttttaattggagcatttagcccatttacatttaagattaatattgttatgtgtgaatttgatcctgtcattatgattttagctggttattttgcttattagttgatgcagtttcttcctagcctcgatggtctttacactttggcatgtttttgcagtgactggtaccggttgttcctttccatgtttagtgcttccttcaggaggtcttgtagggcaggcctggtggtgacaaaatctctcagcatttgcttgtctgtaaagtattttatttctccttcacttatgaagcttagtttggctggatatgaaattctgggttgaaaattattttctttaagaatgttgaatataggcacccactctcttctggcttgcagagtttctgccaggagatctgctgttattctgatgggcttccctttgtgggtaacccgacctttctctctggctgcccttaatattttttccgtcatttcaactttggtgaatctgacaattatgtgtcttggagttgctcttctcgaggagtatctttgtggcgttctctgtatttcctgaatttgaatgttggcctgcctcactaggttggggaagttcttctggataatatcctgcagagtgttttccatcttggttccattgtccccatcattttcaggtacaccaattagatgtagatttggtcttttcacatagtcatgtatttcttggaggctttgttcatttctttttacttttttctctaaacttctcttctcacttcatttcattcatttgatcttcaatcactgataccctttcttccagttgatcaaattggctactgaaacttgtgcattcattacgtagtcctcgtgccatggttttcagctccatcaggtcatttaaggacttctgtacactggttattctagttagccatttgtctaatcttttttgaaggtttttagcttctttgtgatgggttcgaacttcctcctttagctgggagaagtttgattgtctgaagccttcttttctcaactcgttaaagtgattctccatccagctttgttccgttgctggcgaggagctgcattcctttggaggaggagaggagctctgatttttagaattttcagcttttctgctctgttttttccccatctttgtagttttatctacctttggtctttgatgatggtgacgtacagatggggttttggtgtggatgtcctttctgtttgttagttctccttctaacagtcaggaccattagctgcatgtctgttggagtttattggaggtcactgcagaacctctttgcctgggtgtcagcagcggaggctgcagaacagcgaattttgctgaacagcaaatgttgctgcctgatcattcctctggaagcttcatctcagaggagtacccagacatgtgaggtgtcagtctgcccctactagggggtgcctcccagttaggctactcgggggtcagggaaccacttgaggaggcagtttgaccattctcagatctcacactccatactgggagaacgactgctctcttcaaagctgtcagacagggacatttaagtctgcagagatttctgctgccttttgtttggctatgccctgcccccaggggtggagtctgtggaggctggcaggcctccttgaactgcggtgggctccacgcagttcgagcttcttggccgctttgtttacctactcaagcctcagcaatggtgggcaccccttctccagcctcgctgccaccttgcagttcgatctcagactgctgtgctagcaatgagcgaggctccgtgggtgtgggaccctctgagccaggcgcggggtataatctcctggtgtgccgtatgctaagaccgttggaaaagcgcagtattagggtgggagtgacctgattttccaggtgctggttgtcacagcttccgtttgctaggaaagggaaatccctgaccccttacacttcccgggtgaggcagtgcctcaccctgctttggctcacattcggtgggctgcacccactgtcctgcacccactatctgacaagccccagtgagttgaacccgttacctcagttggaaatgcagaaatcacccatcttctgagttgctcactcttggagctgtagactggagctgttcctatttgaccaacttggaactgtcccccaggctatttttaataattagtggttaagaacacaagccgttgagtcaggtaactggatttgtaatcctggcttgctagttgtgtaaattttgaagatgtggtttgctttctttttaatattctgtactttttttgtagacttgttaatacttttttcttgtgctcactttcctattttcagttcttttcctcctcctgtttggtaatgaaaactcaattctggaaaattagaatggtaaaagggaataaaggcaagatgatttttagattttattgacatgtttttattggccggtttattaagattttattgatacatttatcaaggatatgtgtgctatatccttgatacacttggttcaaagatttaatttcatagtaaaggagagattgtcttatttttatttctatttcttattttatttcaatttttagagttaaagtttacatgtttgcatgtttgatagggagactatttctgtaagtttatgttatattctctcactactgggaccacctccctcctgctcctttccactctaaagcacttgggttacacagctgctatatggttgtaccctgtcccatgtgtattaagccaacataggctgcaaaggggttgcagtttggagcatgatagtagcgtggctgtttggagaccccagaactgtagctgccagaattatgccatctggtagcaatgctgccaggcagttccacccagggcataaatgtatttttgctgagcacttttcgtgttgcaagagccatgattgcctaggcagggatgtggatggatggtcatgggaactaactgaaaggtgtttaattggaaccactctaatgttcaaggtgagagtacttgcaataaacatgaagaatcacattcaaacttttacaatagatgcaggaagcttaaccaaatagtcttttaacttttatgaagatttttaaattaaataattgtgagattatagtaaggaatagttactttaaaaatttaatctttatacacatggcagaaggtggtacagaaacatagcttttgtttttaaggtaaaataattgtgatcacctttatttgttgagagtttatttctgttttcttaaaaattcccagaacattgaacgtaattcaacattccatggggaagaaagtattatgcagcttgcatgtgtgcatatctgcatatcggagcacaaaatattgacatgataattgtagtcaagcctgagtgaacagtggcctgtgggaattcagctggtgttgtaccaactggatggctgctcaggacacagtttgaaatgcaaggtgcaagttagcactttattcagcacaggcaggcatcatttaaaaatccttgggggcaaccctggtgatgtgcagatgttaaaacagtctgttctgaagtgctgattttcaaacactggaagaaacttctagattctgggtgaaaaatatttgcacaatcatgaaaggcatataatgcacaatcataaaaggcatataatacacaatcttttcctactcttttatgttgttttacataataaatgttgagtatatgcagaaatatctggacaaatagttaaaagagatgaaatataagaaaatcaggaaatagtcacttaatttctaactataaaacagaaaaaggttttgttttgagtttcagctttgtatatttagaaatggtgttgaatgagtatctgatatataaagagtatctgatcttatttaatactatatttaatataagcagatgtgttcttttgaattgttgcttctttgtttaaagggttcatctgtactccataatttacagattcagattcacatcttagcctgataatcttctgcattttagtctgattgaataaggaaaaaaatgtccatcatttgtcgtttgccaacttctccagcacaagttttggctttcaaatataattttaaacatgtattttatactggaaattaaatataatagttctaaattctggattatacaataaaaactcagttttgtataaaagcaaagtagatatattaactatacttgagcctttaaaacattttatatcaaagtttttacatgaattaagatctgttgaattatttttattccacatattaaagttttctttttttaaatatttgcttttactgtggagtaaaatgtgtttgtacaatatttttgcaacctctttttcaagttttattattgttatattgtttatagatgccattccagtaattcactatgcgtattcataagaagaaatacttataaaatagttcatgaataaatggataatttgatgatggcataactttgatttctctgaacttctgttattaagtcttactgttttagaatcttagtgtttactagaaattgggaattgtttaaattgcaaaccattgatatgtataaaatctgcattttaataggttctctactcaaatgaaagaaaacgttagtccaataaatagctttattttgtgtgttatttatgtctgtaaatcaaaaataaccaacttcagtaagttttgcttttttattttgtttataaattcagaccaatatcactgcctcatttatagttggatgtttttttagactctaatatttcattttgacatctcattaaaagtgggctcaaacccagaaaatatgatcctgttgtagtgtataatatatggcatggtctataacataataaaattttgtttcttaatgattcagaataatttctcagatttttgagcttagaaaaatgactgaaagttagcgtggtaattcatgtggctaagtacagcattgttaaaatgtttaaatgggaagtactcttgggaaaaatgattggtgcttaaaagttgtacagatttgacagcctctcttcgcttcatttttcattctaaagaagtcggcaaatattcttcgctcacatcattattgcacatcagtggttctaattagctaaacaggagtttgtctcagtcattgatcatcatcagctcctggcagtgtctttttttttctttttaaggaacctttttttttttaggtcttgtaagtacatagaagtacatgtattaattgaattgaccagattggttggtgacattataaacttgaaacaatatttaaaaattttattttttcaagtagaaaatattgtattcctgttacagcaccattttatcttgggagcattttcctgttatgaaaatgttagacatctcataccaccaggaggagctgctagacaaattgccatattttgagttttgattatctttcaatttcaaaattataacatattagtcaattttggaggtttttggttataagatataccattcaggtatatttttgaagtttttattttatatggcacttatgacccattttttcaatattatgtcactcagattaatctactgggaagtgtgttattgttattttggtgactctcacactttagtgtgcatcagaatcgcttgagatcttgtgtcttagtcagttctgactgctaaaacagaatcctgggtggcttaaataacaaacatttattctcatggttccaggaagtacaaaattaaaatgctagccaatgtggtttctggtgagggctctttgtaaatggctgcctttttgttgtatcctcatatgacaccgagagatcttctctctagtgtcccctctcattaaggtgctactcccattcatgaaggagtaatcctcatgaccctaattgcctttcataggcctacctccaaatactatgacattggttattagggcctcaatatatgaattttgaggagacacaaaccttcagtccatagcaccttgttaaacacagattgctgggcccccactcttacagttcttgattcagtgcatctggattgggctgaagaacatgcatttctaacctgggtgatgatgatgctcgtgctctggcaacctaaccactagttagactgtgagtatgtgtacatacttgtgtcataggagataattagcctagtatcaagctcatttggaagctgtaataatgcttttgtttgggtttggtgtcacataatctagtattatccgtatctcatttaaaagtactaccagaatttatttggacattagtggggatcttaagtttattatagaagaggggattataaagactaaccgtacagtttttttaaaaacatttaagtttaggggtacatgtgcaggtttgtaatgtagttaaatgttttttaggtaaactttaaaggtaaacttgtgtcatgggagttttgttatacaaattattttatcacccacttattaagcctagtacccattagttatttttcctgatcttctacctcctcccaccctgcactctctgataggacccagtgtgtgttgttcccctctgtgcagccatgggttctcatcatttagctcccgcttataggcgagaacatgttgcacatgcaatatttgattttctctacctgcattagttttctgaggataatgaccttcagctccatccctgtccctgcaaaggacatgatcttgttcttttttatagctttgtagtattccacagtgtatatgtaccacattttctttatccagtccatcattgatgggcatttatgttgattccatgtctttgctattgtaaacagtgctgcagtgaatatatgggtgcatatgtctttatatggaatgatttatattcctttgtaaccctataaattaaactaattcctggacagttaaaaatagattcatggtatatctggaaaagaacttacaaaggaactatctgactgtagttaatgctttgactttcatgatctgggtctttgtccctgggtaaatcctataatgccctaacttttgggatcctgttattttcctcctaatgtatatacctctaatagatttagtattcttttgcagtacttctgattttataatgataagctaaacattcaagtggtaatttgagataatatattagtgacaaattataggtaaagttcatatattttaacataaaatagttgtataaatcaataaaaacacactaaaatataaaatggcagatatatcgataggcaacgccaaaacataaaataaaaaggggcagaaattcatcagtttctgaaagtacattatattttattattaatataagaaacaaaagaaggcctagttgtacataatggattgcaattatgtattaaatgtactattaacgtatggtaagtagacaacaaaataataaagcaagataaagtgcaaatggtaaaaataaatcatcataatatacatgtttgcaaaatttccagtgtggtttattccaattctccgccttttgtgtgcctacatccaaagggctaaacttggcttgagaaagaccttgaaccatgatgacaatgatcttgtataaatttatgaccactaattttaagtggccctcagtactgcctgttcatcatcctattttttcctggcccgcttactatctcagtatcctagaatgttttgttttctcttttctcaacttccaacacttcttttcccattcttactttcagctgttggatacccttgctttcatataccattgagaaagtggaaactcttagaagggagcttttattccttcccataactgtatctaccaacatatctgaatctgttctcatattctctctttttatttctttggaagaactgtttatatttacctaaggccgaacaaactatatgtacgcttcaagcctcaaggattcaaagatgttggactgcagttctcttttctgtcctgcattatcagtgtctctcactgccctggatcattcctgtcagcatacacacaggctgtcttatctcccatgtttaaaaaaaacaaaaacaaaaacaaactcttgtgatctcatatttcccttgaactattttgccatttctctgctcctttctgtgcaaaatttctctgaagagtacttttcagtatttctgtgtttttctttctcacttgaactcactctaattaggctttgtaatcaccatccttctaaaatagttcttgtcaagatatcaactactgaccttaattgatatggttaggctctgcgtctccacccaaatctcatctttagttgtactcccataattcccaatgtgttatggaaaggacctagtgggtaataatttgaaccatgggggtggtttcccctgtactgttctcgtggtagtgaaatatcgtggtatatgaaagcaagggagatctgatggttttatcaggggtttccgcttttgcatcttcctcattttctcttgccgctgccatgtgtaagaagtacctttcacctcctgccatgattctgaggcctccccagccatgtcgaactgtaagtccaagtaaacctctttttcttcccagtctcgggtatgtctttatcagcagtgtgaaaacagactaatacattaatattgctaaatccaacagtcatttctcagtctttagtgtgtttgcagcatttggtatacttgatcattcctttctactaaattctattcacttagctctttctctttattctcttaaattactggcttatccttcttagtttcatgtgatgttttttccttatcttactaatctataaatgttgaaatgttccaggactgaatcctcatacttctttatgcaaaatcactccctaggtgaacttatctacccttatggtcttaaaaatatagtagtctgccttatccatgggggatacgttccaagcctcccaacgggtacttgaaaccatggatagcactgaaccctatgtacactacgttttttcctacacggtaataggcaggttgtgtttatagcatggatactttcgacaaagagatgattcatgtcctacgtgagttgggacttggacagtgcaagttttttcatgcattcagaacagcactgcaatttaaagcttatggattgtttatttctggaacttatcatttaatatttttggatcacagttggctgctggtaactgaagccatggaaagtgaaactgagggtaagggggaactacggtatttggatgactcctaaagttgtatctccagccttaacttttttactgattccagactttttaattcaactgcctactcctcttggatgttgattaggcatctcaaacttagtatgtccacatttgaaatccttgtgtccgtccaccaaacttcttctctgtgtctcagataatgtctgctccattcttccagttgtgtaggcaaaagcttgggagacattcctcacttttctatcaagaaatcctgttagctctaccttaaaaatatccaaaatttaatcacttctcaatgccactgcatctgcctatcatgtacaattcacctttcttttttacctggctgtttcatttgccttctaacttgtctttttgctttctcccttgacccttaaggtctgtcctcaacccaccagccattgatactcttagaatgttatatgttatttctctgctcattgccttcccatttcacttcagatccaaatttcacagggcctagaaggccacatattattttatccccagtgatttctctgttcttagctaccatttccttatctactttactataaatgtgtgtacttccgtgctgttctttgaatataccaattgctcttgctcttgtgtctttgctcttgctactagttccatgacttgacttggaaaactcttccctagggtcttcatgactcttccttccttcctttagatctctcctcaaatataatattacttttaaggagagttacatgttaactattctatataaaataacaacaaccttcgtttcactcccagcttctctaggactgggaattcctttcttcgttaccctaatttattgtccttattatactgatagcaatttgacatactatgtattatttatcttcattatctatgtactgaaatgttaattccatgaaggcagcaacttggtttattttgttccctccaatatctctagtccctagtccaatgactgttatataataaatgtgcaataaatacttgaatgagtgatggattaatgtattagatgtgacttttatttattctggtaggtattccttcaatctgagaactttatttaattctaaaatattcccagcagttacctcctgaaatattgctttatttttcatccccatagttattacttctggaatgttgtaggcatatgttggagtttcccaaagaaacttgtctcaactgtgttttcatgtttttaatctcactattttcctgtgtagtgttctggatgaatcccttattactatcccttatttcactaatctctttttgtgtctagttttgagcttagtccatttagttgttttttacttcagtgattataattttttatcttcaagattttaatagcttctttacatctacctgattgtgtttcatctctcagctttacttttaacattagttattcttttgtctttacggacctttaacttacttattgtagtctttttcattatatttggttatttttattttttctagaggattgcatcttttgacttgaactagtatgtcagtgtatggggattcatgtattttgaatttttttgtttggggtcatatctcaagagggaagattgctgttattgttactgtttacttcctcctctttctccaccaccacgtccttaactaatgcctatctttttttctagaaattttatagttgcctttaaattgtcaatctcaccctagtctctttcctgaaataggttttatagaggttttgctacacctagcctcagttgcagggtgttttggctcaactcttgattggggagctacatctataaacttttgcctttctagactctaatataagccttggttctaggcaaggatgggcagaagcttttttccagcttcatttcatgagttagcattcccatcccacacaatgagcctggttgtgcttctgcatactgggtaaggcacttgtattccctattaaccccagaagtcaagctcctttccacctcagcctgcatctggctctgggggacagcaaatagtagcttcatccccatttatagttttctatttttgtttaatttgtgattctcacagatatagatttgtctgtttaattatttatgtttttctatgaataccatgtattttatttgtgaccttttaaaaaatgtaaatcagtgtccaatcaatttccccttatttataatataaattgactggtgtcagcctgattatacagtctcttcagacctttgttccttcctttcccttttcctcctttgctttataaagctatatttgtttaaaagctatatttgttttagaagatagtcattctttacaagtattgtgattttctgtttcccagagaactatgctttgattgtacaactaccatttagtttagttaatagtattctcagagactagaaatgtataggaaggtgtcagaaatcaaaaaattctagttatagggtatcgactataagtaaatctctgtcactctctcttttgagactcttaaaaaatggtaaattttatccttaatataattgtgtatatgaaagcttaaattaacaagaacatgtttacttaattgtaattattttcaaagcgatgacagtatggttattgcaatcaaggttaaactatgttttatgtaatttttatcatatacctaaatctagaaatgaaactgttcttttagtatgaagttgtcttagttttcagcagttgtaagttgctgtcacttgccatgtggtcaactcaagatgatttaattttctatattttaaagtgatattaatatttgggatatgaaaatttaaagtattagctaccagttatgactaataaactctctatattttatatctagagaaaaacagaaatctgaagctaaagacagaaaagttctagaaattctgcaagtcaaggatgccaaaatacaagaatttgaacaggttggtgttataataaaaatatttaaattaactatatttgttttgggtagtagatcttcaaaattatttttatttttttgcaatagtgtttattgagaatatcagggtccttatgttaaagcattactattttgaagtcactagtaagattattcttcatcattaatacttctcttgtacccttttgttttctgaattaatagattataactcttcatctaatgttacagttttataatagtatctagctattattctttattttgttgaattttgacattattagcagttatcatttacttctgaaacttgtaaattttcagatggttttatttgtagaaaagataaaaattgagatcctattatttacacttaaaacttgtatttttgtgttagtactatattaggctgttcttccactgttacaaataaatacttgaaactgggtaattaataagaaagaggtttcattggcttatggttctgcagacagtacaggatgcatagcaacatctgcttctgggaaggcctcatgtcagaaggcaaagcatgtgacacttcatatggttatagcaggagcaagagagagagacagggcatggtgagggaggtgccacagacttttttttaatttttttaatttttatatatatatttttttatactttaagttctagggtacatgtgcacaacgtgcaggtttgttacataggtatacatgtgccatagtgtggcgattcatcggtgatctagaactagaataaccatttgacccagccatcccattactgggtgtatgccacacacttttaaacaacgagagctcatgaaaactcactccctatgcaaaatcagcaccaagccatgagggatccaccctcatgacccaaacacccctcaccagcccccactttcagctttggggattacaattcaatgtgagatttgggcagggacagatattcaaactatatcaagtacagtcctatcttttatgtataatcagtaaattatacaattacatataattatatgtatatgtaatatgtaaaattacgtgtgattatataatcagtatgtaatcactgcaaaagtgcatgtggtcatgcttcctggaacaattttcaagatacaaacatttcaaaaaagaagtgaaagaaatttaagagtggctaatatcgttatataatatttaaattcattttatactcaagctcattacggagtaaataaattataatttttcttgggaggtacctttttggcaaccatgttcttttgacttttgaatttattttcctttctaaccaattaaaggttcatgagaactttgatctaggatcagttattgttataaagttgttttatgaaaagactaaaagttccattccctacatttctatctgttctttctaaaaaggaatattgattccaataaacttagaaatttgaaatttacacgttttccaaagttgagtttttcttatagaaaatgtcataattggtactatgatgataaaatgttaagaataacattttagtaaatttgttctggaaagaaacatttgtatttaccacccaagtatcaaacaacattaaaatgtactctaaaataggtaaatgttgtcatgtgcctggtatattaattggattaggctaagctgcttgacaagtacaaccttatgagccagacatggcagacatcatttgtatttacattttactggaaaaaaatttggccaccccaagattcaggcgatttgagaaaatgtagatacaagtttagcggtcccttcctcaattacacctctattctgttagagcaggaaaatctttaatatccttaggcattaagtttgcaatgctttagtgaatgctctttggtttaccagctttggataaccatagcacacccttagaaaatgttgccttttgtaaatgaaaatatattttccccttttctttgctaaattctttgtctacttctgcatccttgagtagggattgtttcattatttatcttttgagtggaatcacatagcttatatataacatattaaactctcataatagaaattatttgctttgtagggacccaaatttcttaggattaatcatttcatttttgtgcaatgatgattataactttctacaaagtatattttcagttaggtgcaacaagataatgtattaaatgtatatattatcctgtgatggtgttgtagaatattcagagttacatttcttgcctttaacgctttttaaatctctttgatgattaggtgatgatagaagtaaggtggaaattgccatattctcctacactactttgtttctatgagggcagagtctgtttctctttcatccactctttagtctcatacagacgactgtatacccagtacgtaattattaatagttatttcatagtcaggtccactgacatggacctgaattattaggttggcaggaattaaaggtatgtaaatggaaccataaggacttgatagtaattctgaaaatgactcttaggttttcagcttagagaaaccaggagaacagtggcgttattatcaaaaataggcttattttcaggaagtataaattgttttgaaggtaaggttttgagctcctcttagaaagtttgtgtttgagatgctgataggaattccatttagagatttttagcaaactgttggaagcatgaatctgatgaaggagttttgacctggagatgtgggtatttaatagtttagttagagggaagactttaagcagtgagaattttgagaacaagatatttactgatatttttaatgaggaaggaaaaattgtagtgaaagaggtgaaaagactttatagaagtaaggagagagtacaatgcaatatctcatgaattgagaagagagagtttcaagaagcaaaatgttgtcattgtcgtaaaatgctgcaaaaaatggagtgggtttttgaaaaagacattacatttagcagtcatgaagttttaaaatgaattttagaaagcaatacaacagggatggcatatgaaattttaagagatcattgaattctgacaaagtaatggaaaggaatgaagaaatgtgacattatggggtggggagatagtgggatggattgattgattgactgatttgttttaagtaatagctcacgcagtcgtgggctggcaagtaactctgcagggcagcctggcagaatggagacctagggaacagtttatgttacattgcaaatcctaaggtagcctggaggtagaatttcttcctcctctggggatcatagtattttcttggggccttcaactgattggatgaggccagcccacattatgaagggtaatctgcttttctcaaagtccattaatttaaatgttaaccacatctaaagaatactttcacaataacatctagactggtgttagataagaacgtgtgtaccatgggtagcctagccaaactgacatataaaattaaccaaatgggtaaaaacagctggggtaaataggttttatgtttatctggctagatattaggctgtctccactgttcgctgtggtatgagttagaggcagaactctggtatccgtgccttttatttgaatttttgtagagattttataaatatccttgatatgcataattcagttttcttaaaaagaaaaaccttagacaaattaaattcaatggagtttaattgagctgaaaaaaattcacgaattgggtaacactcaggaccaaaagtggttcatagagctctgctccgcagtgtgggctgggactgtgtacagccagacaatggaagtgacacacagaaatagccagattggttacagtttggtgtttgccttatttggacatgttttggcaatttgcacttgtgattggctgaatgcttggctgctgtgattggctgagactcggctactatacaaaaatatactctcaagtagggttgtgtttacatgttgttaggttacagttagctacctacagaggcaatttaatttaatagttgctatttaaactgctttgtttggtcaaacctattaattatacaatagtcccattgatgtggtggtggggtgttgggggaggagaggaagcggtctgtagtgttatgtttgggtttttttcatggtgagctgtgcttctggactgtgaccttcaaaagtgcttcttagttttttgtttgtttgtttcccccctccccttacccccttaggagagacaggaaggctagaaggtgctagagttgggtatttcccttttccaagttggttagttaggctcaggtaaaaccccatgagtctgggctctggtaaaatagtttttcttgatggcaggccttggtaagaagaaaagaatactctgagtgtgtttaaagatggttactttctccctccacatactggaaacaggaaggaataattgtgtgatcttccctgtgacaacatgacaggggtccagtaggttaaacttatgaaaatgtgtcacctcttattgttttatggttcctctgagtactgcttgcccccttcccccaagcatgactgagccatccttgagttttaaactctcagacttgtccatattgatcttccagtaattcattaattacagaataagtttttccaccctggtgctggctcctgtggaagttttttctcctgggcatctgttccattaagttgttattctctctattttcatgtctgtctcttcaattttgggagcgttggtttgctggatagtctcaattctctgatggatctgaaaagagttgttgattttcagtttgttcagcgttttttcttattgtgtaaatgagaaagatgactgccaagttccttatatgctggactggaaaccagaagccccctccattgaattgttgttgttccactgaaaaatattaaatagctcctaatgttcaagatttatagctatgagatagagtaagaattagaatgacaaatccttcagcttatttaactcttacttctgtatctagtgaaattactagaaagttacacacacacacagtttttttttagctgtttgcagaaaaactttcctagggtgcaatctaataattattagtataaagaattgcctttttttgggtaagactatgttttagctttgtcactgttataaaacaatgttaatacatttcccttctagtattgtgctttgatagcatgacttatgataacctagtaaattgtatttaattagatgataattgctctttaacattatatttcattttttccttaccttctaggaagctcagaagttttgtttcataattgcaattacttcttttatcccttcctttttctccacttatcattgctttagttattgtggtttaattactgctttgtttgttttttgttaaaagtttcatgtccattttgaaaataggtcagtataaataataaattaactatgctcaagtattgcctaatagagtttggggtttgggccttatgccccttccctaccccccacccatttttatgcctgcttcatactcactattattctcttgttactctgtagacttctcttgaccattatttgaattattcattcatttcatggcttatctgtaataaattatttgttccagacattctctctcttgtcatcccttattgctttatggttcctctgaattctgtttgctgttttaatattaactcaagccaggctattaagaatttacctgcctctattcagaaagatttgttgaaaaatattaataaagcttaattttaaaatgaactttaactgtatatgtctgtgctttcattatttatagagggtatattttattaggaaaatatgttgatttatacaaacttttacacttttagagtttatcagtgctcttgtgttgggagagaatctttgtctaacttattttctttaatgattttgtgatataagtaactatattatgcaatttaatattaaactaattatcggaatataataattttggttaaccaattttttaaattttattatgctttttaatttacagattgagtctgtgtttgtccttttgaattactattataagttcactcaaatgccaaaatctaaattattaaataattctcatgaaaggactctctattggtatcatttatattgtcagtgcctgtttagtttactttaatgggaaaactcttttaaaacttgtcatttggttcttcctagagtttaactaatttcagaatagacaagatatgctcaaattttgtcatttctccttcaaaggataggcttatgggtattttacaaacagttttaatgcttatattattgaatttattatttagtgtcaatttcatctgtaaacacttaacagtctagtttgggagatattatgagtagatagattattagcaacactcggtagtttgttgtgtatcaaatgtataatatagataatacaaaaatttagaaatggcaagaattacaaaatactgagatagtaagggaagcttttattgaggaggtggaagtcgagtcttaaaggggcataagacttagctgagagtagaaaaattgattgtaaattgtggaggagccatttttatgcatctatttttatgttatttgattgatgtcaggcacattttgatatggcctaataattaaaatagaacagaaaagttaaaaactgagatgctatttgtacttactggatttaaaaaaatttccaaccctgagagttaagtgttggtatggaggtagaataatgaaaactcttgaaatgcaaatagtctttgacttagcaatttcacttttaagtggatataatccagagaagtgttcttcaaacttttgttagtatgatccccacgctgaagtacattttacttcatgacccattatacacacatgaagtaagtttcgtataagttatttttactacatataattaaggtaaatatatgaaaatgtttatatcaaatgtgaatttactaatatttaaatacaataaaaatcttaaacatgataaaaatttagaaaataatttatgaagcatgtctgttttataagtttattcctttaactgtagtttcattgctaagaatgtgtgcctattaccttgatattttctattgtattataatccgtttaaaaaaatgccacttattgtaactaaatcgatttaatgacccattactagattgcagtctgcagtttgaaaaacactgcttgggagaaattcttggtcatgaatatttgcagtcatgctgaagagtgttcatagcagtattgtttgtatacccctttacctcaaatgggaaacagctgaaatacacactgataaaagatggataaatatagcatagttatctgatggactaatactgtacatcaagaaattgatctagttacattcattattatgaataaatttgggaacatatgttgagcaaaaatagcaagctatgtaatatgtgtaatatgatttaagttcagaagtaagcaaaactatacagcatattaaatagggacatatatctgtctttgaactataaagaaaagcaaggcaaagataagaatcagggtttcaggataatgcttacccttggagggaataagaggtactagaggataaagggtcatttatgagatatcaaagataatggtacagttgtgtttcctagctgaatgttggttacgtacaggacctctccttttacttatttttttaaaaaattatttacacactgatcacagattatttttgtatgtattcagcgtctaaattattttttaactataagtaaaataaaatcaataattaatattacacttttaaaaattagagtattggggttgggcacggtggctcacacctgttatctcagcggggccaagctgggaagattagttgagtccaggagtttgagaaggtaacatagtgagacctcatttctacaaagaaaattaaaaattagctgggttggtggcacatacctatggtccttgctacttgggaagctgaggtgggaggatcccttgagtccaggagttcgaggctgccgtgagccatgattgtgccactgcactccagagtgggtgacatgacagagcgagacctgtctctcaaaaaaaactaactaaataaaatagaatattggatatattttcactttattcctaaaatccacttttcatcataatcctggatcttcctctcattttcagtttattcccaagtcctttggagacaatttgataaggaagaaatgtgagagtataaaataaatcgatatttagggatcagcaccagtgatagatcagaaatggaataaaggtcaactgagcatattacttaaaaaaaaaaggtgtttctatcttgatgtgtctctttcttggttgacagacagaaggtgttattgagtctgacttggaggcttccaataattgtgtgaggctagatactatgtgtttaataaatattagttgaaagaatggatggattgataaaagttgaagaagtttaggaaagagatagtatcaggatatggatttcatttttagtaagttagtttgagatagtagacaatccaaagggagaggtcttgtatagctggaaatatgagattggtgattgggaaggtgagggctggattatagattagatagtctttcagacagaggaaagatcagcagccaagagaggtgctacattttctgagagaaaagatgtacagagaaacaaggaaagctaaaaattgagtctggggtacatccacctcgtaggtgtaatttaggtatctcacaggtgagaagaatgttcggttaaaaattttggcagccttaacattctaaatattctgtctacagagcaagatattattagtactaaaataaacttgccattttaaaaattttaaagtgatttatgcttttacaaaatcatagtttatcagaaaagttccttctaaatgacattcaaataaaagaataaggaattatgttagctataaatatattttctttaattagaatggttcgtaaaatcttgtttttctcctgttacacacctaaattttgaaaatttgctttctgagtatgatttaatatttaatatccagtttttatgtgttcttcaacataaataggccctgtacttgcacattttagttaaaaattcatgggcatgttacaggagatgagaattgtggtgacagacattattatgaaagctatttaatcatcacattagcaaatcaaaatgtaaaacctttaaaataaaatactgtttttcttagaaataaaagctcaccagtaatttaaatttttttccacagagagagtcagtactgaaacaggaaataaatgaccttgtaaaacggaaaattgcagtagatgaagaaaatgctttcttaaggaaagaattcagtgacttggagaagaaatttaaagataaaagtcaagaaattaaggtgtgttgacttgtacatagttttgtgggactgttgctttgaagttctgctttaagctttgttagcctttgtggcacagaaagtgacagatttggaggaaaaattgccttaggccctcctgtaccatacagttttctcacatgcaaaaactctgataaagatgctttaaagccagaactccaagctttataacttttagataaatagttaatgatggaaatggagctaagaaagtaggagtgtgaatatgtggcttcttgtaattagattctgatgggactggcattattaattgataaaacccaggtctgggaggatatgtctgtatgggtctcaaaaatagctggggacagcatcaaaggcagcttgatcaattaatgggctctttgcaaatgtgtactcatcaaagctgtcatccagtgaaaaaatatgacccatccacctgcatgaaaagaggccaataaaagtacacaggtgaccttggctatcaaatatagaagaagcttctgtgagggtaaaactgcacagtttgtatttgctgattagtgctcaccattttttgggttttttgtttcgttttgttttatttatttgcccttgtggtactgttctacaggacactaaggagtgtgtacagaacaaagaagagcaaaacagactagttataaaaaatctggaggaggaaaacaagaaattaagtacccgctgcactgacctgctaaatgacctggagaaattgaggaagcaggaagcacatttgagaaaagaaaaatatagcactgatgcaaaaataaaggtatacaataggaatggaatccatactcctcttttggatctaactttttctaggaagtttaatacatgttattttctttaacaacttatatattcatatccaccagtggggactagcattaatttatattctttcacttaagacccatagctttttaaaaattgatgttgcaaagcaggaaactgacttcaaatggttatcctaaaatgtaatcattaaaaaataaaggctattgcattttgaaagaaaatgtgttttcaaataacatatttagaatcattggttttaactttttcacttaaggcttaagcttacaaagatagctataatttgttgcagtatagtttttaagactattttctagatcctttgaaatataaagtgtaaaaaatactaaacagttaaacaatacaaatacgtggttctatggtggtgctttctttgactttaaaggtgctttctttgactttaaagggccttatttatgggaaaattttatttttatagaagataaaagttacaatcaatctttataatcttataccctttttaaaaggctaatcaagtgaggcagtggtttcttacaattttattagtatttttcaaaataatacttttttatggcattctctttgtctttagaggtttttgctaatttcttttcttattaaattacatttttttttaaactatagattttgttgaaaagggcagacacagattttagtactagtaaatatggtggtctctccatgtatatgcccctacacacacacacacacacacacacacacacacacacacacacacacacacacggttagtcaacagttacaagcagttgaccatatgtatctgcaggttctgtatcagtggatcaagctattcagaaaaaaaaaacaacacaattaaaagtaacaatacaataattaaaaaaaacaagtaaaagatacagtataacaactgtttacattgtattcagtattttaagtaatccagacatgatttaaagtatatgggaacgtgtgtagggtatttgcaaatactatgccattttatataagagacttaaagcatccatggattttggtatttggagacccctggctgggttcaatcctccaggaatactgagggacgatggtaatatgtatggatatatgtgtgtgtatatgcatgtgtgcaagaatatttaagttaggggagaaggatacatctttctcggtgtataaacctgttgcagattatttatggaaatatttaagtctattagtgcacaatcatggggtgactgagccattgagagaactgaattctggtggatttattttcttaatttttatatcagtttctgcttctgtgcagcattaaaacaaattggaagtgtgataagggtaaatcagtacttgtattaattcacagctacatgattatttggtgataatttttatttccttatttattctacttgaataatcagttctgggatttgctgtgacttgtgttacatttttttctcatggggttattgtctttttcttattgctttttgggcattcattacttattttggatactaatacttcatatcttataaataccttctgttctacagacgttgaataaagaaaactggaatttcaaaagtttgtgaattttggtagtcattttattattttcttctcaaatgtttaaaggttttatatgacaaagtttttcccaccctaaagtctttaatctattcataatttatttttggatgtgatggtccacatcatttactcaatacccacggaagcagcaagattgttcactgatcttctcccagctttctcccatgaagcatggtcataaaagaattctcatagctaccttcctggaaagtagatcttatgaccctcattcagagaggttctgtcttgtacctagagtccaagaagaatctcaacaaacaggcctttctaataagtttattttaccacagaatcatatgcctttgtcctccagtcacagttttgcacgactgtccataaaaatacacagttttccctgagtcttctggtcttcatttccaacatcttctgtgtcatgtaaaactttggttaaataaatgttatatttttctcttagtaatttatcttttattactgggatgtcagccatgaactttgccatgggtaaggaaaagatactactttttatttcctacatgtatatatattttcatttctcttgggtatatacttaggagtgagattattgggtcatatggtaactgtttttaagcttttgaggaactgctagactattttccaaagcagctgcgacagtttacattcagacactttgaggattttgatttttcgatgttcacatcaacacttgtaattgtttgccctttttgttatagccacctcaggaatgtgaagtgatatctcattatggttttttatttgttcgtttgtttgagacagagtcttgctctgttgcccaggctggaatacagtggtgtgatctcagctcactgcaacctctgccttcccgggttcaagctattctcctcccgagaagaggcaaattactacaggcgcgtgccaccacatgcagataatttgtgtatttttagtagagatggggttttgccatgttggccaggctggtctggaatcattgtggttttgatttgcattttcctgatgggaaatgacggtgagcatcttttcatgtattactatctttggagaaatgtctattcaaatcttttgtgtacatactggatccacgttctttatcaagatatatacattgaaactattttttcttaaattctttgttactttttactcttttgatggtgttcttaaaataccaggttttagtttcgataatattttatttatctactttttttggtgttacccatgcttttgatgtcatatctaagaaaccattgctaatccaaggtcatgaagattgacacctttgttttgttctaggagttttatagttttatgtcttacatttcattctttgatacattttgagttaacttttgaatatggtgtgagatacaggcctaatgtcatgcttttgtatgtgttatttagttgtttcagcaccatttgttgaagaaaattcttttttccccactgaattgtcttgataccattattgaatatcagttgactgtaaatataagggttcatttttggacctcagttctgtttatttgatctatacatctgccctcctgtctatgccacattttcttggatgttgcagatttgtagcaagttttgaaattggggtatatgtgtcctccatattttttctttttctagattagttattctgggtctgttgtattttcatatgaattttacaattatcttttttcttctggccaaaaaggccatcagagagtttaatagagattgccttgaatcagtagatcagtttggggagtattaccatctcaataatattaagaatcttctgatccatcaacatgtgatgttttccacttattttggtcttcaattttttcagttgttttgtagctttcagggtataaatttgcacttctttgggtaaatgtattcctgaatattttattatttttgatgctattgtaatcggaactgttttaaattttctcttcagatcattcattcataatgtatacatacacaattgagttttgtatactgatcttgtatcctgcaacctttctgaataggttaactaattctgattttttttttcttagtaaattccttaagactttctacgtatcatatcatgacagctgcaagtagacatagtttcacttcttcctttctaatctaagtgcttttaatttcattttatttcatacttccctgctggaaaccctggtatagtgttaaatagagaaagagtggatatccatgtcttttcaaatacctatttgccatttgtttgtcttttgagaaatgtgtattcacatcttttgtcccttttaaaatcagataattagatttttttttcacatagagttgtttgagctccttatatattctggttattagtcctttgtcaggtggatagtttgtacatattgtcccattctgttcactttattgattgccctctttgctgtgcggaagctttttaagttgatatgatcccatgtgtacatttttactttggtttcttgtccctgtggagtattactcaagaaatctttgtccagtccaatgtcctgtagagttcctgcaatgttttcttttcctttttttttatttttgaggtggagtctcgctctgtcacccaggctggagtgcagtggcaagatctctgctcactgcaagctctgcctcccgggttcatgccattctcctgcctcagcctcccgaggagctgggactacaggcgcccggcaccacacccggctaattttttgtatttttagtagagacggggtttcatcgtgttagccaggatggtctcgatctcctgacctggtgatccgcccaccttggcctcccaaagtgctgggattacaggcgtgagccaccgcagccagcctgcagtgttttcttttagtagcttcacagtttgaggtctgtgacttaagtctttaatccattgtgatttgaattttgtacatggcaacagataggggtctagtttcattcttctgcatatgtatatccatttcccagcacagttaactgaagacactgtcttcccaaaggtattttcttggcacttttgttaacagtgagttcactgtagatgtatcactatatttctgagttctctattctgctccattggtctatgtgtctgtttttatgacagtaccatgtcattttggttattatagctttgtaatatgatttgaagtcaggtgatgtgattcctccagttttgttctttttgctcaggatagctttggctactctgggtcttttgtgattccttataattttcagattaaaaaaaattctgcgaagaatgtcattagtattttgatagggattgcatagaatctgtaatggctttgggcagtatggacatcttaacaatattgattcttccaatccatgagcaaggtatttctttccatttttttttgtatcctatctttaatttctctcatcaatgttttatagtttttattgtagagatctttaactactttggttaattcctaggtatataattttatttgtagctatcataagtaggattactttcttaatttttttcagattgtttgctgttggcctatggcaatgctactgatttttgtatgttaattttgtatcctgcaactttaccgaatttatttattcattctaataggtttttggtggactcttcaggtttttccaaatataagattatatcattggcaaacaaggatgatttgactatttcctttccaacttggatgtcctttctttctcttgtctgattgctctagggcttccagtactgtgctgaacaatagtggtgaaagtggatattcttgtcatgtttcagattttagcatcaagctttcagcttttccacattcagtatcatactagcttctgggctgtcatttatggcttttattgttttgaggtatgttccttttatatccagttttttgagagtttttatcatgacacaatgttgaattttatcaaatgctttttcaccatcaattgaaatgatcatgtggtttttttttttccttttgtctttgagatggagtctcgctgtgtcacccaggcgggagtgcagtggcacgatcttggctcactgcaacctccacctcctgggttcaagtgattcttgcctcagcttcctgagtaactgggatcacaggtatgcaccaccactgggcctggctgatgtttctttttttagtagagacagggttttgccatgttggccaggctggtctcgaactcctgacctcaggtgatctgcccacttcagcctcccaaagtgctgggattacaggcgtgagccaccacacctggccaggttttgtctttcattctgttgatatgatgtatctcatgatgtatcccaatgattgatttgcatatgttaaaccatccttgcatccctaggataaattgcacttggtcatgatgaatgatctttttgatttggtgctaatattttattgaggatttttggtatcagtgttcatcaggaatattggcctgtagtttcctttttttgatgtgtctttgtctggctttagtatcagggtaatactggccttgtagaatgagtttggaagtattcccttctctattcttcagaatagtttgagcaggattggtgttagctcttatttaaaagtttggtagaaatcagcggtgaagctgggagatgtcttttctggtagactttaataaggcttcagtctcattacctgttattgatctgttcaggttttggatttattcgtggttctgtcttagtaggttgtatgtgtctatgaatttgtctattctagatttttgaatttattagcatatagttgctcatagtagccattaataatcctttgaatttctgcagtatctgttgtaatgtctactttttcatctctgattttatttatttgggtttctttttttctgagttaatctggctaatgttttgcccacttagtttatctttcaaaaaacccagtttcttttcattgttcttttgtattgtgtatttcaatttcattgatttctgctctgatctttattatttcttttcttctaattttgcattttgtttgctcttgcttttctagttctttaggatgcattgttaggttgtttatttgttaggtgcttttttgatgtagattcttacagcataaaatttgcttttagtactactttcactgtagcccatagattttggtatggtgtgtttccgttatcatttgcttctgggaatttttcagttttcttcttaatttcttcattgacctactggttattcaggagcatattgtttaatttccatgtgatgtgtcatttccaaaatttttcttgttacttatttctagttttattccactgtggtcagagaagatgcttgatataattttagttctttgaattgtttacacttgttttatggtgaacatatggcctatccttgagaacgagctacatgctgaggaaaggaatgtgtatttcgcagccattggataaaatatggtgtaaatatctattaggtacatttgttctgtagtgcagatgagtctgttgtttctttgttgatttttggtctggattacctatccaatgctgaaggtggggtgttgaagcctccagctgttattgtattggggactatctttctttagctataataatattttctttatatatcttggtgctccagtgttgggtgcatatatatttatatttgttatattcttttgctgaattgacctctttatcattatataatgatctttatttctttttatagttgttgtcttgaaatctattttgtctgatggaggtatagctactcctgctcctttttggttttcatttgcatggaatatttttttcacccttttattttcgatctgtatgtatttttataggttaggtttttgtttttgtttttttttttgacacatggtctcgctctgtcacccagactggagtgcagtggcacgatcatggctcacttcagtctccacctcctaggctcaagcaatcctcccacctcagcctcttgagtagctgaggctacaggcatataccactatatctggctaattttttgctttttaatttttgtagagatgaggtcttgctatgttgcccagactagtctcaaactcctgggctcaagtgaccctcctgcctctgccttccaaagtgctggggttataggtatgcaccaccatgcctggtcccctgaagtttcttgtaggcaacagatcattgagtcttgctttttaaaaatatatatacgtggagagtttggtctgtttaccttccgcattattagtgagtgtttgtttcatttacctgtagcattattattgataagtaaggacttactcctgccatttattatttgcttcctggttgttttgtggtcttctcttccatgttttcttccttctgtttttcttttagtaaaggtgattttctctggtggtatgatttaatttcttatttatttatttttgtatccattgtatgtgtctttatttgaggttaccatgaggcttgcatgtactgttttatcacccattattttaaactgattacatcttaacactgattgcatatacaatttaagaaacactcaaagagaaaactaatataaactctaatcttcatcctgttttgtaacattttgttctttttatttatatcttattctactgtattatgttttgaaagttgtcacagttattttggtagatttaccttttattgcttttactccagatacgagtagtttacactacaattacacttttataatactctgtatttgtctatatacttattattgccagtgagctttgttcctttgtatgacttcttattgcttattaatgttgttttttattttctttcaaattgaagaattttttttagcgttccttgtaggacagatttggtattgatgtaatccagcttttgtttgtctgggaaagtcttttgtttgaaggatatttttgatggatatactattctatgttaaaagtttttttttttccttcagcactttaaatatgtcatgacactctctcctggcctgtaaagtttccactgtgcagtctgctgccagatgtgttagaggtccattgtatgttatttgtgttttttttttttttctgctgtcagtatcctttctttatccttggactttgggattttgattattaaataccttgaggtagttttctttgggttacatctacttcatggtctataacctttttgttcttggatattgatatctttccctaggtttgggatgttctctgatattatccctttgaatatattttctagcctgacctctctctacctctctttaaggcaagtaattgttagatttgccctttcactttattttctcaatcttgtgtgtgtgcttcattctttttcctcatttttcttttgtctcctctaactgtgtattttcaaacaacccgtcttcaatctaactagttcttctgcttgatcatttctgcttttaagagactgatgcattctttaatatgtcagttacatttttcagttccagaatttctgctttattctttttaataacttcaattccttttaaaaatatatctgtaggattcttaattccttatctgtgttatcttgactgcacttcctcaaagcaactattttgaattatctgtctgaaagatcacatatctgtgtctctccacgatttgcccttggttattcatttaattcatttggtgaggtcatgttttcttgaatggtttgatgcttgtggatattcattggtatccaggcattgaagagttaggtatctattgcattctttacagtctgggattgtttgtactcatctttctcaggagggctttcctagtattcgaagggacttggatgttgtgatctatgtctttggtcattgtagccttatctgcattagagggcaccgtaagccccgtaacactgtgcctcttgtagactcatagaaatactgccttggtggtcttgtgtgatatccgggagaatttcctagattactgggcagagactcttgttctcttcccttactttccctgaaacaaatggaatctttctctatatgagctgcctggatttagtgaatgggtgacacaagcacccctgtgaccaccaacattggaaaggagctgggtcatacttgaagctagtgcagcactggttctcactaaggcccatggataccactgtgtggtttttgcctgtgtttactcagggactaaggactccacaatcagcaattcgttaatccagcaagacctgtgtccttcccttcagtacggcaagtttgccctggccatgtgtagagaagccatccgggagtcagggcctggagtcgggaaaagtaggaatctacctggtcctctattccattatggttgagctggcaaccaagcatcaatacaaagtccttcccactcttctctcccttttcttcaagccgagaagtctctccacacgtccatcacccaagggctctttagtcagcaggagatgaatcctgttgggaccaggtctctccctcagaggagtgttttttttttctggtccagggcatggttagaaatgttgttcaggagctaggtcctggaatgcgtgcctcagggcactccctggtgccttattgtaatttggctcagctggtgtctaagttgcaagactaagtcctcttaattctctactctcctttagcagaaggtacgagtctctcctggagctgtgagctgcactgcctttgcttagatgatgggtgatacaagtattccctgtgctgccctgggtggtattttattaggtcacatgcacctcacgtccactggctctgagtctagcacaccaccaagactgcctgggaattgcaatccttgtggcctagactgcctttcaagtttatttaggacctcagatcaccttagctcattgtgacagggcttgcctgaactcagattccaactgctgggttgggagatttgcttctggctagggctggtctacatgttccctccatggtgccagctgagttctgccccatattgctttctactatgacagagtagcactgagttgtagtgcaaagttccacagtccctgtgctctgcctctcccaataacacaatttctgtctctgcaccatgcagctactgttgggggatagggaaggggttgtgtgtgttacttgagactgtctgtccttccttcttcagtgcctctttctttaatacgatgttaaaaccaggtactgtgattgctcacctgagttttggttcttaagaaggtacttttttgtgtgtggatagttgttcaatatggtgttcgtgcatggagaatgattgcttgaggcttctatttagccatcttgctccacttcctctcaccaggtgtttttcattatgaagggaatattggattttgccaaatacttttacttttttttttttttttgcatctattgaaatgatcatgtggtttctctgttctttctttttttttttttttgagacagggtctcactctgtcagccaggctagagtgtggtgggatgactcagctcactgccacctctgcttcctaggctcaaacaatcctccaacctcaaccttggaagcaggtggtactacaggcatcagccatcaagccttgctaattatttgtagagacagggttttgccatgttgctttggctggtctcgaactccttagctcaaagcgattcacctacctcaacctcccaaaatgttgggattacataggcgtgagccactgcacccagcctcgtctttcactatactggtgtggtgtactctattaattgatttttttgatgttaaaccaaccttacattattgagatacctttattttacacttgctttggtataaggattatgctgtccttacagaatgagttaggatgtatttacatcctcttctagttgttataacagttttagagggtttggtattcttcttcagaagttgggtagaattcaccagtgaagctacctgtccctgaatttttcttttttgggagattttgataactgattcagtctcttcatttgttatattggttaagacttttcttgagtcagtttaggtaatccaggtgtttctagctatttgtccattttatctaaattatttaatttgatggaaaattataatttataaatatttataattataaatatatttaataatttattatataaatatagaatatatactaaataaatggaatcaaaatgtgtcactataaaaaatcaactaagaaaatcaataatagaagaaatgaaggacaaaaatgctgttttatgtatatagagaaaaaataataaaatggcagcttccttattaatacttactctaactatctaataatccattttataaggtatttagcattatgcaaacctgaacggaccagtaatgagtagcaagattgagtcagtaacaaaaagtcttcaaacaaaagcccagaataagatggattcattgtaatatatctaataattctttttattatcttataatcatttttatttctttatagttaatcatagtgttctcatgtcattttggattttagttatttgcatccttttttttctttagtaatctagctaagggtttgcaaaattgaacattcttttaaggaaataaacttctgctttgattctcaattgtttttccatcccttctccttttaaaatttcaactctaatattcattatttattttcttctatgtttgagtttagtttgctattctgtttctgggttcttaagttactaggttctcaagatacaaacttaggatattaatgagatacatctttttaaaatgtaggttcttatggctataaatttccttctgagcaactgcatttgctacatggtatagttttgtcgtgttgtgtttctttaaaattcatctctaaatattttctaattcccttgtgatttcttctttgatccattggttctttgattgttttttttgttttttttttttgagctggagtctcgctctatcacccaggctggagtgcagtggtgcaatcttggctcactgcaagctctacctcccaggttcacaccattctcctgcttcagcctcccgagtagctgggactacaggtgcctgccaccacacctggctaatttttttgtatttttagtagagacagtgtttcaccatgttagccaggatggtcttgatctcctgatctcatgatctgccttcctcggccccccaaagtgctgggattacaggcacgagctgctgcatccagctgagtgtgtttttaaatttccacatacttgtgtattttcctttttcccttctgctgtggatttctagcttcattccattttatttagagaagatcctttgtgttatattactgttttaacattttttgtcagttattttatggcttaacttatggtgtgtcctggtgaatgtttcatatgtacttgagtagcacgtttattcagctgttttgggatagagtatttcgtatatgccttctaggtgtatctagtatgtaatgttgtttaagccatctttatccttaataaccttccatgtagatgctttttcagttatttaatgtggaatattgaattttcaactattattgtaaatttttctgtttctctgtcaattctttaattgtttgctctctatattttggggctctgttgtttggtgcctacatgtttattattgttataacttctcgataagttgattattagatcttttgtctcttgtaaccatttctgccttaaagtctcttctttctgatatgattatgtctaccccagctctcttctggttactattttcatggaatatctttttccatcatgttccttttaacttgtttgtatctttggatttaaagtgagtcttttgtagataacatattgttgtagaatgttttctttatgttttatgccaatctctttttttctgactggagaatttaattcatatatatttagagaaattattaatgaggaagaactaacttctgccattttttctttttacagctttttatgtctctcatttcctctgttattgctttccttagttgattttttctagtgacacatttcgattttgtttgtttagtatatatgttattgataatttctttgtgcttaccatgtagattgcacatatctttctaaatttatagcaataaaatttgaattgatacaaagtgtttttgatagtatacaaaactgttctcctctacagctttgtccatccattttatgttattgttgtcacaagttatatcttacacatgtgtacttaatgtgtaaaaagtttatacactatttatgtagtttttatgtagtttatatagtttttatgtgtttgtttttgaaatcatataggaaataataaggataattagaagccaaataggtaatactggcttttatatttgctcacctatttacctttactagaagtctttatttcttcatatggatttgagttactgctttacatcctttcatttcaatctgaaggattccattttgcatttcttgtagtgcatctgaagtggtaatgacttctctcagtttttatttgtaaatgtcttaatttctccctttttaaggacagtttttgctggatagaaaattcaaggttaatatttgttttttccttattacgttaaatatgttatctcagtgcctctgtacttcatggtttctggcaagaaatcagcttttactctcattaaggatgccatgtatgtgatgagtcacttctttcttgctactttgaagattgtctcttttttgtaggctgaatttcaagagtttgattataatgtatctcaacatgaatctattttgttgatcttacttggagtttattgaggtttttggatttgtagattcatatctttcatcacattttggaagttttgggccatcatttattcaaatagtatttctaccattttcttggtcccttctcctgttgggattcccataatatgtgtgttggtctgcttggtggtgtcccactgatcactttttttcttttttctctctttatgctctttagactcaatgattttaattgttctatcttgtagttatctaattactttttgtgctgaaatctgctgctgaaccctctagtgaaaattttatttcagttgtatttttcagctcctgaattacttttgtgtgtgtattttgttcctttttttccctttcattgatatgtaataatctacctatttatgggctatatgtgagtgtttgttacatgcatataatttgtaatgatgaagtcagggtatttggggtctccgtcaccttgagtttttatcagttgtatgtgttggtatcatttatagtctctttcagttgcttcgaaatacatgtgacgttgttcccaagtataggaacctgagtgtgctatcaaacactagaacttatttcttccatctaactgcatattagttccaataaccaacctttatacattcccactctcccactttcccttcctagtatatggtatctatcactgtattcccaagcaccacgagataaggtttttagcttacagatgtgagtaaaaatatgcagtatttgtctttctctgcctgccttatttattgtaatgaccttcagttccatccatgctacttcaaatggtatgatttcattcttttttatgtctaagtagtattccattatttatatatacaccacattttctttatgcattactttggtttgtggatacttaggttgatgccatatctttgctattatgaataatgccacaataaatgttcaattgcagcaacctatctctttgatatactgatttcttttcctttggatagatacccagtagtgggattgtgggattgtatggtaggtctgtttgtttttttgagaaatttccatactctttttcttagttgttacactaatttacattttcaccaacagtgtataagagttctgttatatacgctgttgtatcctcacttacatctgttattttctgtccctttaataatagtcattcgaactaggatgacatgacatctcattatggttttgatttgcattttcctgatgattaatgatgctgagcatttttcatatacctgttggccatgtgtatatcttcttttgagaaatgtccatttttgtacatgttataatgtgattttttaaaaactgttgagttctttgagttccttgtcgattctagttactagtcccctgttgactgagtaatctgcaagtattttaactcattcaaaaggtttcttgctactttgaagattgtctgttttttgtaggctgaatttcaacctattttttcttttgctgtgcagaaggtttttatttaatatagttccatttctctatttttatttttgttgcctgtgcttttgagttcttaggcataaaatctttgcctagaccaatgtcttggagagttttctctatgttttcttctagtatttttctgtttccatgtattacaattaagcctttaatccatcttaagtttatttgttgtatggtgagagatgtgtccagtttcattcttttactcatggttatctagtttttctagcaccatttattgaagaggcgctatcctattctatcgccaatgtatattcttagttgctttgttgaagatcagtcagctatgaattggtggatttacttctgggttctatattttgtttcattggtctatgtgtctatatttataccaacaccatgctgtttcagttaatatatccttgtaatatgttttgaagtcagatagtctcatacctccagcttggttcttttgctcaggattgctttgggtattcaggctcttttttggttccatatcaattttagaattgttttttctatttctgtgaaaaatgatgttggtagtaatagagattgcattgaatctagattgctttgggcagtttggtcattttaacaatattaattaatctgacccatgagtgtgatatgtttttcttgtttgtgtcctcttcaatttctttcatcagtgttttgtttgtttgttttgtagagatcttaaccctccttggttaaatttaatcccagatatttatttgtgttttctgtagcttttggaagtagaattgcttttttgatttcttcttcagctatttcattactaatgtatggaaatgctacttattttgtacatgattttgtatcctgcaactttactgaatttatttatcagttctggagtttttctggtagagtcattaaaaaaagaaaaagatgtaagatcatgttgtttgcaaagagggacagtttgactttccctttttcaaactggatgtcttttctattgttttttttttttcttttgcctgattgctctgactgggacttccagtactgtgttgactagaagtggtaaaactgggcattcttgtctagtttaaattattataggaaaggtccttaatttttccccatttaataggatgttagttatatgtttgatatatatggtctttattatttggaggcatgttctttgtttgcctagtttgttgacagtttctataatgaaggtgtgttgaattttatcatgatttttctgtattaattgagatgatcagattatttttgtccttcagttcattgatgtgatgtgttacatttgttgatttgtatatattgaatcatccctgcatccctgggacaaatcccagttgaacatatttgtattatgatgttgaccatcttttcatatgcttcttggccacttgtatatcatctttggagaaatatctattgaagtccttttgttgcctttttaatctgttcattgtgtcctttgatgaacaaaagttttcaattttgaggtagtaccatctgtatgcttttggcatagtcccaattttatgtttttgcttttgttgtctatgcttttggtgtcatttgcaagaaatcattgccaaatccaaaatcatgatgtgtttctgctatgttgggaattttctagttttggcttttatattttggtctttaatccatttggaggttttttttttttcttttgtgtgtatggtgtaagggtccaaattcattcatttgtgagtagatatctagtttttctggcaacatttgttgaaaaggctgccctttagtcatcagttggtcttggtacctttgtgaaaagtgatttgagcacatatagaaatgattatttctaggctatttttcattggtctgtatatctgtatgtcagtacaatactgttttcattactgtagctttgtaatacattttgaaatgaagaaatatgagttctccaatattgttgtttttcagaattgctgtggctgtttggggttgcttaagatttcatatgaattttaggatggtattttaactttctgcaaaaagtgtcattgggatattgataaagagtgcattaaatctgtagctcacttttggcgttttttacatcttaacaacattgtcttccaatccagtgacatgagatgtctttccatttatttgtgtcctctataatttctgttaataatgttcatagtgttcagtgtacaagtctttcacccccttggctagatttatttctagtatttttttcagttgtaaatggaattgttttcttaatttccttttctggttattcattgttagtgtatagaatcttaaggttttctacatatacatgccatcagcaacaagagataattttacttctgcctttttgattaggatgccttttatttttcttgcatagttgctctggctaggacattaaataaatactatgttgaataggagtggtgagagtgggcaacctcatcttgttcctgatcttagagaaaaagcttttagtctttcactattgagtatgatgttagctataggctttttgtatttggcctttgttatgttgaagtagcttccttctattcctagttggtgggtgttcttttaatcatgaaagggtgttcaatcttgtcaaatgttttttctgtatcgagtgaaatgcttgtatgatttttgtcttttattctttcatcgtggtttatttcataaattgaattttgtatgtttcaattccccttgcattcaaggcataaattccacttggtcatgttatgtaaccttttttgctagtattttgtttatgatttgtgcatcaatattcatcagataattggtctctagttttcttctagtgttgttttctagcgttggtatcaggatgatgctctcctcatagaaggagcttgaaaatactctccgtacttcagttattggtagagtttgaggaggattggtgttaattctttaaatttttggtagaattatccagtgaaaccatctagacccatgctttgttgataggtttttgattactgattcagtcttcttacaagttactgttctgtcagattttctgttttttcatatttcagttttcataagtgtgtttctaggattgtatatacttcctttggattatccaatgtgttagaatacaattttgtatttgttagaatacagattttttagaatacagttttgtatttgttagaatacagttgttcttagtattcttagttttccatttctgcatcactttgctgaggataatggcttccagctaaatccatattgctgaaaaggatatgatttttttaactgctacatagtattccatagtgtatatgtattatattttatttatccagtctgctattgatggtcacctaggttgattccatgtctttgctattctgttgtgatgcatatacaaatacatgtgtgtttttggtagaaaaatttatttttctttggctactgagtaatcccagtaatgggattgctggatcaaatggtagttctatttttatttttagctctttgagaaatctccaaactgctttccacagtgactgaactaattttcaaacctaccaacaatgtataaacattgccttttctccacagcttctccaacatctgttatttttgactgtttagtaaaagccattatgattggtgtgagatggtatctcattgtgtttctgatttgcatttctctgatgattagtgattttgagcatttctttcatgattgttggctgtttgtatgtcttctctttttttttttagtgtaaagctcttagttgtcttttatttgcaattctagaatcatgcagcaactcattctgtaaggcagaatgtgtattcaaatgagccgatctggggaggttggttttatagacagaaaagggcagagaaaagcagaaacagaaaacaaaatgtcgtttaaaagttacttttcttgtacaactcaaagcagaggggatttggggatttctttatccagttttcactggcctgtttcgatatttgactgtttctctctcttgattttttggaaggtcaaataatttagtttctgcttggtggcctggaacttcagaatgaatgattccattttggtttggtttgttgggcctagtgcaggagctcagtccagaccaatgacctcctatacattttgtttaacattttttttttattattatactttaagttttagggtacatgtgcacattgtgcaggttagttacatatgtatacatgtgccatgctggtgcactgcacccactaactcgtcatctagcattaggtatatctcctaatgctatccctcccccctcctcccaccccacaacagtccccagagtgtgatgttccccttcctgtgtccatgtgatctcattgttcaattcccacctatgagtgagaatatgcggtgtttggtattttgttcttgcgatagtttactgagaatgatgatttccaatgtcatccatgtccctacaaaggacatgaactcatcattttttaaggctgcatagtattccatggtgtatatgtgccacattttcttaatccagtctatcattgttggacatttgggttggttccaagtctttgctattgtgaataatgccgcagtaaacataggtgtgcatgtgtctttatagcagcatgatttatagtcctttgggtatatacccagtaatgggatggctgggtcaaatggtatttctagttctagatccctgaggaatcgccacactgacttccacaatggttgaattagtttacagtcccaccaacagtgtaaaagtgttcctatttctccgcatcctctccagcacctgttgtttcctgactttttaatgatcaccattctaactggtgtgagatggtatctcattgtggttttgatttgcatttctctgatggccagtgatgatgagcattttttcatgtgtttcttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccattttgtgggttgcctgttcactctgatggtagtttcttttgctgtgcagaagctctttagtttaattagatcccatttgtcaattttgtcttttgttgccattgcttttgttgtttcagacatgaagtccttgcccatgcctatgtcctgaatggtattgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtatcatgatgccttcagctttgttcttttggcttaggattgacttggcgatgcgggctctcttttggttccatatgaactttaaagtagttttttccaattctgtgaagaaagtcattggtagatttatggggatggcattgaatctgtaaattaccttgggcagtatggccattttcacgatattgattcttcctacccatgaacatggaatgttcttccatttgtatcctcttttatttcattgagcagtggtttgtagttctccttgaagaggtccttcacatcccttgtaatttggattcctaggtattttattctctttgaagcagttgtgaatgtgagttcactcatgatttggctctctgtttgtctgttgttggtgtataagaatgcttgtgatttttgtacattgattttgtatcctgagactttgctgaagttgcttatcagcttaaggagattttgggctgagacagtggggttttctagatatacattcatgtcatctgcaaacagggacaatttgacttcctcttttcctaattgaataccctttatttccttctgctgcctgattgcctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtacaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggattcagtttgccagtattttattgaggatttttgcatcaatgttcatccgggatattggtctaaaattctctttttttgttgtatctctgcccggctttggtatcagaatgatgctggcctcataaaatgagtttgggaggattccctctttttctattgattggaatagtttcagaaggaatggtaccagttcctccttgtacctctggtagaattcggctgtgaatccatctggtcctggactcttttttgttggtaagctgttgattattgccacaatttcagatcctgttattggtctattcagagactcagcttcttcctggtttagtcttgggagagtgtatgtgtcgaggaatttatccatttcttctagattttctagtttatttgcgtagaggtgtttgtagtattctctgatggtaatttatatttctgtgggatcgctggtgatatcccctttatcattttttattgcatctatttgattcttctctctttttttctttattattcttgctagcggtctatctattttgttgatcctttcaaaaaaccagctcctggattcattaattttttgaagggttttttgtgtctctatttccttcagttcagctctgatgttagttatttcttgccttccgctagcttttgaatgtgtttggtcttgcttttctagttcttttaattgtgatgttagggtgtcaattttggatctttcctgctttctcttgtgggcatttagtgctataaatttccctctacacactgctttgaatgcgtcccagagattctggtatgttatgtctttgttctctttggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagatagttttttataatttctgttcttttacatttgctgaggagagctttacttccaaatatgtggccaattttggaataggtgtggtgtggtgctgaaaaaaatgtatattctgtatgtcttcttttgacaagtgtctgtttatgttctttgcccactttttaatgggatcatttgtttttttgcttgttgacttaagtttcttatggtttctggatgttaaacctggatgttagaaccctgttagatgcataatttgtgaaaattttctcccattctgtatgttgactgtttactctttgatagtttctcttgctatgcagaagctctttagctatgcagaagctctttagtttaattagatcccatttgtcaatttttgttgcagttgcttttgatgtcttcatcataaaatctttgccagttcctgtgtccagaatggtattgcctaggtggtcttcaaaggtttttttagcttttgttttcatatttaagtctttaatccatcttgagtatggtgtaaggaaggggtccagtttcaatcttccgcatttggctagccagttatctcagcaccatttattgaatagggggtcttttccccatttcatgtttttgtcagctttgttaaggatcaggtaattgtaggtgtgcaactttatttctgggttctctattctgttccattggtctctgtgtctgtttttgtaccaatagtaccatgctattttggttactgtagccctgtagtatagtttgaggttggataatgtgatgcatctggctttgttcattttgcttaggattgctttgtctaattgggctttttggtttcatataaattttggaatagtttttgtaattctgtcaaaagtgacgttggtagtttggtaagaatagcatcgaatttgtagattccttcatggagtagggccatcttaatgatattgattcttccaatccatgagcatggcatatttttcaattggtttgtgtcatctatgatttctcttatcagtgttttgtacttcttcttgtaaagatctttcaccttcttgtttagatgtactcctgggtattttgttattttttgtggctattgtaaatgggattgtgtttgatttgctttgcagcttgaacattattgggatttagaaatgctgctgatttttgtgcattgatttttgtatcctgaaactttactgaaattatgtattccctaggagacttttggtggaatttgtagggttttctatgtatagaatcatatcatcagtgacaaggggtaacgtgacttcttttcctatttgtatgtcatttatttttttctcttgactgattgctctggctaggacttctagtactatgttgaataggagtggtaagagtgggcatggcttctaattaaactaaagaggttctgcacagcagaagaaactagcatcagagtgaacagtcaacctacagaatgaaagaaaatgtttgcaatctaccattctgacaaaggtatccagaatctacaaggaacttaaacaaatttacaagtaaaaaacaaccccatcaaaaagtaggcgaaggacatgaacagacacttctccttcaaaagtggacatttatgatgccaacaaacataggaaaaaagcttatcagtagtcattagagaaatgcatatcaaaaccactatgagataccatctcacgccagttagaacagcgattattaaaaagttaggaaacaacagatgctggcagtgctatggagaaatagaaacacttttacactgatggtgggagtgcaaattagttcaaccattgtggaagacagtgtggcgattcctcagggatctagaaccaggaacaccatttgacccagcaataccgttactgggtatatactcaaagggttataaatcattctactataaagacacatgcacacgtatgtttattgcagcactatgtacaatagcaaagacttggaaccaacccaaatgcccatcagtgatagactggataaagaaaatgtggtagatatacaccatggaatactatgcagccataaaagagaatgagttcacatcctttgcagggacatggatgaagatggaagctatcatcctcagcaaactaacacaggaacagaaaaccagcactgcatgttctcactcataagtgggagttgaacaatgagaacacatgaacacaggaaggggagcatcatacactgatgcctgttgtggggtagtggggaaggggagggagagcattacgacaaatacctaatgcatatttcggggttaacacctagttgatgggttgatgagtgcagcaaacatcatggcacatgtatacccatgcaacaaaccttcacgatctgcacatgtatctgagaacttaaaaaaaataaaataaagaaaagaaagattaggtatctctgtatttttccagttcttaaagggaatgcttccagcttttgccagtatgatcagtatgatgttggctgtgggtttgtcgtagatggctcgtagtattttggggtgtgttccgtcaatacctagtttgtcgagagtttttatcatgaagggttgttagattttatcaaaagcttctctgtgtctattgagatgatcatatggttttgtttttaattctattttataattgagttttaaaatctaatttatctaaaggtttatcaatttttttaattttattattattatactttaagttttagggtacatgtgcacaacgtgcaggtttgttacatatgtatacatgtgccatgttggtgtgctgcacccattaagtcgtcatttagcattaggtatatctcctaatgctatccctcccccctccccccaccccacaacagtccccggagtgtgatgttccccttcctgtgtccatgtgatctcattgttcaattcccaccagtgagtgagaacatgtggtgtttggctttttgtccttgcgatagtttgctgagattgatggtttccactttcatccatgtccctacaaaggacatgaactcatcattttttatggctgcatagtattccatggtgtatatgtgccacattttcttaatccagtctgtctttgttgggcatttggattggttccaagtctttgctattgtgaatagtaccacaataaacatatgtgtgcatgtgtctttatagcagcatgatttataatcctttgggtgtatacccagtaatgggatggctgggtcaaatggtatttctagttctagatccctgaggaattgccacactgacttccacaatggttgaactagtttacagttccaccaacagtgtaaaagtgttcctatttctgcacatcctctccagcccctgttgtttcctgactttttaatgatcaccattctaactggtgtgagatggtatctcattgtggttttgatttgcatttctctgatggccagtgatgatgagcattttttcatgtgtttcttggctgcataaatgtcttcttttgagaagtgtctgttcatatccttcgcccactttttgatggggttgtttgtttttttcttgtaaatttgtttgagttcattgtagattctggatattagccctttgtcagatgagtaggttgcgaaaattttctcccattttgtaggttgcctgttcactctgatgatagtttcttttgctgtgcagaagctctttagtttaattagatcccatttgtcaattttggctttcgttgccattgcttttgttgtttcagacatgaagtcctggcccatgcctatgtcctgaatggtattgcctaggttttcttctagggtttttatggttttaggtctaacatttaagtctttaatccatcttgaattgatttttgtataaggtgtaaggaagggatccagtttcagctttctacatatggctagccagttttcccagcaccacttattaaatagggaatcctttccccattgcttgtttttctcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtatcatgatgccttcagctttgttcttttggcttaggattgactgggtgatgtgggctctcttttggttccatatgaactttaaagtagttttttccaattctgtgaagaaagtcattggtagcttgatggggatgacattgaatctataaattaccttgggcagtatggccattttcacgatattgattcttcctacccatgaacatggaatgttcttccatttgtatcctcttttatttcattgagcagtggtttgtagttctccttgaagaggtccttcacatcccttgtaatttggattcctaggtattttattctctttgaagcgattgtgaatgtgagttcactcatgatttggctctctgtttgtctgttgttggtgtataagaatgcttgtgatttttgtacattgattttgtatcctgagactttgccgaagttgctcatcagcttaaggagatttggggctgagacaatggggttttctagatatagaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagcattgttgaattttgtcaaaggccttttctgcatcttttgagataatcatgtggtttttgtctttagttctgtttatatgctggattacacttattgatttgcgtatgttgtaacagccttgcattctagggatgaagcccacttgatcatggtggataagctttttgatgtgctgctggattcggtttgccagtattttattgaggatttttacatcaatgttcatcaaggatattggtctaaaattctcttttttttgttgtgtctctgccaggctttggtttgaggatgatgctggcctcataaaatgagggaggattccctctttttctattgattggaatagtttcagatggagtggtaccagctcctctttgtacctctggtagaattcggctgtgaatccatctggtcctggactctttttggttggtaagctattgattattgccacaatttcagagcctgttattggtctattcagagactcaacttcttcctggtttagtcttgggagagtgtatgtgtcgaggaatttatccatttcttctacattttctggtttatttgcttagaggtgtttgtagtattctttcatggttgtttgtatttctgtgggatcggtggtgatatcccctttatcattttttattgcatctatttgattcttctctctttttttctttattattcttgctagcggtctatcaattttgttgatcttttcaaaaaaccagctcctggattcattaattttttgaagggctttttgtgtttctatttccttcagttctgctctgatgttagttatttcttgccttctgctagcttttgaatgtgtttgctcttgcttctctagttcttttaattgtgaagttagggtgtcagttttggatcttcctgctttctcttttgggcatttagtgctataaatttccttctacacactgctttgaatgtgttccagagattctggtatgctgtgtctttgttatcattggtttcaaataacatctttatttctgccttcatttcattatgtacccagtagtcactcaggaccaggttgttgagtttccatgtagttgagtggttttgagtgagtttcttaatcctgagttctagtttgattgcactgtggtctgagagacagtttgttataatttctgttcttttacatttgctgaggagagctttgcttcccagtatgtggtcaattttggaataggtgtggtgtgctgctgaataaaatgtatattctgttgatttggggtggagagttctgtagatgtctattaagtctgcttggtgcagagctgagttcaattcctgggtatccttgttaactttctgtctcgttgatctgtttagtgttgacggtgggatgttatagtctcccattattattgtgtgggagtctaagtctctttgtaggttactcaggacttgctttatgaatctgggtgctcctgtattgggtgcatatatatttaggatagtgagctcttgttgttgaattgatccctttaccattatgtaatggccttctttgtctcttttgatctttgttggtttgaagtctgttttatcagagactaggattgcaacccctgcctttttttgttttccatttgcttggtagatctttctccatccctttattttgagcctatgtgtgtctctgcacatgagatgggtttcctgaatacagcacactgatgggtcttgactctttatccaatttgccagtctgtgtcttttaattggagcatgttgcccatttacatttaaagttaatgttgttatgtgtgaatttgggcctgtcattatgatgttagctggttattttgctcgttagttgatgcagtttcttcctatccttgatggtctttacattttggcatgtttttgcagtggctggtaccggttgttcctttccatgtttagtgcttccttcaggagctcttttagggcaggcctggtggtgacaaaatctctcagcatttgtttgtctgtaaagtattttatttctccttcacttatgaaggttaggttggctggatatgaaattctgggttgaaaattattttttttaagaatgttgaatataggcccccactctcttctggcttgtagagtttctgccgagagctccgctgttcgtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtgtttcctgaatctgaatgttggccaaacttgctagattggggaagttctcctggataatatcctgcagagtgttttccaacttggttccattctccccgacactttcaggtacaccaatcagacgtagatttggtcttttcacatagtcccatatttcttggaggctttgttcgtttctttttattcttttttctctaaacttctcttctcacttcatttcattcatttcatcttccatcactgataccctttcttccagttgatcgcatcggctaatgaggcttctgcagtccacgtagctcttgtgccttggttttcagctccatcaggttctttaaggacttctctgcattagttgttctagttatccattcgtctaatttttttttcaaacttttaacttctttcccattggtttgaatttcctcttgtagcttggagtagtttgactgtttgaagccttcttctctcaacttgtcaaagtcattctccatccagctttgttccgttgctggtgaggagctctgtcctttggaggaggagaggtgctctggtttttagagtttccagtttttcttctctgttttttccccatctttgtggttttatctacttttggtctttgatggtggtgacttacagatgggtttttagtgtggatgtgctttttgtttgttagttttccttctatcagacaggaccctcagctgcaggtctgttggagtttgctagaggtccactccagaccctgtttgcctgggtatcagcagcggtggctttagaatagcggatattggtgacccgcaaatgctgctgcctgatcgttcctctggaagttttgtctcagaggagtacctggccatgtgaggtgtctgtcagtctgcccctactggggggtgcctcccagttaggctgctcgggggtcagggaccctcttgaggaggcagtctgcccgttctcagatctctagccgcgtgctgcgagaaccactactctcttcaaagctgtcagacagggacatttatgtctgcagaggttactgctgtctttttgtttgtctgtgccctgcccccagaggtggagcctacagaggcaggcaggcctccttgagctgtggttgggctccacccagttccagcttcagggctgctttgtttacctaatcaagcctgggcaatggcaggcactcctcccccagcctcgctgccaccttgcagtttggtctcagactgctgtgctagcaatcagcgagactctgtgggcgtaggaccctctgagccaggtgcgggttataatctggtgtgccgttttttaatcccgtcagaaaagtgcagtattagggtgggagtgacccgattttccaggtgctgtctgtcacccctttctttgactaggaaagggaactccctgaccccttgtgcttcccgagttaggccatgcctcgccctgctctggctagcgcacggtgcgctgcacccactgtcctgcacccactgcctggcactccctagtgagatgaacccggtacctcagatggaaatgcagaaatcacctgtcttctgcatcgctcatgctgggaactgtagaccggagctgttcctattcggccatgttggctccatctgtatcaatttttaaatatctcttccaaatccaactcttatttaaaattttttttctattgttttgttatttaattaaccactactctaatctttcttatttcctttcttctgctaacttttggttcaatttgttcttcttctaattgtttccaatgtgtaaatttaggttgttgagatttttcttcctttttaatgtactacatacttaacagctataaacttgcctcttaccattcctttttctgcatcccagaagttttggttttggtatgttttctaatttttatttgtctcaaggtattttctaatttctttctttcatgatctcttgtttggtcaattggttgtttaagaatgttttgcttaatttccatgtggatgaaaaatttccagttttccttctgtaattgatttctggttttattacattgtgatcagaaaaaatactttatataattttagtattttaaaaattgttgagccttgttttatggtctgtcatggagaatgtttcatgtgccattaagatgaatgtatattctgttgttgttgagtggaatattctgtattattcttttagttccatttgttctgtagtgttgttctactcctctatttcattattttggttctagaccaccacaataaagggaatattgtaataaagtgagttacacaagtgtttttggtttttgacttcatataattatattgtacatttgttttaagatttatttctggttattttatgtttcttgttggtattgtaaatgtttagttttatagaaaatcatctgagttttgcacagtcatcttttataatcttgctcaactctagctctaagtgcttacactttgtttttgtttttttggtggaagatcatattggctgctaataagaatggtttactctttctgttaatatttatatatttaatgtctgttcttttttcccttctcttagtatattacctaaaatccccaggacaattttaatataaaaccagtttgttcttgattttttaatgaacatttcaccattaattatgatatttgctgatttttggcattcatattactaaagtaagaaaattcttctgtattcctattttgttgttagtttttgtttttaaatcgtaaggtgttggattgttttggatgatttttctgactctattggcatcttcatatttttttcctttaatctcttaatgtggtaaattatattaacagattttctaatgttaaggcatccttatatttctggaaccaaatcatctcaataaattacccaaatctttcttcaatactagtatagcttattttggatttttgcatctatatgcctaagtgatattgccctgaaatgttcctttttatgtccttccctttctaacgtggataacaggtcatttcataaaatgagttgagaacatccttttaaaattctgtgtaatgtttctcacaagatgggggttattcatttattgtaatgtttatagaccttacctttaaacctttaggaccagataaggtgtttttttgagtcagcttcatataattgattaaatgtgttgatatttgtaacattttaaattatccttttgaaattttctattttttctttttttgaatttttaaatttagaatgtgtaatatagtcgcatggctcaaaactgaacaagatatagtgggaaacaatgaaaagttttaccttaattttgtattaatatcaagggcatttccttcagagaggagttctttttttttttttttttttttgagacagagtcttgctctgtcgcccaggctggagtgcagtggctcaatcttggctcactgcaatctcagccttccgggttcacaccattctcctgcctcagcctccggagtagctgggactacaggcacccgccaccacgcccggctaattttttgtgtttttagtagagatggggtttcaccatgttagcctcgatctcctgacctcgtgatctgcccacctcagcctcccaaagtgctgggattacaggcgtgagccaccgcgcccagcactatttttgttttttaccttgggagcatgatttgtgggggcgcaccataaatcatgcaccagatttgcggttcactgaccttccaaaaatggaaacccaggctggaattctgtgtgagggctagctttaggaccacctgtactaaggggtgcattttcctccttcgttttctttctttctttgcttagtattacaaatgaagttctgttacttattctggattccattctagtaatttaggtttttcatgaaaattgttctagatttgtatacttactggaaaacttgttctagtattttctaatgattaaaatacatatattatatccaccagaagctgacatttggatttctgttttcagcctatctttcttgtagtctgctttatcatgatgaatggatccaccattcacctctttgctcccaggccatatccctacgagagatctttaattcctgtttttatcttgcaactccacagacacttatcaacaggtcctgtcatttttaccttcagaatatattttaaatttgactcttcatcacctctgttattacttatcaagccaccatcagctttggctggattattttcaataatttttgatttggttcctctatgtctactcttcacgtaaaatagtagttttttcattttagctgcctggttgttccatttttgcttcataatatttgtctattttagtatattctgtatatttatagtccttttgaattggttcccatatttgcattttgctaggatagtgtcccctccctccctcccttccttccttttttccttccttccttcctctctctttcctttctgtcctttctttccttcctttctttccctccctccctccctcccttccttcctttctttcctttggtgcgatttcagctcactgcaacctccgcctcctgggttcaagcgattcttttgcctcagcctcctgaatagctgggactacaggtgcgtgccaccatgcccaactaatttttgcatttttagtagaggcggggtttcaccacgttggctaggatagtctcgatcagttgacctcgtgatctgcccgcctcagcctcctaaagtgctgggattacaggcgtgagtcactgcgcctggccagataatgtttatttctgattgttcacttcattgactctgtttttgaaggttagattttgaagggtgtgtcttgatgggaatgttttaccatcctctatttctaccctggtgttcgtttatcgcttttaagctattttgaggttcctggtactttttggtacctcagtctggagctagatcttctttccagcctgaggcatcttgtccctccctgatatttggcagaaatcagattgaatcttgagatgagcagctttacccagatcctatctgtggtgtgttaaaaaatttcttctgtgtctccagaccatagtcataatctgtttttggtttcttttttaagagtatgagagcccttctgtagtccccagtttcattttctgagtttggattctttcccctgctaagcataaaaatacatttactcctaactgtcagtagttgaacatctgccacctctgtatatgttgggcacaaagatagagtaagtttttaaaaaggcttgctttccctccctccctccttctgcccttattttctcccctctgtcttcctctccttcctccatctagttgtttataaacctttgttatttatctatcattgtcttttctttttttacagataattaggaatttctagtgctttatctaaaacttggtgtttatgtttggaaataatgaatgtatggtgtttctgttggcatactttatttagatatatatttagttctttgcaaaagtaattaaaattaattttataatatatttaaaacacctaattttaaaatcctttcacaatgaaaaatatttagagaatgatcaggaggaaaagatcagctttcaagaactttaggtaaatttcaccacagtcaagagaattgaacacgatctgagtctcaaactctgaaaaacttttttgatgtctttgaagcactgtcctttcttcttgaaatgtatctgtgtatttgcacttcaaacagagaaaacagggaaataagtaaatgtctataatttgttgtgattaatgttgaagtaaatgagttcatttttgttcagctaatgtattactttattgtacaataatttaataactacattttttatacatatcttctagtttatttgcttcagattcttaacttttacaccaagaggccatgatgtttttaagtttttgaaagaaaaaatctgtgactggtataaaagttattgtttgtgttaaaattattttaagtaagtgaaaaaattaaaactatttttctctgtcattttgtagaataattaaatataacagatgttttgttacatgtagtatttattatgtttgattattgatataagcactctaattttagacctttgaagacaatttaattgaagcaaggaaagaagttgaagtatcacagagtaaatacaatgctctatcattacagttgagtaataaacagactgaacttatccagaaggatatggatattaccctggtcaggcaagtatattcaatttttaatttaacatcatagaaatgtcattagttattcagaatgataccatttatacttattactaacaccctaaaataataactatgttttctgtggttatatatgtttgtgcattgagaatctggagttatttacactaacttgaaaaattgcctggaagaatgagtgggtctacaggattggacgagcatggtcaaggggtaccctagtttcagtttttaacaaggatattgcaatgctttcattcattgttttcttctaacatttctagccatgtgttacatgatgctcatattgttacagtgaacaatagtaactgagaaacaaattttgactttaattttattatattctatatagtttgttttaaagcagtctttctatatcaacataattgattttgtaatactattcataaagttggattacttgaaaaaggaagcacgatactcttgtatttctgttttttaaagatgttaaaactattaatttactttgtaattaccttttccagaaaatagtatgagagagaataaattaagacagaacttttccttggttcatagatcaatatctatctatctatctatctatctatctatctatctatctatctatctatgtatctttctatctatccatccatccacatgcatgaaaggacatgcatgcatgtttgtatttattttgcatgcatgtgtttatttattttggtagcaccagagcatgggatcgaagatatgcttctagaggtatataatagagtttgattgtataatttattttaatttaaaaactaagtgataaataaatgatggatacatcactgccattctggtacacattgggtggagttctttggtaaaacttgtctgggaattttccttcatgttagtgggcattggtaagggggtcaagttagtgctgtttatgacgtagtttttatagttccattaggcaaaatacagttttgtaaatttaaatatgccattgtgaatttagtttggatgaaaactgtttaccattactgaagccaataaagttaaaatgaattaggacattaacagattccttgtatcacattttaaaaactttctcatcataagggtgaggaaaagtataaactttatagatgatagactggttaacatatcaactcatgttataattatttttaaaacaataacgaagtcagaaaagtaattctaaataggaatagaatcttagatttggatgaaatttaaaaattattatttattcttatcctcttcctagtaagattgcatagcgtttagtctttccttgaaaacttagtttaaaagtttctgatgcttttcaagactgctattttcattttatattgtttaaatttttgaacattgttttacatgtacttagttgaaatttgcctttttataattcccacccatttattgtagttttattatctggagaatctcagaaaccatctaatccctattctgtaacatagctcagtggtctcagacatttatcaatgacaacattttttcactaattgatcaactactcctatttcttacataaactctccatgtacatatttcacagatgttatcatgttttgggttacctttctgactgttttccatattgtcaatcttcttaaaatataacatctggaactgcataaaatatttcaacaaagacctttacattttagagtatgatggtgctaggctattagaacaaacatggtgttcattctaggatacagtgcagtgttaaggacatgggatataacaactatgttttcttctacattttgcgtgagtttgtatatttaaatttagtgtattgcaagagctgtaagttattataaataaagcaagaatatccttgcatgcactttttcttatacaatagtaaaagaataatagctagtgggccatgtgtaattctaagagtttgattataaggacctatagaggcatatggcctatgtgaattaatgcaggaacaaaaaaccaaatacttcatgttctcacttataagtgagagctaaacattgggtacccatcgacataaacgtaggagcagtagacactgtggactactagacggtgaagggagtgagggtgcatgggtggaaaaatctacctgttggatactatatttaccacctgggtaacaggatccataccccaaatgtcagcatcaagcaatatagccaggtaatagtactacacatataccccctgtatctaacataaaagttgaaattttgaaaataaggactcacagaggagaagaataatagcacagagttggtagtttggagcagtggactttctcttgaatcctcattatagggtagtagttgagatgtctacagtgtgtctcctaagttatcttgtatgaggattactgttggatatactgtgtgtcttgtttctttcatcattatttcactgggagagggtggttatgatataccagtcccagtttattgaatctttatgttgtaatcaagacatatgaagccataattgtggaaaaagtggtctaggcactttcttatttggatacacttttcctcactgataaatgatggagctactgtttctgtatggatttccttctttgaagttcatagtcatttatattttattgaatatttgatccatgtcacccattgtgctaaaggatatttttgtgaactctacctcaaatgatttttgcctaggttacagtataaataagtatatacagtcattccttggtatctgtgggggattggtttcaggcctcaatatggatactaaaatctacagatgctcaagcccttgatataaaatggcagtatttgcacataacttatgtgcatcctcctgtatacttcaaatctttagattgcttatattaatagtatcaaatacaatgtaaatgctatataaatagttgttatactgtattttttgtttgtattgttttgttgttatatttttaaaattactgtttttgatctattgttggttgaatttgtggaagcagaaaccacagatatggaagtccaactctatgcatatataatgatgtacatgtctgtaatctgtatagagcatatgaatatatttacctagccattgcattaaaaaggataactaattaaattgcctaaccaaaacttttacctgatggtaatgatggagctactgtttctgtatggatttccttctttgaagttcatagtcatttatattttattgaatatttgatccctgtcacccattgtgctaaaggatatttttgtgaactctacctcaaatgatttttgcctaggttacagtataaataagtatatacagtcattccttggtatctgtgggggattggtttagatggggtagatggggtagaaccattacctaatggttctacaattgagatgagaatttttgttagaaattgagtcaagacagtgcagtcataattttggttcagaaaatcttcagacagaatcctgaaattggattaatacatctggattgctggttttctcagatgcttagcagaagcaagtgagttttctttggagaatgataaaataatctggacttaaattatatctaaagttttacaaaatagggtctagcacatagtcagaaataacaagtatgtagtaaggaaagaagaataaaaagatataagacctagaaatgaaagcagaaatcctagttatttggtaaaacatgattaattcacgtagagaacccaaaataatttatatatagtttaaactaataagtttatcatgcttggtggatacatggtcagtatataaaacttaattgcatcttttataccagcgaaacatattaggaaataagaatttacaatattactggaggtatgaagtgcacatataatgaaaaatgtgtattacctctattcagagaattctacaaatgttgagaaaaatagaaggtgtaatatattcagggaaatatcaaagttcatggtttggaagactcactatcataaagataccagttctctctgaatagatattagattcagaaaatgctgaccatcgattatcaacaacaggaaaccattaccacccttagccagaagggacaagaattagtatcctgtgacggaagctgcccaataagaccaataaccttagacagaggaacacaggcactatcaaactgtggctcagcagagagtgagctgggtaaataaatatccggacctctttctcctttaccctggaatcaccagctagtgcctccaactgatgaaattcagtcacagccagagaacaaggagcagtataactagtctgtagagaggttgggctcttaggctaagcagagtagagatgatgaagactggcccattctcagttactactctttttcagaacttttctggccattattccctgttagtttttgcatatgaactttagagtaaacttgcttattttttctttggtatgttagtagcacataaaatttacaataatctaagaagaattgacatctttatgatgttcagtcttcttgtcccagagtgtggtgtgtcattccatttgtttcagtctacctctgtgtctttcctcaaacagattttgaacatttctcatcaaatttattcctagctctttcatgtttcttgttactattttaaatgtaatttttccttcccatataattttcaaatgatttttcttttactgcatatagttttactgtacagcttttttggtggataaaaataagttgttttgtttttactgtgaactgtgctatagttattttggtataaatgataaacgtgaattatgtaaaaataaatacatgcagtacagaaaagtacaaagaaggtaaaagaaaaaaacgttagactaaaaatgcatccctagagaattaacagccataaaattctgtgagcattgttctacatttttctcagtcctgatttataaattgaagattgggtagacagatgtttttaaataaaagggactatattgcacatgttcttttggtaactaataattttaggtttttttttcatataatgaaacaataaggctctctgatgtgaaattgaggagattattacatcttagataattattttttctctataaggaacactatctttctaaaactaagaacaaactgatacgaaaaaccttggcgattcatgttattatttttttttaaactacatttcatctgtagttgattttggcactctgctctgtatactctggaaataagcacataaattcaaccattttgactccccccaatttgtatcttaagaattacagcatttatcttctcttgtataaccacagtgaacacagatgtttaggcataattctatatagtacttcagtgttcatcactaaacttttttactcttgatttgttcattccatcctgtttgttttgattcatctcatgagcccatttttaccagggccttccctattgctaccatatgcttttctgcccctgttggcatccaatttagccatgtgacttattttggccagtgaaatgagaggctttgcaaatgttttaaaggagccgttgtttgatttgcctttgcttttcacctttttccaggagaacagcctatttccactatagtctgatgctccagtttggttcttagaacagagaaaagcaaatgtaatgtgaagaagccatagatctttgtttttggaaggtgtcaggtttttttttttttcctgcagaattatgtagagcagctgctcgaaaccctctgttagtgtttcctgtcaaacctggtctttaaagggatagtcctaatttaatcacatggcctactcaactcctgagacagcatcactgcaatggtttgaatatttgtcccatccaaagttcatgttgaaatttagtcctcagtgtgggacattgggctctgccttcatgaatgaattaatccaattctcatgaatgaattaatccactcaggtattaatgggttattatgggaatgcgactgttggccttataagacgaagagagacctgagctagtatgctcagcttctttgccatgtgatgtctggcactgcctcaggactctgcatagagtccccatgaggaagaaggtcctcagcagatggaacccttcaaccttggacttctgtaagaataactgtaagaaataaattcctttttctttataaattacccagttttagggattctgttataagtaacaaaaatggactaaaacaatcactagtaactgaaagattattagatttatatttcagcagtaaaatatattctacagaacttaacatccttcatgaggtgggaagaagtattgttggttctcagtatcttctctttcaactaacctagattgtccttaattccctttgatctgtatctagaggaacttctcaagtttgaacctaacaattttatgttccataactttgattttgcttataactactctcattatggatttaaagctatgatggcatttttttttctttgtatcaatccttttttattatctttttcatttcattcattcaacaactgtttttacatagcctagtaaacagggcctgagtcacggattacatactgattacttgggagattcacttccagtacagagtgggcaaaagtacaagaatctgaggcagggaaggataaaaagtaattcgaggtaatgcattgttgttctggccattgcttcatgataaaccgtgaagacatcaggtcactgacttagccacccaagaactgagaaactgtgccctagagcaagccatcagatggaagaagataatttatctctctggtttccttttgtgttttgtcttccagtttgttgttcataccatcccctgtatagtagcattgtttatcccagtctggaaatggtaaatgcagaaaaagactctaggcatgcagctggttatcctcacgtgatggagtcatttgaactgtatatatctggtaggctgatgtagcaattagtaggctgaggcagagagatggactcaaaattctagtagctagctgaggttgaatctcaaaagatgcataagacacatatttaataagagacaggaactgtcctaggtgctctgtttatagcagtgaacaaaaaaagttcctgctctcacagagatgtccttacatcttggctttctattggtatttcacagcggcataatggcttattttttgtactttttcttcacttttcttctaagttcttatgttactcctactgagaggtatactcttcctctaagtattcacaattgcatttcgtttttcttaattttattacccccattccttttagatgtcctgttattttattttattttttaaaaattaattttgtttcaagttccaggatacacgtgcaggatgtgcaggtttgttatgtaggtaaatatgtgccatggtggtttgcagcacctatcaatctatcacctaggtattaagccccacatatattagctatttatcctgatgttctccctctccccgcacaccaccctccccactgacaggccccagtgtgtattgttcccctacctgtatccgtgtgttctcattgttcagctcccactacgtgcagtgtttggttttgtgttcctgcgttagtttgctgacgataatggcttccagctccatccatgtccctgcaaaggacatcatctcgttcctttttatggctgcatcatattccatgttgtatatgtaccacattttctttatccagtctatctttgatgggcatttgggttgattcaatgtctttgctattgtgaatagtgctgcaatgaacataacacgtgtatgtatctttataatagaatgatttatattatattgggtatatatacccagtaatgggattgctgggtcaaatggtgtttctggttctaggtctttgaggaatcgccacactgtcttccacaatggttgcactaatatacattcccaccaacagtgtcaaagcgttcctgtttctccacagcctcgccagaatctgttgttccttgactttttttttgtttgttttgagacgaagtctcgctctgttgccaggctggagtgcagtggagcgatctcggctcactgcaacttatgcctccccagttcaagcaattcttctgcctcagcctcctgagtagctgggactacaggtgtgtgccaccatgcccagctagtttttgtatttttagtagagatagggtttcaccatgttggccaggatggtctcgatctgttgaccttgtgatctacccacctcagcctcccaaagtgctgggattacagagtgagacaccgtgcctggctgacttcttaataatatccattctgactggtgtgagatggtatcttattgtggttttgatttgcatttctctaatgatcagtgatgttgagctttttttgatatgtttgttggcatcataaatgtcttcttttgagaagtgtctgttcgtgtcctttgcccactttttaaatggggctgtttgtttttttcttgtaaatttaagttccttgtagattctggatattaggcctttgtcagatggatagattgcaaaaattttctcccattctgtaggttgcctgttcacttgatgatagtttcttttgttgtgcagaagctctttagtttaattagatagcatttgtccatttttgcttttgttacaattgcttttgatgtttttgtcatgaaatctttgcccgggcctatatcctgaatggtttcagtagatttccttctaggatttttgtacttttgggttttacatttaatgagtctttaacctatcttgaattgatttttgtataaggcataaggaaggggtccagtttcagttttctccttatggctagccagttttcccagcagcatttattaaatagagaatcctttccccattgcttgtttttgtcaggtttgtcaaagatcagatggttgtagatgtgcggtcttatttctgagatctctgttctgttctattggttcatgtgtctgtttttgtaccagtaccgtgttgttttggttactgttgccctgtagtatcgtttgaagtccggtagtgtaatgccactggctttgttcttttcgcttaggattgtcttggctatacgggctcttttttggttccatattaattttaacgtagttttttctaaatctgtgaagaatgttaatggtagtttaataggaatagcattgaatctataaattactttgggcagtgtggccattttcacgatgttgattctttctatccatgagcatggaatgttttttcatttgtttttgccctctcttatttctttgagcagtggtttgtagttctccttgaagaggtccttcactctttcacttctcttgttagctgtattcctaggcattttattcttttcttagcatttgtgaatgggaagttcattcatgattgggctctctgcttgtctattgttagtgtatgggaatgcttgtgatttttgcagttgattttgtatactgagactttgctgaagttgcatatcagcttggaaagcttttgggctgtgatgatggggttttctagatatagaatcatgtcatctgcaaacagagacagtttgacttcctctcttcccatttgaataccctttgtttctttgtcttccctgactgccctggccagaacttccaatactatgttgaatagaagtggtgagagacagcatccttgtcttgtgccagttttcaagggaaatgtttccagcttttgcccattcagtatgatattggctgtgggtttgtcataaatggctcattattttgaggtatgttccatcaatacctagtttattgagcatttttaacatgaagcgatgttgaattttatcgaaggccttttctgtgtctattgagatgatcatgtgtttgctgtctttagttctgtttatgtgatgaattagatttattgatttgtgtatgttgaaccagccttgcatcttgggaatgaagctgacttgatcgtggtggataagctttttgaatgtgctgctgtattcagtttgccagtattttattgaggattttgtttgtttgtttgtttttttgagacagagtttcgctcatgtttcccaggctggagtacaatggcgtgaccttggctcactgcaacctccacctcacagattcaagcacttctcctgcctcagcctcctgagtagctgggattacaggcgcttccagtatgcctcgctaatttttgaggattttgcatcaatgttcagggatattggcctgaagtttttattttctcagggtttggtatcaggatgatactgacctcataaaatgaattagggagcagaccctccttttcaattgtttggaatagtttcggaaggaatggtactagctcctgtttgcacctctgatagaattcagctgtaaatccactggtcatgggcttttttttggctggtagggtatttgttactgccccttcagaacttgttattggtctattcagggatttagcttctccctggctcagttttgggagggtgtatgtgtctaggaatttatctgtttcttctagattttctagtttatttgcatagaggtatttatagtattatctgaaggttgtttgtatttctgtggggtcagtggtgacatcccctttatctttttttgttgtatctatttgattcttttctcttttcttattagtctagcttgcagtctatccattttattaattttttcaacaaacggcttctggattcattgatttttttggaagggtttttcatgtctgtatctccttcaattctgctctgatcttggttatttcttttcttctgctagtgttgtggtttatttgctcttggttctctatttcttttagttttgatgttagggtgtcaacttgagatttttctagctttttgatgtgggcagttagtgctataaatttccctcttaacactgctttagctggatcccagagactctgtgtgttgtctctttgttatcattggtttcaaagaacttcttgatttctgccttaattttttttttttttaattatactttaagttttagggtacatgtgcacattgtgcaggttagttacatatgtatacatgtgccatgctggtgcgctgcacccactaactcgtcatctagcattaggtgtatctcccaatgctatccctcccccctccccccaccccaccacagtccccagagtgtgatattccccttcctgtgtccatgtgatctcattgttcaattcccacctatgagtgagtatatgccgtgtttggttttttgttcttgtgatagtttactgagaatgatgatttccaatttcatccatgtccctacaaaggacacgaactcatcattttttatggctgcatagtattccatggtgtatatgtgccacattttcttaatccagtctatcattgttggacatttgggttggttccaagtctttgctgttgtgaataatgccacaataaacatacgtgtgcatgtgtctttatagcagcatgatttatagttctttgggtatataccaagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtttcttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattgtctcccattttgtaggttgcctgttcactctgatggtagtttcttttgctgtgcagaagctctttagtttaattagatcccatttgtcaattttgtcttttgttgccattgcttttggtgttttggacgtgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccacttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaggaaagtcattggtagctttatggggatggcattgaatctataaattaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcagttgtgaatgggagttcactcatgatttggctctctgtttgtctgttgttggtgtataagaatgcttgtgatttttgtacattgattttgtatcctgagactttgctgaagttgcttatcagcttaaggagattttgggctgaaacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagcgttgctgaattttgtcaaaggctttttctgcatctcttgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattcaggatttttgcatcaatgttcatcaaggatattggtctaaaattctcttttttggttgtgtctctgcccggctttggtatcagaatgatgctggcctcataaaatgagtttgggaggattccctctttttctattgattggaatagtttcagaaggaatggtaccagttcctccttgtacctctggtagaattcagctgtgaatccatctggtcctggactctttttggttggtaaactatcgattattgccacaatttcagctcctgttattggtctattcagagattcaacttcttcctggtttagtcttgggagagtgtatgtgttgaggaatttatccatttcttctagattttctagtttatttgcgtagaggtgtttgtagtattctctgatggtagtttgtatttctgtgggatcgctggtgatatcccctttatcattttttattgtgtctatttgattcttctctctttttttctttattagtcttgctagtggtctatcaattttgttgatcctttcaaaaaaccagctcctggattccttgattttttgaagggttttttgtgtctctgtttccttcagttctgctctgatgttagttatttcttgccttctgctagcttttgaatgtgtttggtcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttattgctgccttcatttcattatgtacccagtagtcattcaggagcaggttgttcagtttccatgtagttgagcggctttgagtgagattcttaatcctgagttctagtttgattgcactgcggtctgagagatagtttgttataatttctgttcttttacatttgctgaggagaactttacttcccagtatgtggtcaattttggaataggtgtggtgtggtgctgaaaaaaatgtatattctgttgatttggggtggagagttctgtagatgtctattacgtccacttggtgcagagctgagttcaattcctgggtatctttgttgactttctgtctcgttgatctgtctaatgttgacagtggggtgttaaagtctcccattattaatgtgtgggagtctaagtctctttgtaggtcactcaggacttgctttatgaatctgggtgtcctgtattgggtgcatatatatttaggatagttagctcttcttgttgaattgatccctttaccattatgtaatggccttctttgtctcttttgatctttgttggtttaaagtctgttttatcaagagactaggattgcaacccctgcctttttttgttttccatttgcttggtagatcttcctgcatccttttattttgagcctatgtgtgtctctgcacgtgagatgggtttcctgaatacagcacactgatgggtcttgactctttatccaatttgccagtctgtgtcttttaattggagaatttagtccatttacatttaaagttaatattgttatgtgtgaatttgatcctgtcattatgatgttagctggttattttgctcgttagttgatgcagtttcttcctagtctccatggtctttacattttggcatgattttgcagcggctggtaccagttgttcctttccatgtttagcgcttccttcaggagctcttttagggcaggcctagtggtgacaaaatctctcagcatttgcttgtctgtgaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctggaggagtgtctttgtggcgttctctgtatttcctgaatctgaacattggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaccttcccttctcacttcatttcattcatttcatcttccattgctgataccctttcttccagttgatcgcatgggctcctgaggcttctgcattgttcacctagttctcgagccttggttttcagctccatcagctcctttaagcacttctctgtattggttattctaggtatacattcttctaaatttttttcaaagttttcaacttctttgcctttggtttgaatgtcctcccgtagctcagagtaatttgatcgtctgaagccttcttctctcagctcgtcagaatcattctccatccagcttttttccgttgctggtgaggaactgcgttcctttggaggaggagaggcgctctgcatttaagagtgtctagtttttctgttctgttttttccccatctttgtggttttatctacttttggtctttgatgatggtgatgtacagatgggtttttggtgtggatgtcctttctgtttgttagttttccttctatcagacaggaccctcagctgcaggtctgttggaataccctgccatgtgaggtgtcagtctgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcctggctgctttgtttacctaaggaagcctgggcaatggcgggcgcccctcccccagcctggctgccgccttgcagtttgatctcagactgctgtgctagcaatcagcgagactccgtgggcgtaggaccctccgagccaggtgtgggatataatctcatggttcgccgctttttaagccggtctgaaaagcgcaatattcgggtgggagtgacccgattttccaggtgcgtctgtcacccctttctttgactcggaaagggaactccctgatccctcgcgcttcccaggtgaggcaatgcctcgccctgcttcggctcgcgcatggtgcgtgcacccactggcctgcgcccactgtctggcactccctagtgagagaaacccggtacctcagatggaaatgcagaaatcacccgtcttctgtgtcgctcatgctgggagctgtagaccggagctgttcctattcggccatcttggctcctcccctgatttctgccttaatttcattatatacccaggagtcattcaggagcaggttgttcagtttccatgtagttgtgtggtttgagtgggtttctttatcttgagttataatttgattgcgctgttttctgagagactgttatgatttcagttcttttgtatttgctgaggagtgttttactcccaagtacgtgactgattttagagtaagtgctatgtgctatgtgtcgccaagaagaatatatattccattgtttttgggtggagagttctgtagatatttatcaggtccacttgatccagagcttagttcatgtcctgaatatccttgttaattttgtcttggtgatctgtctaatattgacagtggggtgttaaaagtctcccactattattgtgtgggagtctaagtgtctttgtaggtctctaagaacttgttttatgaatctgggtgctcctgtgttaggtgcatatatatttaggatagttagcagttcacattgaattgaaccctttaccattatgtaatgcccctctttgtcttttttgatccctgttggtttaaagtctattttgtcagaaactaggattgcagcccctgcttttttctgctttccatttgcttggtatattttcctccattcctttattttgagcctatgtgtgtctttgcatgtgagatgggtctcttaaatccagcacgttgatgagtcttgactctttatccagcttgccattctgtgtcttttaatcggggcatttagcccatttacatttaaggttaatattgttgtctgtgaatttgatcctgttatgatggtagctggttatcagacttggtgatgtagttgctttatagtttcattggtctttgtacttcagtgtgtttttgcagtggctagtggtggtttttcctttctatatttagtgcttccttcaggagctcttgcaaggtaggcctggtggtgactaattacctcagcatttgcttctctgaaaagtattttatttttccttagcttatgaagcttagtttgactggaaatgaaattcaggattggaaatccttttctttaagaatattgaataatggcccccaatctcttctcgcttgtagggtttctgctgagaagtttgctgttagtctaatgggtttccctttgtaggtgatctcccctttctctctggctgctgttaacattttttttcccttcattttgaccttggtgaatttgatgattatgtgtgttagggctgatcatctcatggagtatcttacgagggttctttggatttcatgaatttgaatgttggcctatcttgttaggttagggaagttttcctagatgatatcctgaggtatgttttccaccttggttctgttctccccatctctttcaggtatccaagtcagtcataggttcggtctttttacataatcccaaagttcatggaggttttgtttcttttcattcttttttctctcgtcttgtctgccttgtcttatttcagcaagataggctttaagctctgaaattctttcctctgcttggtcagtttggctgttgatacttatggttgcattgtgatgttctcaggttgtgtttttcaactccattaggttatttatgttcctttcaaactaattattctggttaacagctcctgtaatgttttatcatggttcttagcttctttgtattgggttagaacatgttcctttggctcagctaagttcattgttacccaccttctgaggcctacttgtgtcagttcatccatctccacctccgcccagttctgtgctcttcctagagaggtattatgatcatatggagaagaggcactttggctttttgaattttcattgattctttctcatctttgtgagtttacctagctttgatctttcagtttgcgaggacctttttgttgatgctgttattgttgttgctttctgtttgtttttcttttgacattcaggcccctcttccggagggctgctgtggtttgctgggggtcactccagaccctattcacttgggtcccttctgcacctgcaggtatcaacagtggaagatgcagaatagcaaagatggctgcctgctacttcctctggctgggatcttcgtcccagaggggcaccaacctgatgccaacaggaatgctcctgtataagttatctggcaacccctgttggggtctcacccagtctggaggcaggggttctgggatctgcttaatgaagcattctggctgccccttggcggagcgggtgcgctgtgctgtggcgaatctcaatcatctggactgcctggattcctcagagctggcagggggaaagtctaagtctgctaatctgtgaatactgtggctgcctctcccactagaggctcagtcccagcgacatcagagttctgtccctaaacccctggctgcagttgctgaaattcctgcaggaaggtcccacccagtgaggagggatgggttagggttccgcctgaagaggcagtctggccatgatctgccatagccatagccactgtgagtgctgtggggaattccatctgggtccaaaccatctagtcttcctggcactggcaggggaaaattggcagactggagctgcagtgatggctgccaccccttgcccctactccccgggaactcaggcatcttaggcaaaaggcagggtggtgatgatgacctccccttccattaggaagttggtagtcgtaggtagtcaccagcccattggctgctgagaggccaccaagaggctgccgagaatctggacagctctgcacttgggacccaaggccctggtggcatgggctcattgggggacctcctgatctgtgggtagcacggatccgtggaaaaagcgtggtttcccaggcagggtagtagtgtgtccagaattggtgcgttcttggtctcactgacttcaagaatgaagccacggacccttgcggtgagtgttacagttcttaaaagcggcgtgtccggagtttgttccttctgatgttcagatgtgtttagagtttcttccttctggtggattcgtggtctcgctggcttcaggagtgaagctgcagaccttcgagtgttacagctcataaaggcagtgtggatccaaagagtgagcagcagcaagatttattgcaaagagtgaaagaacaaagcttccacagtgtggaaggggacccaagggggttgccactgctggctctggcagcctgcttttattgtcttatctggccccacccacatcctgctgattggtccattttacagagagccgattggttttacagagagctgattggtccattttgacagggtgctgattggtgcgtttacaatccctgagctagacacaaaagttctccaagtcccactagattctttagatacagagtgctgattggtgcatccacaaaccctgaggtagacacacggtgctgattggtgtgttcacaaaccttgagctagatacagagtgctgattggtgtgtttacaatcccttagctagacataaaggttctccaagtccccactagactcaggagcccagctggcttcacccagtgtatcccgcacaggggccacaggtggagctgcctgccagtcccgtgccctccaccagcactcctcagcccttggatgggactggctgccgtggagcagggggcagagctcgtcggggaggctgtggctgcgcaggagcccaccgcggggggagtgaggggagggagggggggagggtgggggggagtgggcgaaggggggagggcggggaggaggggggagggcggggaggagggaggagggcggagggagtggggggaggggggagtggggagtggggggagggcgggggggagtggggggagggcgggggaggctcaggcatggtgggctgcaggtccccagccctgccgcacagggaggcagctaaggcccggtgagaaattgagagcagcgccggtgggccaacactgctgggggacctggtgcactgtccgcggctgctggcctgggtgctaagcccctcactgccgggctggcggggctggctggccgctctgagtgcgggccgccaagcccacgcccacccggaactctagctggcccgcaggcgctgcacgcagccccagttcccgcccacgcctgtccctccacacctccctgcaagctgagggagccggctctggccttggccagccaagaaggggactcccaaggtgcagcggcgggctgaagggctgctcaagcgccgccagagtgggcgccgaggccaaggtggcgcggagagcgagccacgactgcgagggctgccagcacactggcacctctcagtaggtcgatcactcaccatttcccttggctggtggtaggagctcgcattactctgtgtggctcccaggtgggccgtcgcaccaccctgcttttccttgctctctgtgggttgtgccagctgcctagtcagtcccaatgagagaacttgcatacctcagttgccggtgcaggattcactcattgtttttgttcttcttggtggggggcctccgaccacagctgtttctagtcggccatcttggcccgccctgtttttctttacttattttcaaatgaggaaagatctggacaaattcagtgctttccgctggttcagatgtgtgagttgtgcgagctttgcttgctttttgtatttgcaacattggtgtacatatcatcacttgtactttcccgagggttgtgtggggcgatagaaataaacatatctacatagtataagagtatccttcaattccacttattgagagcatgcccagaaaataccatgaggtggtagagaaaaatgtgctttttcccaggttgatttttaatttgcaaagagtaataatagtatgagcatctccctactcttcagtgagagagagagagagagagagagagagagtgtgtgtgtgtgtgtgtgtgtgtgtgtgtgtgtgtgtgtgttagatggagtctggctctgtcacccaggttggagtggggtggtgcgatctcggctcaggatcaaatgattcctctgcctcagcctcctgagtagctggaactacagatgtatgctaccatgcccagccaatttttgtaatttttgtagagacggggtttcactattggtcaggctggtctcgaactcctgacctcaggtgatccatctacctcaggtgatccacctgcctcggcctccaaagtgctgggattacaggtgtgagccatcgcaccctgcctagtgtgtttcttttgactaaagatacatatattttgttgtacgttgtccttaaatgcagaccagctacggattcgggccttctcattaagaaataccaaatgtcttctaacatgggaatataaataaatttgctatgttttaacactgtattgaaagatgatatgttttatcttcatcatgtctcttttctaaatgtgacatttttttaggcctcctggctaacgtatcttaactgtgatggaattttctcctgccctgttgcgtatttcctttgataatttttgctaatgttattagtgaaaaatggcagtaatcatcatgcatgattactgtgggtcttttttcccctcctcttgtattacatttcctgaaggcattgtgccattattggttctcttctctcccctttcccgtttttgactgctattttctgcatgtttcagttttttgaattgttacaggaaaattgtgtatatccatgtatctgtatggatgcaggggttgtggttgtggtttgagaacattaatgttctaaatctctaaggagcggaactccttgctcccatactaattttcatccatgttcaacaactgtctccgtatctcttttattccttctttcttttaagacattttatgtgaatgaatgactagtttaaagttataggtaaaaataagttccattaagaaatacaatcttcaaaatattatgtaagtacaatcggcctttcatatccatggattccatatccacggattcaaccaatcatgaattgaaaatatcaggtgaagaaaaatgagtggttgcatctgtactgaacgtgtacagacttttttcttgtcattattccctaaacaatacagtataacattatttgcatagcatgtactttgtattaggtattataagtaatctagagatgacttaaagtatttggatgtgcatagattatattcaaaactacatcattttatataaggacttgagcatctgtaaattttcatattcaaagtgggtcttgaaaccattctcccatagataataagagactactgtttatagtatattttgatgtaatagtgctttataaatatttctcggttcaaattaattatacaaaagaattcccagtttgtataatctgtatcacacaggattcacaaccacagcaatctggaaacctctatctcaaaggtgtagttctcctagactcttagtgccatcattaccaccaccagttcatttgtcctcctgcttatcagtttcatcctgggtaggttcgaaggactggatttttcttgtgactttctgactcttttacctcatcagttccttcaagctgagttagaggagtcacaagtatcccagcccaggaccctgaggttacaaactagaattggcagttgtgctttaaggaactttggtttgaaaacttaagtttgccctttgggattctttttaatatatttaaagttctgtatagtaatataaaatgaaaggttgacgtaccctttgttcaaaactgtctaataactatagctgatcttaccacttgttaattcttgaaactgaagtgtttacttaaataaaaggttgtactatgtatatccatggtttttattactataaagctacaaaagaaaattaatatgtatctggctttgaaagtcatagtcgttgtatcaatactttctgtgtgtatgtgataaatattaaatatgtcattatttcttttattaataagtttgcctgcagtacaaataacagatgcaaaacaggatgccaatctgtaaccttagatgaacacaattatttaactgagatgatctttatccatacttttctctatttattgcttgctttgcacaggaaggaactgcaggagctgcagaatctttacaaacagaacagtacacatacagcccagcaagcagagctgatccagcagcttcaggttctcaatatggacacacaaaaagtactgagaaatcaggaagatgttcacacagctgaaagtatatcatatcaaaaagtatgcttttattctgtaataaagatgtaaatgtttatgtatgaacttatgaacatatatagaattcagattttttcaaatttcagcatttaatttttacttccttttacatgtgtttcctcaaaatttagaagtgaaggatggttcaatttgataacatttaaaattttttgaattttctttatggtaattagagctgaatcacttaaaatatagatacaaacttactctatagggtattatttttataaattggcattcagacagcttctgtgaaacatactaggagtatagtctcaaaactggaatggaattcctcggcctgctattacaagaaattattttgtcaagtatggcagactttcattgtaaaatttgtacattatttttcggcaaatcttcacaaatacaaaggggattgctgaggagggctttaggatcaatattttccaggatttttctctgtttattttgtgtgtttctgttcagtagtcttttactttacagttgttttaggagcctttcaagaaggtttacccaagtatttaggtgtgctaactgactcagcagcaataatttaatctactaattaaaaaaaatacctttattggccgggcatggtggctcatgcctgtaatcccagcactttgggaggctgaggcgggcgaatcacaaggtcaagagatcgagaccatcctggccaacatgatgaaaccctgtttctactaaaaatacaaaaagttagctgagcatggtggttcatgcctgtagtcccagctacttgggaggctgaggcaggagaatcacttgaacctgggaggcggaggtcgcagtgagccaagatcgcaccattgcactccagccaggcgacagggggagacaacgtctcaaaaaaaaaaaaaaaaaaaaaaaaaacctttactgaattcttcatatgttttgtgtagtgtgctaaattattttaataaataatgtagtttatatagtgttattctcatttaatgatagtagttgaggcaagtgaggcttagagaggttaaataatacacagttcatattatccctctagaattactggatttttacttctgatcttacttttctaaaaaatcactgtgaaaatcgaatgtctataattaacatgaaattaattaccttaaaacttaaacacatatttttaaatgatgctttgtaacagtggttttcagtgtgtgttttgtgttgcctttgtgttttcccaaggacctagatgatagcaagcaggaagatacagtcttccacttcagctagagcagtgctgcctttttgttttatggggtgacattgcccactgtgttttttgtttctaaagcacgttccattgctaaaatgatttgaaacactgtactttattaatacttgttaattgttattaatactaattaattgttttctctttttcccccattgatgactttctgttgcttggaacattttttttctgttgcttgaaacatttttttcccctcttggcttccattgtactataattgggtggctttcttccttcagtttttagctgtccctttttaatttctttgtggtcctccccagtctccatgtcctgtaaagtgtgaaaatgttccaggcctcactcttaggatctctccttttttttctgtttatcctcacaccctaggtgatttcatctaatcaccttgactttcaaagttacactgcaggttcaatatcccttatctgaagtgcttggaacctgaaacctgaagtgcttcacatttttagcttttgagattttggaatatttgcattacatttactggctgagcatcccaaatctgaaaaattgaaatctgaaatgctccaatgagcatttcctttgagcatcatactggtgctcaaaaatgttttggattttggagcatttcagattttttgatttgtatgctctacctgtgtctataggctgatgattcccaaatttgtaaatttgtttatctaccttggatctcttctgtatactctaggaaagagtatatctaattgcctacttaatatctcttcacttggattcctaatgggcatctcatactgaacgtgttcaaaacaaagctattgccttttatgttttcagtacaggtgcagaattcgactacttcccaccacccttgctgtcaccattctgtccaggccactatcacatattacctggattattgcagtaacttgccagtttctttgttctgatcttaagccttttgacataggtgccaggatattattgccaaaactttgtgagtcaaatcagatcactgctctcttcaagtccctccagtggtttcccagaccattaaaaataaaaaacctaagttcttactacaacctgtgggactctacatgttccgactctacattacctctctgatctcatctttgccttcttttcttattcactccagcaacacaaaccatgtttttattccttgaacataacaggtatttaacctttcaaggtaatactttcttccagtgcctgaaagctttcctgcccagttatctgcatagataccattttacttcctttattctacaactcttacagtttaaaattagttgatagcagacattaaatggtagaagcaagaaaagaatgatgtatgttgtaatagtagtagagggaaatatgggagcataactgggggcctgttccaagactaaggataaagaaagctctccttgatggtgtcataccagtaatactttgctgagaagataagatatcaaagagacaaattaatttctgataacttttccaaatggactctagttcaaaccagaaattccctagtgtatgtctttactaaattgggagaagtagagcttatatgcccctatttggcgaacttgccgtaacctaaattgtgatctggggtacattttgaaaccgtaaacacttttcttctaggattatgtttatcccttccaagaatcattatagaaaatgagagatgtaaatgatggggttatgttgtgtttgtgaatgatattgaggcagaataaaaataaaagagaacaaactgagatgtgctaacctaataattggcttacttttccttgtgtttagtctgttttttgtcatttctttctctagattgaatatcatttttcttttatttttgtttctcagagattaccttggggagtgtgggagtagggggcttcactgatacttaagttgattctcactttgaaattgtacctcccactgtaatattttaattttgtagttgttttagatgcttgtagttgttcatacagttttcattagtatcctcaactagactcaatttgaaaatattcttcttatttatttattctttataaattttgtctacagttagtagacattacaattgttttggtggctgtatgtagttattttaaaaaacaaagtcttttataattccatctcccagaggcaaatactgtgaacattttgaatatttcacttttaaaaatgcatcttaacatatttgttagcacactagtatttttcactttaacattatattttaaaaaatcataacatataactattttagatggtcatataatttatttttctactgttggttatatatgttatttgttttactattgtaaataaagctgcaataaacatttctttgtcagttcagactattactattcattatagtgtactgactacacatatgtgtacacacacacacacacacacacacacacacagacacacacacactgacctatccacccagggaagacttccttttatgaagctataacatcatattaaccatatgcaattcacttttttttttttttgacagtgtctcactctgttgcctaggctggagtgcagtggcacgatctcgactcactgcaacctctgcctcccaggcttcaagcaattcccccaccttagcctccccagtagctgggactacaggcacgtgccaccacactcagctaatttttgtacttttcgatagagactgagtttcaccatgttgactaggctggtctcgaactccttacctcaggtgatccatccgcttcagcctcccaaagtgctgggattataggtgtgagccactgtgcctggcccaattcacttttaattagttcgtacataacatacccttttaaaattatgccataataagaatgtacgggggtcatggattctaaggggacctgcctactacatgatcagtaaacgttaagttactgaaacttgagacattgcatgctatgatgtcccactttggataatgcaatttaaaaatcataattgtattttaaaactttatggcgatgtttctattttaatttaaatattactctagtccatttaatgtttgactttgggtggatgaatggttctgcagtggtgaaaaatgtggagaaacaaaatacaagtgagaagtccttccagttagatcacagttataaagacagaatgtaaaattgtactataagccagggagaatctgagtttccatttacacaaattattttagaaatgttttatgtaaatcgagataaaaatgtaaattgctcctagtaaccatataataataatagttaacattttttagcttattgtgtatcaggcactggcgatagggcttttgcctgattgtttaagcctcgcaccaacctgatgtggtattgttatttttatccctgtttgtagatcaggtaactgaagcttagagtgttgtctaaagtcaaacagctacctgtgtagaattcagatctaggtaatcttgggtccagaatgcaattcttaaactttattataaagccaacagtatagttcagttttaaatggaaaggtgaggtcttatccctaaaagcctcggtaaacagattctacaaacttgcattatccattctcatccaaattttttcaacacttaataatttctaatgttggaatatttatcctgatatctaagttaaatgttattcagaagatttcattgctctctttttggtgaccagagtatagcagttacctttctctgtgaaaagggcttccatcatttttctctggccattgtttctcctgattgtatccatttggtttcttttatcttgctattacatcacactttttaactttttgagcttctgaagattttttactaacgctttttttttctcctcaaaaatgtagtagttgtgtagtgcaggattttaaaatttgtgaatgatcacattgccttatttgtcaggtgtgttattgttcatactttagtgttcatttatgtcagattattcattcttattctagagcattatatgtattgtctttattccttgtctacacatatttttagattgttttctaatttgaataatcttgcaataatgagatgaaattatttattcaaaatttcaaacattttcacatagattcattttaatattttcgaataataattgggatttagctctaagactcaggtgagttgaattaaaagtattacactaacaatttgtcttcaattcttattaaacttctttaagaatcagatcttagtttactgtttctaatgaagtttgtttcctctgttctctttctctcaattcttcacccctttttcttgcccttacattacccattctttctctcatttattaagtagatctgtatcataatatctgtttaattatctgaaaagatgaaaacagttgtcccaggtggtaggatgtgggaattgaggaggggagacaaaggtgaagaaagaaaactgaaaaaagttttgagcacagaggtgagtcatattgtcccagagctctccgtaacaaatcatcagtctcatatacaagtctaccagtcatatagtgtggaaggcttttctaggagaaaaacacctatcaagataaataaaagtaatctaatgtgttctcttcctctgagcatgtagccgttcatacaatttttaatatttttatatctgcacctttatatatgtgtatgaattaaatattgataaggaattatatcagcatttatgatttctagaccatccaacatggttggggtactaacatgtattttataactttttggtctatttagtgacaatattactcaaactattaactaggaaaataaggagttagcatattaaattacatgttaaattagtgttgtcatttttggctataaatagtacagttttcacttgaagaatttattgtttcagtcagtgttgcaaatacagttggcactctgtatccatagggcatatccccattcacagattcaaccaaccttgaattgaaaatatttgggaaaaaaatgaaaaatagcaatacaacaataaaaattaataagaaaaagtataacaactatttacatagtgtttacattgtaaacactgggtagattccatctcattcttataagtaatccggagatggtttaaagtatacaggaggatgtacataggttataagcaaatactgtgccattttatacaagggacttgtgcatttgcagattttttttattcacttgggtcctggaaacaatattgtggataatgagggaatgctgtagtatatttactagatttggatgatttcaattcttaaacaaattagtatcagtggataacagagcatatacattttcaaaattgttaagatatataaaatatcatttagttctttaacactaataaaatattcgaaaaggcgttcttcagtctaagcccctgaaaattaaaggagttggaggttgaggtcttatttctaacttgctttctgtcccctggagatccttttaacctttttcacttaatttcttcaacagaaaatagcatgaagaatagtaaggatagtatattgcttatgaattataatgattgatacttctaaagcatataatgtaatacgtggttacatttttataggccagaatcttacaaaaaaattcttatccattcgagctttttggattattagaggaaagaagttatagagaaaagagcctctctgaaaactgttgtaaggaatcttattgctaatagggaaaaagataactcagtatgcctaaagcaatgcagatgaatgaatttatcatattgcctaatttactcacttgagcactgtttttttttttttaaactctactcttattaatggaatgagaataagatggaatctacccagggcactggaacatcctaagcttttgccttcttgcaggatctcctagagaattaaacatttgattaccctgaggtcttgtcaccaaaaaacactttagaaataaagctagatttaaccttgttgaaggctgttttaaccaagtttactgctggactgaggcctagagttaaaaatggctggaggactatctttgcttcctgtactctaagttcacaactgagtgatctcattactattaaatacatgaaatccagtcagccaacaaagaaaacaggcaagtaggagatgtatatttggagtaagctaaggaataagataagaatttttcccaaaacctagagcaaagctgacctaatttgttctgggctttctcagttctttttcacctgctgcttggaaggatggatattcagtgcaagacatagagtttttcccagtgtagtcttacacacctagtcatatcacatcaagtcagggcaacttctgaataggaatgcaactgcttaaactgcatgtcagagagagcaaagtagagaacacaagaagggtgctattagtcgtctatttttttttttttttttttttgagtttgagtcttgccctgttgtcctggctggagtgcaatggcacgatctcatctcattgcaacctctgcctcctgggttcaagtgattctcctgcctcagcctcccgagtagctgggattacaggcgtgtgccaccatgcccagctaattttgtatttttagtagagacagggtttctccatgttggtgaggctggtcttgaactcccgtcgtcaggtgatccgccagcctcggtctcccaaagtgctgggattacggatgtgagccaacgtgcctgaccagtgctctattttatgaagcaaggcagaagttagatgagaggagataaattaagatagagccttcttccatgaatgaatcggcctaaagccttatatttgtggaagaaggtcccaagatgtgacacccaagagtagggtataccacatccttggcactagtggccagtaaattggtcctcgatcctgaccataccctagcatcatgcctgtaccttggtcattaggatagaaggtatgtagttttctttgtcagcacttatcagtgtccatgagattctcaaatatttgaaatatgtgaattctttaataatatgttctattatttacctcagagggattaatttgtactgattgggtaaatattggttagtgtaaataatgcacccgagattagaaagtggttaaatattcattgaaaaaatgactatgcagtgaagagaagaccgtcactcatcatagcttcaactttccctagccaggttagctcttgtgtccagggtttgcttttttcttttctaccctaaacccagttatgagagcagcagcacagtacaagtaggcacgctgaactcttcattgtccctttaagctgtcaggttcctactctttcttgcctcctagaatatttgatggtatcagctgtggaaatgacattggacatgctccttggtataaaggtaatgagaagggaaagtataaattgatgttctaaatttttttataaatcatataggcaatactttcttttaaaagattgcctagactttggcaataaagtgaagtggattattttaaatatctccacaataatatcgatagataattttatttttttttaagacagtgtctccccatgtcacccagactggagtgcagtggcacaatctcggctcactgcagcctcgacctcctgggctcaagtgttcctcccacctcacccttccaagtagctgggactacaggtgcatgctaccacgcctgggtaattttttgtatttttggtagagacggggattcgtcatattgcccaggctggtctcgaactcctgagctcaggtgatctgcccatctcggcctcccaaagtgctgggattacaggcgtgagccaccttcccagccagagatacatttttttttaaaataaaagataaaaggtatattgagctaattatatgccagtggagtggaactttggagggtcttatttttgtgacaaaattatgtttcaggagatgtattaatgaaaggttttacaagcctttttaaattttaaatttaaaaaacggaggtaaacatgcatacagaaatgtacacaaatcctaggtttctagatgaactaaagctttacaatcttttatgtatgtaagtttcttcccatgaggcaaggcaaactgatggaagatgttcgtatctttaagtaaatgagcaaacctaaaaacttaccgtagctgtatataattttgagatttttacatttgagggttttgctcttattgtaagattttactgttagcctttaaaaccacacacacacacacacacacacacacacacacacacacacacacattttcgttcttaggtcacttttctagtgtcagccacagatatacatacagattatgtatgtaaatcaactaccagagattggattatatctcattaaatcacaattatacattaggatcaagttcacaagttctggaggcataccattgttaaccttatattactgtctgtatgatagcacttatatgtcatgttatctcatagttttaataaacttaaatttatttaatgcatattgccttgacttaaaaaggttttaaagttattaataagtcttcaaaatattgcttctattttttcacagtttaaggttttcagtaactccctgttgtctgcagaacaaatccatcctcttaatccagtattgaagagcctttacattctttctacagccttactgcttgactttgtctcttactattcctctgttcctcctagcagtagatactaaattatacttaataagaatgtagaattcaacattaattaactgttaatgaaatactcctgattttgttttctttcaaatgtatatgttaagtccgattaaactgatataccttgtgctcctttctgtcctttcctatcgttgtacataattttttttcacatttcttctatctttagaatgactttttgtttttggtcaattccaattatattgtcatggttcatttcaggtcctttttcataattccctccatgattaatacagctagcttaaagtattttcttcctcagaaatttggcattcttttcctatattacactggctaataatacatattgcctttttaacatattttctagtttttatcacattttaaatgttaaaaaattaaatattaaacatattattatataaattagttattttttgtgtttatatcttctttctctctgagactattaaaataacctgagggcaagaactgtgtttatacagttcatatgtatatatacacacacacacacacagacacacagacacatagttttattgattattaatataatttggatatattttttgaaacagctttacaatgagttacatatttgttttgaaaccacaaaatcaaatgaagctatgctccggcaaagtgttactaatcttcaggatcagctattacaaaaagagcaagaaaatgctaagttaaaagaaaaacttcaggaatcacagggagcacctcttcctttacctcaagaaagtgatccagactactcagcacaggtgagagacattttctaaaactgttattcagtgtaatattaaatgaaatcatctcctacaattgactaaaacataaaaatttaaatatatttgcatttattggagtataagaagtgtgcagattgttttgcattatactgtttttatactgtttgtaggcatgaatattacatacaatacaaatttatatagaagtgcatgtagaagtacagggtctagcaaatatagttatcgtgatgaaacatttggctgatatacattattgaaaagcaaattaataggtcatgcccattttgagactttttaactgaatgagctaatggaatagaaagtatctaactaagtttcataaagtacttgccataatgcctggtattcggtactcagtatccaatagtcctaattctaccactaccttgataacatgattttggacaggtcatgtaacctttcttactatttcctgtggtaaatgaaggtagtataaatgtatagataaatatgtaggatctggttgcagagcttagcatatagaaaatgttaagtggtacctttttagataatcttcagggcaactttcaactctaaacatctttaaaaaaatctctgtgaatttatttaagtgtttttaaggctctcatagcttttctttaaattttataatgtattaattcagtaatggattgtaatttttgaacgcagcacatttgtcttgctaattaaccttatgacaacaatttttaaaattgtaccatattgtatgcattttttggacttcaggcatacaatattggatcaatgataaaatttgtgttatgacatactattgtatgcatatgacaatttaatttaatggctttgtttagttctttattataataaacacccttggttcaaccaacttatccaaagactagatcattacaaatggcttacatccacttgtatgtgctttgattctcttacaagaggtaaccaccaaacttcttatcattttgatttttttaaacagttttatcatatacaaatttatgaggaaacagtttattgtttagtcattcaaaaaaatgatataatgtgttgtttatggggttaggcaattttgactcatcattatgttactaagatttatccgtgttttttgatataggtgtttgttttcactgtttaaaaacattctattatatgtgagtatatcataactatttttacatgtatctctagatgagaactttggttatttccatttttactgttatgggtaatattactgttgacattttcgcacatgtttcttgacgtacacgttcatgcatctttgtgggttatatatctaggagtagaaatcctggactataaagtgtgaaaatgttacttttaggtgatactgatcacctgtttttcaaagtggttttatcagttttactaccaccaacaatataaaagagatctggttgtttcctgtcctactcaacacttggtgttgtcagacttcttaattcattaccaattgaatgagtataaaataatattttattttgttttttatgtgcatatcactgactagccagtatgtgtcttcttttgtgaactatctgtttatgtcttttttgttcaatcttctattggattttttcttactgattttcaaaagctctttatatattcttaatattaatccctagtaagttaatatatggcagatatctcactgtgtacttgtcttttcttttgattttcttcaaggtgtcatttgatgaacagaaattaaattacttcttttttttttgagacagagttttgcttttgttgtccaggctggagtgcaatggtgcgatctcagctcattggaacctctacctcctgggttcaagcaattctcctgcctcagcctcccgagtagctgggattataggcgcctgccaccacacctggctaatctttttatttttagtatagacggggtttcaccatgttggtcaagctggtcctgaactcctgacctcaggtgatccacccgccgtggccttccaaagtgctgggattacaggcatgagccaccgtgcctggccacctcttaattttaatttaggcggattaatcatttatagttattggtttggtatttcatttaagaaatctttctgttcccccaaagacagaaagattcccaatcaaaatcccaggagggtttttctgttttttttttttttttaaggcagaagatcccaatcaaactcccaggaggctttttctgttattttaagaaattgacggctgggtgcggtggctcacgcctgtaatcccagcactttgagaggccgaggcgggcgaatcatgaggtcaagagttagagaccatccgggccaacctggtgaaagcccttcctctactagaaatacaaaaattagctgggcatggtggcgcgtgcctgtagtcccatctactcgggaggctgaggcaggagaattgctccaacgtgggaggcggaggttgcagtgagccaagattgcgccactgctctccagcctggcaacagagagactccatatcaagaagaaaaaagaaaaaaaagaaattgacaaatcaattctgaaatttgtagggaaatgcaaagaacctagaagagcaaaatcaagtttcataaagaagaagttggaggacttacactccctgatttaagacttatttattgagctaaaatatcaagacagtatggtgttagtataataattgacaaaatagtcaatagaacaaagtccagattatatgcctgttcatatatgtagctttatagtaacttttgaaatgagggtaatgtaagttactttattctttttcaagaatattctgtatgttcttgctcctttgcttttttgtagtaattttactatgagctcctcaatttctacaaataagcattcgtttagaaatgtttctgattttcctttggattttctatttgctgagtttaagtgtcttgtttacttttgaaatatttttgtgtatgtgtgtttcctgttttattgttactgacttctaatctacttccattgtggtcacaggtagtactcgataagattactgtatttatatatatatatatatatattatatatatatatatatataatttatttatttatttttttgatacagagtctcactctgtcgcccaggctggagtgcagtggcgcgatctcggctcactgcaagctccgcctcctgggctcacgccattctcctgcctcagcctcctgagtagctgggactacaggtgcccgccaccaagcccggctaatttttttttttttttttttttttgtatttttagtagagacaaggtttcaccgtgttagccaggacaatctcgatctcctggcctcgttatccacccacctccgcctcccaaagtgctgggattacaggcgtgagccaccacgccagcctgtattttgatatttattgagacttgtcataaagccaagcatattgttttggtgaaagtactatatgtacctgagaataatttgtattttgcaactactgggcagagtgctccttaaatatcaatattagttatgtcattgcacttgatagtattcagatcttttatgtctttaatgattgtgtttagtttttctatcaattgctttagaaaggagtgttaaaatctctcacataattgtagatttttgtttctcctttgagttttctcaatttttgcttcatgggttttaaagctgttttattagttgtatgcatatttatgattgttatgtctttctgataaatggaaccctttctcattataaaatgtcatttttaactataatattttgttggcttgaaatgtacctttatgatgtcagtatagccaattcttccctttaatggttatattttgcatagtataactttctcattcttttaatttcagcacataggttactgtatatttaaagcgtatatattcggatcctgttgtttataatccattctgacaatttcttccttttcattgcagtgttaatccattgaattgtaacataattataatatgattgggtttaggtgtaccatattatcatttgttttctgttcatcctgtttttcgtttctctgcctctctttttcttccttccttttggattaattaactggctttttttttaatctaaaagttttactcttctatcctctagacccacagtttctgatggtaattcagtggaactcatttcattattcacttaaacgtaatgtgtcagttttgtccggctttccttttttccccaagattttaacttttgactcttagcatttaaactatgatgttcccaagcttgattttcattatagtaatccatcttgtggtttgctgagcttcttgattttcataatttttaaaccaaattggaaaaaaattttgatgttattttcgcaaatatttttgtttcctgttctttcttttctccttttgagattaccatttcccttatgttagatttttcagtgttggtccacagattagtaaagctctgtaaatttttattttttttgatacagagtctctctgtgttgcccaggctggagtgcagtggcatgatctctgctcactgcaatctctgcctcctgggttcaagtgattcacctgcctcagccttccaagtggcattcagcacatgcccggctggtctcaaactcctgaccttaggtgatctgcctgccttggcctcctgaagtgctaggattacaggcgtgagccactgtgcccggccagctctgttaattatttaaaaattgttttatatctatattattcagattagatagtttctattactttatattcagtttaactgaaatttctgttatgcccaacttgctcttaagtcttttatgtgaattattctgcaaatataagtccttgttatagtagttaaaatagctcctttaaaatccgtattttccttctctattgggtcttctttggtttgatcactattgttttcccttttcttttgaatatgggtcatacattgtttcttctaacttggaattatatggtgtatattgtaaaatatatgttatagagactctggtttctgttgtattactcatggaagtgttgaaataaatatatgaatcagaattttaattaggtcagatttaaattccaagccctgcgtcccaacaggtgggtggcagtgaattgcttttcggttatcttaaccttattcagattgcttagaggtctgcttagtgcatgaacagttcatttatgagttcatagttttgactctctcttttctggaacttttcccctcaatttgtagctgcagaggtatgactgaacttccaaagtttctgttggaattttagtctcctaacgttatttctgttgtgggccttgctaaggtaaaaattcatcagaatgggtaacttagccaatgctgttccattttccaactatcagttcttatctagattctgcctacatttgatcattctctgttaccttcaggtagttgtttataatttgcttggagtttaaatggtcgtgtgtggtagatttattctgataggatctactctgtcattattgtaaatggaacttcccaatctttgactttttaaagactattttaactgattttttaaatcattttctatacaatgcagtgaacttaatagactataacttgttgatcttatcaccaattattgttattgtcttgcattttaattatacatctattttaccccataaaatattattgttgtaaaaaatcaatttcatttagaatttttacactttttaatccctttattcttttgtgcaattctgtatttcccactaggatcttttgccttttgccttaagcactccttttagtatttattttattgggcatcatctcacagtgaattctctcattttgtattttttggataatgtctttcttttgcctttatttctgaacagtattttttagatggatagaactgttgatttgcaccatcttttctgtctttattttaaagatgatatatgttgttttttgtattttgtattgagaaggcatgtctcttattgttgcaactttaacagtagtgtgtcctttttgtgtttactttttatagcttctctttatttttggtttctagcagtttttatatgatttcaatgtggtagtgtttctccttttcctggtttttcagtttttaaagcttttgtcagccatggcctgtggctttggttttcttcattcttagaaaatttgtggtaaaaatgtcttcaaatatgacttctgcacattctttctctcctgtccttgtgagattccaattacacacatattagaccttttcactgtattccatatatattttgagctcttttttgtatcttcaaagatttttttctgtttgcttgaaccttgatgtttccttgagttcacacattctcttttctgttgtggttactctgatgttttacccatctatattgaattcttgaatagaatatgtatcctacttttgtgggtagaatattctataaatgtcatttaggtcaagtttcttgatattgttgtttaggtctttatctgtatagattttctctacctattctatcaattactaagagagatgttgaatttttccaaccatacttgtaggtttgtctatttctcctttctgttctattctgttttttcaggtctgattggcttgtaatgttcttccagtcttctgtttccatgctgatcttctgtctagtttttttccccatcattattgtttaattgtctttttttctctttaattctatcaggttttgcttcatgtattttggggttcttttgttaagtgcatgtatttttataattgttatctctttttgatgaatcgattcttttatcattataaaatgtcctttacctttagtggcaatttttgtcttaaagtctattttgtctgatattaatatagccaccacagcttccttttggtaactgtttgcatgttgtatcgttttccatacttttacattcaatatatgtgccttttaatctaaaacgtttctcttgtagacaccatatagttgaattatgattttaaaatttattctgtcttaaattccacctataatttgagggcttaatgtatgctctttaacttaggatggggctatgtcctgataaacctattgtaagttgaaaatattgcaagttgaaagtgcatttttgacataatattttcagcttataattggtttatctggttttagccatatcataagtcaaggagtgtactgaatgcatattgctttcacaccattgtaaagttgaaaaatcataaggtaaaccattttaagtcaagggctgtctgtattggtaaggtaagatataaatctgcaattttgctatttttaatatgtgttatgtctgttttgttcctcttttcctctattactgcctttttttgtaatattttctagtgtgatattttaatccctttgtttttcttttactatatatttttcagttatttccttagtgcttaccctgggggggattataactaacaatttacagcaatctcatagaaattcatgtgaacttaatgtcaatacataacattgttcctgtgtacgtttgtttctccccctgccctttatgcttttattgtcacaaattacatctttatatattgtatgcccatcagtacagatttataattttttaaatgcaattgtcttaaaccagacagaagaaaaaagtgttttttttttttcttaatgttgagaagatatcatgtcgttatcattgggtttgcataatttttggtgagaaatctgatgtaattttattattgttcctttgtatatgtcatacatatgtggagtttgaaaatcgtgtgaatgaataatagatggatactgtttagcatgtttctctgaataagaatctttgtgtagctagtgaggtgacctcaaaatacgtacattttatggacagtttaaataatggctctcatgttatatggaagatacagacaggtaaatagataaatagaaaatttgaaagtatatttttctgtaaaatttatagtaaaatgcaggaatcatactgttaactacaactctccatcaattaatatatctaaatatatattccacaaatatttattgatattctactatgtgttaggtgctattcttggtgatgaagagctgttagggaacaaaacaaggcctttgtgctcatggagcatacattcaggtcagagggttaccatctgataagcacatgacacacggtaataagtgctatggagaaaaataatacagcatgagatggagcatgatggagagtgatagggcttttttgtgtatggtggcagaagaaatcattctgattaggtgacattagaaaagaaatatagaagaagtgaatcatttagatatctgatgaagagcattctaaacagagagaacaaatgcaaagctcatgaagcaggagcttgcctagtaaggaggcgagtgtggctagattgagagctatggggagaggagtgaaacatgatctcagagaggtaaatgtgggacaggtctccttgggccttgttaagttactataaggatatagattttactctgagtgaaatggaaagccgttggtgtgttttttgtagaagagcaacatggaacctattggggtgacttattcagaagagtggtgagatctaactgaattttttttttcttttctttttttttttttttttgagaaggagtctcactctgtcgcccaggctggagtccagtggcataatctcagctcactgcaagctccgcctcccaggttcacgctattctcctgcctcagcctgctgagtagctgggactacaggcgcccaccaccacgcccggctaattttttttgtatttttagtagagatggggtttcaccgtgttagccaagatggtctcggtttcctgacctcgtgatccgcctgcctcggcctcccaaagtgctgggattacaggcgtgagccaccgcgccgggccctaactgaatatttttaaaagatcactctggatgcattgcagaaaacagaatataggaaggcaaggaagagaggagggagacaaatttaacaggcaattgtaatagtgcaggcagaactcagtgggtacttagactatgttataaaaaggagttagagcctgtaaataattcaaagttagaatgcataaactttgatattgacttatatgtgaaatatgagaagaaaggaggaattaaaaatgaattcatgcttttcagatctaaccacctggacaaatgaatttgctattttttgaggcaagaaagattattctcacagctctcctagcagtaggaggactctgaagttagatagaggagagatgtggaagcccagaattagggaagtagtaatgaagagaaatgtgtgacttaacatttctgcccattagtaacatatactttatcatgtcaatactctctttttagtattcagtccaactagactcacctcttcatccatcctttattccatccatccatccatccatccatccatccatccatccattaaaccttcatttattcagttatgtaggcaatatttattaaaatcccattgtatttttacaggggatacgaaactgaacaacaccatttatgtttctatgaatcttatagataggaatgcagatagaaaatagttacaaaatgtgttgtaattgaagtatgaaacaaataggaacctgtggaaagaagcttttcaaggagcatgtttatggagaggaagggattaccaaagctttcacagagaaaacaacgtatgtcattttgttaagggctttctggtttcttgtcagaagcgcactggcataggcccagaggtgagaaagtttgtggtgtatcctagagagtgaggatagtctggctaagtacttcttgtaatctacatccaagcatcctagggtgggagtagttattatcctaattcagtacgtctgggctggggcctgagattctgcatttctgtcatgttccaggtcaggctgatggagctggtctagcgatcatactttaatgattaataggagactaagtggaaagtgaaatatacagtcgaggggaaatggtagaaaggttttatttcatttttttctatctgtaaatttgtaaatacttctagtgggacttttttgtgcaggattttgggggtgttatttacagagtaatggataaaaacatagattctagagtctgaatgcatggatttggaacatagacttgatcacttaattgtgtgaccttgggcaagttacttctctgtcaactcagtttcaacatttataaaatgggtattataatagtacttacctcattagagtttcattaagattacacaagacaatgaatggtgggcatttagagtaataaatgttagctcttaatttattatacagggaagagacttgttagtaaattgagattttttttttcttatattggtggggatttatctttcctttctcctatctcaacttgtaatccaaattattggtgagctgacagtctttgccatagaaaagggcaaagctaattggttcataggggattgaaacctgtgacccttgatttctaagcaccctgctcttcactagctgaattctgaatgactgcctattcttatctcaaagcgattgtttatctttttcatgcagaaataatgttttttgccttggaggaatatcttgcagtagaggacaagagagaaagccagggtttactatatttatctgtgaatgagatacatgccatgtggctaatggcaagaccacaagatgagttgcaaattttaaccagtcttgttgatttttatttcttttcatagttactctctcttccttgctttcctcaattgaagagaattttctttagctgttttcccttatgttcttactctctttttataatttttattacaaaatatttgcaacctctagaagaataaatgtaatgtctgtatactcaccagcaactgtcacaaataatcttgattatatctatgtactctttcctgattccatctttctttttttttccatgaagataactaccatgttggattttttgtttatgaattcctgcctcttaaaactatgttttcttaaataatatattccaatgccttttgtttgtttgtttgtttgtttttttgagatggagtttcactcttgtagcccaggctgcagtgcaatgacgtgatcttggtgcactgcaacctccgcctcctgggttcaagtgattctcctgcctcagcctcccaggtagctgggattacaggcacgagcctccacacctggctagtttttgtatttttagtagacacggggtttcacaacgttggccaggctggtctcgaactcctgatctcaggtgatccacccacctcagcctcccaaagcgctgggattacaggcacaagccaccgtgtctggcctcatttatatatatttattctgatccctgattgtttcctcaggatgaattattaacactagaattactttgtcaaagattatgaacctaaggcttttgaatatatattccctgccaaactgcattccagcaggattataccaagttatcttctcacagtatgtgagattgcccacattttgtattcttgcaattatttattataatttaaaaacagccttttgtttttcaaaacaaatttattcctttattatctctttggaaactagtgaggtttttcactttcacttttatgtagttttcttttgtaaatattctgtcagcttgtatttttatcttgtttgcttacagatacatatgaccctttaaatatatgttagggaatgagtgctatacaatattcgtcacagtatattatttgcccactttgttaatactttctagaccttgtagattcagttccaagataattgagacctttttttgaagactttttcttaagattgagctccacgtacctctttctgcattagcagatgttaaacttaattgttttccttgtgtatctccatctctggactctgagctccttgagggcaaggagagttgatgccttatccttttctccccactgccttctccagtgattgacagtcttaagttcaataaatgctttttgaatgaacacatgaaaatccttgacataacaattgtaggaagtaggaagtaagagcagtaaagaattaacatttggaagggtatatctaattgtgacgtggagaaaaaatgtcagtagtagttagctttattttcttgccagagggtctgatattgatagtgactatttggcattaactaaagtacagtattctggtttttcaggtggtagggagaagatctgattgtagtacctttacttgggctcagaatgctggtaacttttgtcatactttagttgcaaaatattatgccagagttaataattggtttgcttttgtttggtttttatgatttttactttattattgtttctattccatttttttctcattttcagcatggaagaatatcaatcttatactttctctaggtatcttactgtacaggatcaaaataactttcaatatattaggtcaaggtgccacaaagatagtacttttatattatgcttatcatcgtatttttatacttaattagtttcgagtttatatgtgtaaacttaatttgaaaagttgacttgatttattcttcagcattattgtaaatgaaaactgccttgtaatttgttgcttgatttaattatattcagtaatttatatttttaattcagttgtatatgtagatatgaccacacaaatatatgggaaatgatttttggatagtttgatatttaatcaattttcaggagagaacaacttagcagtaaaatataatgttatgatatgatttttagccttaataaatgaaagacatttttatttaaaagaaaaatttgaagtctttatcttttgtaagtcttaactataaactttttttctaaaggccattgtgtattatattcacaaaatttgaacttgttatcattcaactccactatcctgcatgaaaaataaaccatttctgctataaaaagaaggctgccaatagatattctgatatttcaagcttactttaagttccaagcagaatgaaacagcccaagatattaaaatctagaaatttagcatatctaatggaaactgcaactcaactttaactactctatagtggcacttctcttgccgctgtaataaaacttaagaatgtttagtgattttttttttcctactattattcaaaattacattacccttactgaaatctgaatggcttttagtggattaattaaactgtagctggtttgccatctgggtgcagcttgtttagctgcctttccacagaaaaatttctcatggagtaaagagtattttttgttagaatacagctgctaggctttactttctaaaaaaacaaatagtttatgctttcatacatgaaatttgtgatgaaaattaatttgtaaaatataaaacctatgattgccttttaaaataatacaacacaagcttttttatattctttatgaatttgtaaaaaatgtatgccttgataacttgtaatattaaatagaatcctaggtttaggctaaatatgaaaaaatgggtaagagggaattaactaaatctgatttttatggctcaagtggtttcattaaattagagtgctctgtgttgttcattaatgaacttatgccatatgctttaactgttctggtcaatagctgataaaggcttgtggatttgcttttttttcatataaagctggataaaaatatccatgtgatgggcttttatcaaaggagttactctgaattcagtaactactactgaggcaatatggctcgcaatttgcaacccaaaggtagtcatacattattggaatacagcctactgcgcttcacattacacagatgtgaaggcctgattatagctgcttcataattaacagtgatccgatttgttttgtggcataaatggtgcatgtgtagaacattagccatggcactctcattcaaattcaactcaagggctcagcggcaggcgggtcacgagcttcagggagtagaagcacaagctcctccatatgttcttgctgcatcttactatggctatgtgtgcaagataagttccccaaagaacctaatcgtgttctgtaattacagcgcggctttctgctggctagaaatgagggagaagctaaaacactccctcatcagataatttgtaaattactttacatggcggatgcctaactcagttggttttcaactgctgaaattataaataattgtaacagatgtggcaatatggctggtctccaataaatgaggcccttgataatttggccaaccctttgacaggccaatttaataaaatgtgaacaaaatcttcttgctaataatttatcatcctttttcccagtagaataaatttaattaccctagcagttaacaaggtcacacccagatgccaaactcggctacagttttgataatgcaatcaggaattgagaggtgatgacagcgttgttgtttttttcattacctggcttcacataaacacaggtggcgtagctttcttgtcagtttttaataattacaggctattatggaatgcatagttagcagattgaaaaccacactttagtgaattcgagtatgattgaggttttaatgtatagagatgataatgtataacaagcatagtcccttgcttataccattaatgcacaaattttggttgttttactggtgacataagtgtttataaaacttagagtatgtattatagtaagtaatggcttataccccgaagtcacatatttagagatacaccacaaaaaagtttaattccatgaattttagaaattcattttaggatgccactaacagaaacattttaaataaccagatttgcaaattctggcagaatgtgaggcttataacatattttggaaaaatctgaatgtgttttattttgctatttaagataaaaagaaatttatagaaaaatcagtcttttcattctagcttttaagcactgtcaggattagtttactcttaggattggaatctataggtaatttgtaaattgtggagttattctaaaccctcttgtgtgacatgtaaatattactaatttttgtcagtacagtgtgatatttacatgtcatagaataaatacttagcttgtggttgctcaattttgtaccaaagatgctactgtcatttactggatgtatgtatatacccataattgtcatctactggatataagtataattgggttgtaacccactcggtgttaagttttatttggtatatggaagaagttaaagttttggaattaattttcttccattttattttgctgttaacaacttgactgtaccatgtaagtatttagatactaaaggaaagctaaatttgactgacttgtttattactgaattttgctataatgtgatagtgttataagcggagatggtgatagtttattttttactcaaatgtagtcaataatttaattttattttgtgaattacaaatgctacctgaaaatatttggttaaaagtgagtagatggaagaaatgcaaatatttatatttttaaaaggagtgctagatgaatttgttgatattagacattttattactcaatatagtggtctttctaaaaatgaagtataaatttaaactagtacccttagttttatttgtgaatttttattataacactattttgatttacaatattatgttaaattgatattctttttctttttcttttttttacaagaatatatgactattattaaagtcatttattttcaggatatagatgattcagctaacaatgtttactttattaattggtaatagacatattgctgcatttctgaaatcaattttaaatataaagttaatctctgaatatgggcatttcatgagaagaaaagtgtgtgtgcatgtgtatgtatgtgtgtgtgtgtgtgtgtgtgtgtgtgtgtgtgtatgtatacacagacaattatatactctgttgtattcccagagggtttgaattagttttcagagaaccgtcattcaagtagttagtttttctgatatatacgtgtatgttagatatgttatatacacatgtaacagattttattacacacacacacacacacacgcacacacacacttgacccgtacttgattttcagtgatatattgttttaagaaaaagtatttcttttgctgaggtatcatgtgcttttagaaatgtttttgttttgctataggctttgttatgtgttgacaggtttggaattcgtaaatttcttaaaacaagtgagataatgtatgcaaaatgcttagccagaggtaggaactaaacacttttttgctaaatgctaattattatcatcattgcaatgtagtaggaaaaaatatttaattataatttgctaataaaacaatttaagttacaatttttgtaattattatagctgtgaaacaattttctatgtattaggcaatattcagtcggcccccactgtaataatgccctacaatatttcttggatttaatgcaacatgactatatatttaagttgtataatttaaaaaatagtaatttgtataacacctaaaggcccttcccccatgccttctattctatttaatatatatcttctacagaacttttcaattaaaattagctctgtgagtcagtgtgaaaaataaagttatgtgttaacaatggcaatttaaaaagattatttccacctgggagcctttagccgtgtagtcagtccacgaatcatttttcttcagattaattatagtatagcactataccattgtatttcaagaatgtaaactaaaagggagcaaaatatttttaatattagagaaaaaaatttatttataaaatgtgaataattgttaggaaggaaagttaacttttcaaagattctaggattttaagggtaatagaatgaacttccacagagaggggattggttaacttgattttgctatacatgtaaagcagcccttaaaaaggttaaagatatgtaaggatatatggagatctatgatgatatacatgtatatcatatattttattacttatacatataatagttatatgtgtatatgtttgagattattaagtttttaaaaagcaagtaaaaaagtacagtatggctggggagaaaagagtagctttacaagtggagtaatctgacaaaactctacttcagccaggtgatcaaactgaatatcaacagtcataaatcatgttgatagcatatacccttgatatgatgtgatgaaaatggcactttacctctatgatcttccttctcaaaactcataaccccagtctaatcatgagaaaaacatcagacaaatcccaaaggaggggcatcctacagaaaactgtcaaggtcatgaaagacaaggaaggtctgagaaaacagccaaaaggagctctaggagatataggaactaaatgtaatgtatcctagatgggatcctgaaacagaaaaaggaccttaggaaaaaactaaggaaatatgaatagactatgtccttcagttactaataatgtatgaatattggttcagtaattgtaacaaatgtaccatactaatttaagatgttaataataggggaaactgagtgggtgggggtaggaggtcagggagaactctgcatagtatctgcttagtttttctttacataaaaaaactgttgtaaaaaataaagtctattaatttttaaaaagtatgttaaatgacaaaaatatagtagttaaccttttttttttttttttttgagatggagtctcactcttgcccaggctggagggcagtggcgcaatcttgggtcgctgcaaactccgcctcccaggttcacggccatcctcctgcctcagcctcccgagtagctgggactacaggcgtctgccacagtgagacggggtttcaccgtgttagccaggatggtctcgatctcctgacctcgtgatccgctcttctcggcctcccgaagtgctgggattacaggcatgagccaccgcacccagctgtttccttttttttttttttttcaaagtctgagagatatatcacaaacttactagtaggaactttgagggatgagattgtgaagagacttttatttatatttcccttacctatactgaaatttttacattgaactcatagtcattttatttgcaaaaaaataaatatttctattttgaaaagcatttaggccgggtgcagtggcttatgcctgtaatcccaaccctttgggaggccgaggcaggtggatcacctgaggtcaggagttcgagaccagcctgatcaacatggtgaaaccccttctctactaaaaatacaaaagtagctgggcatggtggcagatgcctgtaatcccagctactcaggaggctgaggcaggagaattgcttgaattcaggaggcagaggttgcagtgagccgagattgcaccattgcactccagcctgggcaacaaaagtgaaactccgtctcaaaaaagaaaaaaaaaagcatttagtgacatgtccattgtaaaatctttaaggaaattcaggtaagtacaaagaaaataattcatattacagtccctctacttagaaatcacactgtaacatttcagggttgtttttgtaccttatgcatgtttggtgaaatctatttctacatataatatacccttttgtaccctacttttctcagtttatcatagatatctttccattttagccttcagcataattagaagtaaattaaaggtttggtacatttttatgagctttgatgcatctttcataatttctctagaaaattgatagcagattatacttctacccactaccacattctcaaagtaacccataaactgggtccaaccaacatttgaaaatttggacactctccttagaaatcctaattctttgcttttcgtgaaaaatcagtaaatctagcaacagtggggcacattcttccctgaaaacaattggctggagttgagcggcaactgccctgaattccctccttaccactcagcagtggggctgagtgttgacacttcattttgctcatatttaatacttaaaaaaatggttttattaggagaaatgtaaaacacttcttgtaaacatgtctgtaacaaaagtgataaaaggcaagagagagacaaaccagacttaaagaaaatgggaacatgaataagttactttgtgaaggggaggaacatatctacttggttaatatgtatgcaaaatgcctctgttggatgaattttaaagctattactttaaaacacatatttatttatctgcattatcttcctggcttctattcactctttgatagtattttaattgtgaagttctctgattttttattgaggaattttgaaggaatgctgcctaaatatcctttattgttatcaaaaatattaatatcattaatataatatcagtagaaatattaaaaatgaatccattattatagtgacagtatccactgttggagcattgttaatgtcttatatttgagttatttatcatagcttcttgactgaatattaattttataatattcctagctatagcattataatccattgatgacttaggaagttcatttattgacgaacacaagtttgcttgttggatataccaataaactaaaattatgtttttctgattttattctaagtttttgtttgaccttaaacaaattatttaaaatttattttgtatatgataggatgttaatataacatttataattttattaaaggaaacctagacaagagcaggtagcctttgaaatagtttagcttggcagcccaaccaaaggaaatatttctaaacctcagaagtttgactataaaacaggagaaaagataaaaaataaaagttgtacaacgattaaaatggggataaaagaatagggcaaaatcatttagacttcctggaagagaaatgcttaaaatattttaatttgatgttcaaagcaagataatgaaataagtaatatattgtaagtatggtaacagtacaatgtaaacaatactttgaggaagataatcatatggtagaataaaggttggaaacaaatgaggtgatttaaatatgagaaaagtgtaatagtataaatcaaatatggtccctctcattatacaaattgcaggttagaattaggaaaattttgcgtatcctctcaaaaaagaaaaaagcaggcacaattggaaaaggatgatgtttcccattgttggttcaaaaaagttaaccgtatatatttttctcatagtacttaggaatatcatttaggaaggatggggcccttcatcagtttaagtgcaaatattttcagggctactagatccttattgataatgttagaatcataagatttgacatttgtttgcctgtaagtcaacaaaaactgttttcatgtgattctgtgtttttgtttttgtaaatgtagttgttaatttgaaacagcgaatttgcatgggttttaatggcctcaaatacattcagtggagatggtagtcaaattttgcagaattccagttttcatgaacaggtttcctacaagattagttttcctgtgacttctgttgttaaaatgtggagcttaccattagcagtttatctgaaacatgaataaatttcaaaggagaatgctgtaaactatattgacttaaaattgtcagggttctttgaggagttgttattaaattagtttacagtaaaagctgattgtacttataatgctgttgttttccttttcccaggtttatattctatggtattgtatgactcttgatgaccagatggtggattgactgttttgtgaggcaatacatatgtgtataatcagaaatttgaaatgactcatttatagatgagtggtgtgtatcatgcagccatgctttaaatttttttccttgaaatctatatgacagcattatttatgaaaatacttgcatatagactcttggttattttattggaaaatactattctatggaatgaaaaggttcagctcctgctagtttattattaaaaggaaaatttccttctctgaatatttacaatttctataatatagtgttacatttaactatttatttataaataatgtaagatacaaacatagatatctatttacaattatactttttaaaataggtacctcatcgcccatccttatcaagcttagaaacgttaatggtttcacagaagtctgaaattgagtatttacaggagaaactaaagatagcaaatgaaaaactgtcagaaaacatatctgccaacaagggtttctcccgaaagagcatcatgacaagtgctgaaggaaaacataaggtagggacattttgtcattttgtgaatttgccaggatgaggctggaaagacaagagatgaagttaaaaaacaaatggcagcatttacttctctgcttgtatttcgggaaacttttgaaaaatattatgtaccgaactcttgttaaataagttttaggagtaaggagttttccctttttaaagactgagttatattcccaaattagttaattaaatatattattagtgctatacccattttgtcagtaaattaacattcttatattaaaactttggtaagtattcctcatctctctcatatattaatctatctgattaaaaatttatttttaaatggtatttactcacttttctaatttgaattaaaagaaaaatatatctaatatgtctttcaatcagatatgatgtttaaaatactgtctgtgtggaaaataaaatagtaaatgaattttaacactaacttctgcacttgttatatatttttatagatttaaagggatagcattaagagaaaaataagcaaattttacatgtttctcgtttattaatgtctcaattttttttagtattcattacatagttgtgttacgctgtaaaagattctacagaatgttgactaatataaaaattctaaaatatcatgtagtacatacattatttctagataaattgaaataacattttcctcagagtaagagttttagcatatttttcacacgcttgttacttcagcaataaaggaataatagtttttataataggaagccatgttgttaagataattgtttttgtttctttccattttttcttatgggtaggacaaactatcttaataaaggaagtatttaaaatttgaaccatgtttctgtggtactgttattcatgctctctgaaattattagtaattttcagaaaatgagatttatttattaaaacataactgcattatacatttcttgccattttgaagtagtttcacaagcactgaactttatttaaatgaaagaaaacattcataaaattgaaatacagcattaccgggcctaatttggttgcttgctcgattgctgaaatttaaaaatgtatgactttgacttttttctgcctttaataaaagtcaagaaaaagagaggggtattatggccaaaattttctttctttttgtaaggccatgcagtaaggatgagcactgtgttgcccagcttaatagttgctttcacatattctttctccagattggtatatgaagctgtacataatataaacgtattcttgtctctagttagccacattatagttaatgaccatatggtcattatggtataagatctactgtctgttgtatttatattcctcaagcatattgttccttcaacttcacagtgtgttaaactatttcaaagggaaaaaaatcctttccctcttgtttctggttgtcctatcaagtgtaaccttggacccttatagagcaattagaccagcctctatcccctcctttgtaatgaggtttcttgcatttctgagtctataaccctttagtcttccctaatgggacatcattattctgaaagaaacaatgtaaatgtaaatgaatattctcattaacgagtcacagagaaacctttagcggtagcactgtggtaattccgcttgttatttctctggtattccatgcaggattttttttttttttataattcattattagtattcaaaattacttgttctttaattttgcatgtctttcataatccagtgttccaactagttcaaccatgtccttgttttattctcgaggaaccacctgtgaaacgttcaaggtctttgtccccaaagagctctttcacagactcagaagagctacagaagctgagaaaagctgaaagaaagattgaaaacttagagaaggcactacaactaaaggtgaacattaaatcatttctttagtagtaaccttgcaaagataaaaatataccaaagtaaacatacagttcatagattactagttgtcctttttctttcctgaatttaattgcctgtataaaagtgtataatcagttcatcttgttattaagatttctgaggatgataaaataatataaaatatttgctacttgaaaagtaaatgtttatttactactttcaagttatttggtaatattttgtcttaaaattgggaataaatttcttaaccctttcccaaaggcaaaaaatagaattgtagcaagtgaaaagagaatttcttcttctttatatatgataaacatatgtaaatgaaagtgagtttaaaagcatattaacctagctcagatcacttacaattatcctttatagaaaaattacatttagtcaaaatgaaatatatatatattttttcatttcagctgaatttgtctcagaacatgtgacatttgaatgagcactctaccatgtttaagaaacatgtatgttatcgaccagtctttgagagcttatattaatacttcctaattcatactttgtgaaatctctttttcaatatgcaagttgttcatacatattgaacccattttgtgtgactacattgagggttttttttctctttcattcttcattcacaattacctgaagctgtgccctatttgaagtttaatcatataattctcaagtagttttatgatattctgtaaatctagtgctttacacatgattagaatgcagtacacatgaagctcagattctttgtcatataatatagattactcttaaggagataaatgttcagtttagattatgtgtgttctaaaacaaaatagggtttatgggtatagttaacaataagctataattaataattttagtttgccttaagtttaaacattaagttttagtttatgtttattcattcagagttaaactgctctaaaacatgaaaattataatgtgtttctaccaaaaataacatgtccaaatgacctcagctagcatttagcctacttgaaatttataaagaacttagataaacacctaagttattctcttattcatttgtttcctcaatagcaattactgagcattgcaattagctaagcatcatactagtacttgtctaacaggagactgttaaatgagttgctatccttcaagaccctttctctagttaagaaggtaagtaagtagttaactcttgtgttaattgtaaatgtgtggttaggcacaggatattatgggcatttttgaggagcaagtctatcatcttcctccttttgcataattttttttctttcccttgagacagagtcttactctgttgcctaggctagagtgcagtggcatgatctcggctcactgcaccctctgcctcccaggttcgagctattcttctgtctcagccccccgagtagctgggattacaggcgtgtgccaccactcctggctaatttttgtgtttttagcagagatggagttttaccatgttggccaggctgatctcaaactcctgacctcaaatgatcctcctgcctcagcctcccaaagtgctgggattacaggcgcgagccgctgctcctggcccttttgcataattcttgaaatttgttacctgggttctccagagaaacagagccaatagaatacacacacacacacacacacacacacagaacaattatttactatatttatataattccttatagtaaattagatttatatgagatttcctataaggaattggcttacgtgataatggaggctcagaagtataagatctgtagtcgctcagggaatgctatgcagccataagaaagaatgaaatcctgtcctttgcagcaacatgagtgcagctggaggtcattgtcctatgtgaactaatgtagaaacagaaaactaaatatcacatgttctcatttataagtgggggctaaacctgagtacacatggacataaagatgggaacagtagacactaaagaactgcaaaaggaagggagcaagggctataaaccttcttattgggtactgtgttcactatctgggtgatgggatcaatagaagcccaaacctcagcatcctgcaatatacccttgtaacaaacctgtacatgtgctccctgaatctaaaattaaaaaaaaaaaaaaaaaaaaagattttcaattggcaagctagagagccaggagagctgatggtatagttccagtttgagcccaaaaactatagaaccaggaaagctgatggtgtaagttcaagttcaagtcagaaggcaagagaagactaatgtcccagcttgaaggcaggcagagagaaaggaatctttcttactcagcttttattctattgaggttttcaacagattaaatgacatccatccatattggggttcatgcttttagttcagcttattctcatctaggaacctttgttcaaacctgaagattagataaaaaattattggctgggcgcggtggctcacgcctgtaatcccagcactttgggaggccaagccgggtggatcacgagttcaagagatcgagaccatcatggttaacatggtgaaaccctgtctctactaaaaatacaaaaattagctgggtgtggtggtgcatgcctctaatcccagctactcagggggctgaggcaggagaattgcttgaacctagaaggcagaggttgcagtgagtcgagatcgtaccactgcactccagcctggtgacagagtgagactgtgtttcaaaaattatttatgtttttaatcaattcagaattagaattgcaaagatctttgaggaaaaggtcagttgatacattttttcctgttttctatttcctaatgtttcattcattcatacttgttcgtacacagaaagagccttgccaggcacgatggctcaggcctgtaattgtagcactttgggaggctgaggtgggtgcataacttgaggccaggagttcaagaccagcctggacaacatggcaaaaccctgtgtctactaaaaatagacaaaaaaatgagctgggttaggtggtgcacacctgtaatcccagctactcagtaggctgagggatgagaatcgcttgaacccaggaggcagaggttgcagcaagctgagatcctgccactacattccagcgagtctgtctcaaaaacaaaaacaaaaacaaagttagagcttctagtttagctagtttaattacaaaatccaaaggaagtacttagtaaatgttttattgaatgatctaatgaactgatctcattcagcacctgcctgtggaatatttttgtgtgtatcctgtaggaaaatatattaattagtgatataaaatacatttttcaggtcatacacttgacttgttgtaagatctttggtggtaatagttcccaaataaagtactattattttgcctttgcttactatttgtcaaagtttggatcataatccaaactacagttaacctgtgtttgttagaaggttataaagaaagtatttggatattttgaaaaatatttattttaagatatccaacttttgatggatgacttcagctggcatgtattctggcgccattaaaatgaagaagtgtttttctttgaactgtatctatcttatatttacatttttataaaactttactctctattgctgaagtaagataaaggaacaatagtctctaggactaatttaatgcatgatttacactttgacagcagcgtccccaaacatgaatctttggatgaaactgcattttaaaagattttttcttatgaattatgtctatcaaatgatttgcaaataatagctagttgaattttatttttaatagtttagattttgataattttataagacttatgtaaacactctgctgttagatataataaattaagcaagtaaaattaaagcagaaggctcatctataaaacctttttttaaaaaaattatactttaagttctgggatacatgtgcagaatgtgcaggtttgttacataggtgtacatgtgccatggtggtttgctgcacccatcaacctgtcacctacattaggtatttctctaaatgctgggtcaaatggtatttctggttctagatccttgaggaatcgccacactgtcttccacaatggttgaactaatttaccctcccgccaacagtgtacaagtgtttctgtttctccacatcctctctagcatttgttgtttcctggctttttaatgatcaccattctaactggcatgagatggtatctcattgtggttttgatttccataatgaccagtgatgatgagctttttttcatatgtttgttggctacataaacgtgttcttttgagaagtgtctgttcatatccttcgcccactttttgatggggttgtttgtttttttcttgtaaatttgtttaagttccttgtagattctggatattagccctttgtcagatggacagattgcaaaaaattttttccattctgtaggttgcctgttcactctgatgatagtttcttttgctgtgcaaaagctctttagttttattagatcccatttgtcaattttggcttttgttgccattgcttttggtgttttagtcataaagtcttcgcccatgcctgtgtcctgaatggtattgcataggataaaactattttttctgtaattaatacttagtggaaagagccacttattgaaattactataggaaaatcaaaattatttggtaatattgaacattttacactaaagctttgggaatcagaaggggcagcattcactgcttttattaattaaagtgcctagtacagagtctggcacatcatgaatgacatatggagctcaggagatttttattgattcttagtctttggtttaatggtgtaatatagttagtttctatggacaattagggaaaacacatgaattcaatgactaatggtagttgaggcagtactgaaaaatccttaacatagtgtcaatacatataagaatctcagtttgttccatgaatttaacagagaatcattgtgaaagtaattgagaaaatttgtacatcctattctatttattttcacatcttggtcaatctttgaggttctatttactcagtttctgatgactctaacaaaaaactttagtcattccccaaacagtttatatataataatttttaagaaagtcattgtaaaataagagtttgagggaagaactttgattcaatgaagaataattatagaaagctatcatagaagtctttaacataagatacacattttagtttaagtttcttttgaaattatgttttgacatgaatctcttccaatatagtctgttaatttccctccctccttctttccttccttccttccttccttcttctttctttctttttctttcttttttttttgacagagtgtctctctgtcgcccaagctgtagtacagtgcagtggcgccatctttgctcactgcaacctctgcctcctgggttcaagcgattctccttcctcagcctcctgagtagctgagattacaggcacctgctatcactcctggctaatttttgttttttttttttttttttagagatggggtttcactatattggccagtccggtctcaaactcctgacctcaagtggtttgtctggctcggcctcccaaagtgctgagattagaggcatgaaccactgtgtccagcctattaatttcttataattaaattattaataaatttctaatatgtcttgctgaaatcactaatattgttttctagtttttaagcaatctcaataaacataattaactcatgttcatatatgagaaggtaccaacattattaatttttaatctcttgttttgctaacttaaattatttatttcacatacttaacaatagaaagctttttgttcaaagacattaagtagtatttggattgttaaccaaattaatatgaaaaactcaagttcaagactaaattattctctatgtcttagaagaagagatataaatagcttctattttgaagatggataacctgagttaactgaatttaagtaactagatcaaagtaaaatttagttaactttgagcagctagatttgaactcttatcaacacagcatcctacgtgtaatagactcttcatgtatggttcttaaattgaaatgaacaaaattgaactcagtaacctgaggtttttacttttacttcatatattaaactatcctactttagcaaatttgcattatgtgtgatttgtatatcttctaaaactacttaggaaacatttattttgaatgcctttgtcaactgaatccattctgctttttcatcaagcactttcatttctgtacggcatatagaacacttcttgttacaaacaagactcaaatacttcttaataactacttaagagaactatcctagtagaaatatagtgaaagtagaatgacagactacccatactgctaagacagctagaattgcagtaaaataatgcagactctataaagtattatctcactgtttagatgagaggtcaagaaacagttacttggtttctaaaagataagggcatcactgttaacatgtgggaaaaggagactgaaagaagctaacttttgctttgtgtccttaaaagggctggggccccaccacctaggttaacttatttcatcaaaatttaaacctcttttttctcttccatattttgcaggaaaaaacttgaattaatttcaatggtgttcttaagataatgccactaacaggagcaagctccaagaatggaattcagatctttctgattaccatatgcctactcatatcacctcactataatattagagagtatctgttgcctccaccacataagtatacaagttcattcatacagaaatatgaataacagttattaaaatatttgaaattctcatgagggaagaaactggagaagttacttattttactttgagaaacacagtttatagtcatgtgcatatatcttctgaggactaagaatttcgtctttataaattcattttatatatatctaaaaatgaaaattgatctcatgtgctatatattggaagtagttgactgtgccacacacggtggcttatgcctgtaattccagcattttgggaggctgaggcaggaggatcatttgataccaggagttcgagaccagccttggcaacagagtgagaccctgtttctacaaaaataaaataaaaaattggctgggtgtgatactgtatgcctgtagtcctagctacttgggaggctgacatgggaagattgcctgagcccaggagtttgagactgcagtgagctttgaactccagcctgggccacagagggaagccctgtttccagaaaaataaaaataaataaaaaagaagtagttgactataattgtctaacctaggtattgacacaacaaagcaatgtttggatggcttgttttataacctctttaagagttgtaagcctagctttcccattccagttcttcatggtacaaccccagaaggttaaactatgctccttctaacatagggtccaatctcattttcttccttatgtgtaatccttgtgccttagtaaatattagttatgaattcatgtgctaaataattgttcttactctgattaatgttcttatactaattatatttgcactttaataaaataatcatggtttatgtatagataaaaccttatgctgaaaaagaaaataattaaaaacatgtaagataggtttatgaatgtatactaattaacaacagggaaaggagtgaaactatcttaatggtaaaattttgaaattatgtgagcagcttaaaaaatgcattgactgagttgaatttatcaagcaaatgtattctgtgactagagaaattcttttttctgcttaaatacatattacagattcatttatgtttacacactattttctttcaaatttcatatttagatgggtaaccttttatttgaaacattatattaatactttcttcaaacttatatatacttgcttttttgtgttctacagagccaagaaaatgatgagctaagagatgcccatgaaaaacgcaaggaacggctacagatgttacagaccaactacagagcagtaaaagagcaattaaaacagtgggaagaaggcagtggcatgtgagttacatagctcataaaggcatttccctaaatattaaatggaatggagtagcattatataggtgtcttaatggcttttgtttggttttaaagaaattatttggtagtcaaatctttattgtgaatttttaaatggagaatataacaaattaaaacagaggaatgtgttggtaataactatagattttcctcacatttgcagatatcattagcagtcaatgattatgaattattgtacacatttttaatatcaatggaataacttaataaaattatgtaatttaaagcaaaaatggttaatatccgtgtgattgaaaaacttgcttttaaataaataaaatactggtgttaaaatgtttataactccaaaagtatttaaattttagtggaaagactagagaaatatgaaattcacatatatagttaactatcttaaaactacttcaacctagtatgcaatttgaagatctttactatccatcagtttgttctccagcttatgtgaatgaattggcggtctcagttcaattgctctgaacaggtgttcagatcttggttagtcgtaagtggctcccctgttaactgtatcaacagagggcaaaggactgaatgagtacagaaaatctactaccttctcatcttttgagatggatcctttagggcaatgttgatgatacacattggtctgttctgtagagaaatactgtttctaaattggccagtacggcacttttacaaaataaaaatgaagaatttgttttatgttcagaaaatgaaaatgtaaagggcatttggcatcacttgtagataattgtcacatctaatttttttctttgatgagtggaagtgttttgtatcacttgtcagtaaagcagtgataaagcagtttgtcctagatttatcctctgttcacccagcttaactaatcattagaagagtgaaatctactttctgacatattcactggtaatagtttttttaaaagataaaggcatctgtaccacattcatcttggttagcagcaaattccagatgagttggttgcatatagatttttttgtatgcgggggggaccgttaaaattctacagtgtctgttttcattactactagactgaatgggagcaatagaccttagaatatcatgtgtctgcttaaaagtttgctttccacagtagcagtttagcttcaaaaaattatgatagagggttttgatttctacatgcttaggttttaggaaattcattcaataaatggtgaactcgagttagaaatttggtcaatagatatttttaaattttaaggaatgtataaaataatttttattgcacttcagacatgttaattgaaaaagcaactttgttttaaaaataggactgaaatcaggaaaataaagagagcagatccccaacaacttcgacaagaagattctgacgctgtgtggaatgaactggcatatttcaaaagggaaaaccaggagctaatgattcaaaagtgagtttcatttttaacaatatggacttagataaaatacttgggagaaattttttcatggcttaaaagctattaaagaaacactttataaaatttgaaataatctgatttttgccaataaaagtaaagaaaaaaagactagcttttaaaaatatatatatgtattatgcaataacaagttgcacagttgctagctctaacagaaactggataatatgatctagggattgtgttaattagtgtggctctcatctgttggaggtgtcgctcttcattagcctgtattttagacgctgccgtgcttcatttttggaatgaggtggagaggggataacctagccagccatccttgtttgatctcctagatacatacgcaatgcagaatgcctgagctctcttggttccctgccctgtcctgctaatcccagctgagctcattatggtgtagccttgctgctactcttggagctggagctgtccaagctaattactggtagcagcagaactgcctgttaagggtctggtgtggatctgctaacatggtccttggtagtgacctgcagaagacacaagggaattgccttctttcttgctgtgccctgcctgtcctttgggcttactgctgatttttccacataggtgttttagctgccctaagtataaaacttgatgaaggatactcatattttagaaaacatacagttggtcgcttgatcttataattcacaggctattatattcagcctggcaaagaaagaacatttatttatttaattttaagactaaaaggagttagaccaatataattaacctcttctgctacttaactatttcttcatttagagttaatgcctgacactcaagcatacagttttttaaagcctagatgtctttcagattgctagaatatagcctcattatggtgtaatgtaattaaatgtcactgaattttcttagctgtaaatgagaagcttattttatatactacatgataacatgtataacttttgtttacagccttttccatgtaatgataaacttttgaggaaatgactagaccatatgagatttaaatgttgtatgctcccatttaccacttaaagtgcagtatactctattagttctaaatatttgatgctataatgaaggctcttatcttgaaaactattttatagactcatagatttgtctcagaggcatttcctaataatttcagtagctttattgaaatataactcacaagtcatacaattcacttatataacgtatataattcactggtatattcagagctgcaccgtccattatcacaatctattttagatttacagttttatcaccccccgctactctccccaccaaagcccatatgactttgttgtcactccccagccctcccatccatcctgcccagccctaggaaactactaatcttcttcctgtgtttacagatttgcctattctagacattgcatataaatggcatcatttagtacgtggtcctagactatcttctttcacttagcataacgttttcaaggttcatccatgttgtaaatgtatcaatgcttttatctgatgatctttaatgacccttctgtctctaaaaaagaaagtaattttgaataaagtgaattagttgagagacctaatctaactattcaagaaaatttaggaaggattacctataaatgattgatttggagtttattttatttgttaatgaaatagaactacagaaaaagtaatgaggcctttttaaaattagagaactcagaatcctgatctgttcacttagcaatatttgcactttacaaatagctccttgaattaaatgccgtgtcattcttaaagtgtggaatttttccctgaaatatgttaatattcattaatgtgagagcaatttgtgaaatagttattttttagatcagtcttaatttagtaacaggtaaggaaaaaatttttaaaagaatgctaaagaatggaataaactttaacgtaagcttttttgggggagggttgcattattttgtgaaacatttattcaggtaacaaacctgtttgagcgctgtgtgatagtcagtctgctaggtcaatgaaatgagaataccagacagactttctactctcagggaacttacatggaaacatgtttagtattaaacattcttaatgaaatgtgatgttaaaaataaatgtcaaaaatgttaaaaactaatgtccaaaagtgtcatgataaaacaataaggcattaaatatcagtgctatagtcattcaagtttgttttgaggacagaaattttttaacattgtatgtagtatgttgaatgtttaatgtgcaattttatgagttatatcatatatataaatttgagtaactaccactacaatcggtatgcaaaatagttctatcatctcaaaaaatttcctcatcctgcccctttgtagtcaaatcttcctaccgccactaatacctgatttgttctccttccctatagctttgcctttttcagactgtcatatgcacagaatcatacaggctatttactttctgagactggcttctttccgcataatgtctttgagattcttttgggttggttaatctaatatgttcctttttattgctaaatgatattccattttatggatggaccaccttatccatctattgaagaacatttgggttttttctagttttttgcaattatgaatacagctgctatagacaggtttttgtgtgaacataacttttattttttaagggaaatgcccaggagttgcattacattctgtagactgccctttcattctcttacctgtgtcttttgaatggcaaaagtttttaatttttatgaaatccagtttcaaaccatatcatttttaaattttacattgctagtgtatggatattttgcatgctgacattttagcttgcattattgatagagctaagtctgccatgttattatttatttcctgtttgtttcctctgtttcccatttaattccttcatatgggttacttaagcttttttttagaatttcattttattttttctgtagagtttttgactatatctttttgagtagtttttttttttagtatttgctcttggtattatattatgcatacataccttattacagtctactggtatcaacattttattactttaagtggaatctagaaaccttgttttcatttacatacctttacccttctccattataatacagttatctcaaatattttctctaattacattgagaacctcatcacaagatgtgataggttttgcttcaactgtcaaacataattataaaccacaaaacatgggtcgtctcttatgtttacccataagagataaataatttatgtatgggtaaatataatagaggtattgtttatcctttctactgtcctcattgctagtcttccaagtttcttcttttatagttttctttcagtttgaagaacttcctttagaattattaaaataagttggctggtaagaaattctctgttttcttttaaaatatctggatttcttcttcattatttgtattattctgttttcacagtataaagaaatacacaaaactggataatttataaaggaaagagatttaattgactcacagttccacacggctggggaggcctcaggaaacttacaatcatggtggaaggtgaaggggaagcaaggacctttttcgcatggtggcagaggagaggagtgagaagtgaagggggaagagtcccatataaaaccatcagatctcactagcatgagaacacaccagcatgagatctcactagcatgagaacagcatgagaactgcccccatgatccaatcatggggaacacatgagaacacactagcatgagatctcactagcatgagaactgcccccgtgatccagtcacctcccactaggtctctccctgaacacctaggagattatggggattatgggaattacaattcaagatgagatttgggtggggacacagctagaccatatcactactgaatggtattttcaccatatgtagaattataacttagcaattgtttttcttcagcacttgaaaaatttgctacttccttttggcctctattgtttctgatgcaacatgcactgttgaatctttgttccacaataggtaatgcatcattctgtttacttgctttcaatcatttttccttttctttactcttcagaagtttggtcataacatgtcttggcatggatttgtttgggtttatcctatttgggtttctgtttcttgaatccctaggtttgtgacttttgtcaaatttgggaaatttttgtcattatttctttaaatcctttttaaaccctacatttcttttcctttgacagttctaatcacatgaatgctagatcttttatgattgtcctacaggtcactgagggtctcttcaatttatttttcagcctttcaacctaattttgtctctgttattcagatttggtaatttctattgtgtcgtgtcttcaagtttactgattgtctcttctctcatgagctcatgcagcaagtttttaattttggctattgtaatttttagttctaaaatttccattgggttcttctttatgtataattgtttatttgcttagagtttctatttaatttattttaagagtgttctttagtggttcactggagcattttaatcatggctggtttaaagttcttgtcaagtaattccgacatgtgttatatcatggtggtggcatcctttgaatataatttcatcctttgattatagattttccttgtactttgtatgatgaattattttttaattgtctcctggacatgtggactacagatgtttctcaacctaccttgggttatgtccggataaatccatcataagttgaaaatatcgtaggtcaaaaatgttgctggggcacagtggctcatgcctgtaatcccagcactttgggaggcttaggcgggcagatcacttgaggtcaggggttcgagaccagcctggacaacatggtgaaaccctgtctctactaaaaatacaaagattagccaggtgtggtggcgcacgcctgtaatctcagttactcaggaggctgaggcaggagaatcgcttgaacccaggaggtggaggttgcagtgaaccgagatcatgccattgcactccaacctgggtctgggtgacagtaagactcttgtctcaaaaaaaaaaaaaagaaaaaggaaaagaaaaagaaaatgtattgaatacatgtaaactaccagacatcatagcttagcctagactaccttaaaatgctcagaacacttccattagtttacagttgggcaaaactatctaacacaaaaccattttattttatttatatatattttttgagacagagtctcgctctgtcgctcaggctggagtgcagtggtaccatcttggctcactgcaacccctgcctcccgggttcaaggtattcttctgcctcagcctcctgagtagctggggctatagatgctagccaccacttctggctattttttgtatttttgtagaaacggggtttcaccatgttggtcagtctggtatcgaactcctgacctcaagtgatctgtctgcctccacctcccaaagtgctgggattgcaggcatgagccactgcgcccaccaaaacccattttatgataacgcactgagtatgtcgtacgtcacttattgccagcctgggaaaagatcagaattcaaaatttgaagtacgttaaaattgcaaaagctttacaccatcataaagttgaaaaatcgttaaggagaagcattgtaaatcagtgattatgtgtattctattttgagactgtggatcttatttaaatcttttattttagcaggcctctgatgatatcatgcctgagggagaaggtcacgtcaatactactaggaaaagatgggagacttactcctcccttttacctcttttcctctgctgacattgcatcgagagagtttgaaggggttcctgcttagtgttggtgaaagtgcaggcttctcactctgctttctttctttctttctttcttttttttttttttttgagacggagtcttgctctgtcgcccaggctgcagtgcagtggagtgattttggctcactgcagcctctgcctcctgggttcaagtaaatctcctgcctcagcctccctagtagctgggattataggcatgcgtcaccacgcggggcaaatttttgtattttctgtagagatggggtttcaccatgttgtccagactggtcttgagctctgacctcaagtaatccacttgccttggcctcccaaagtgctgggattacaggtgtgagccaccgtgcctggccctcactctgctttcattgacggagcatggctgctttttgttttgttttttccccctagttgattatggctggagtagggtgggcatggtgagcagggtttttgttttactggtcctcacctttcctgtacctttggctagagagagtaggctttccttgaagcattttttgtttctgttcattggcacttctaggtggtgagtttctctaggaactagcttggggtaggtaggaggaaagaagaaaactcaaggaactcaccactgtgagtcacttctctaatgttgttccactactcctgagctccctattctatccttcttcttttccctacttttcaaagtctcatgtttgttttattatgttctgggtttttataattaattagcaggaggaatagagataaatacatctactccttgttgggaaacagaagtttcagcttgtttttctatgggccaggcagtcttacttttgagtcattcattaatatctagtttcatactcagtcttaactgtttaagtaataagatgtacccctttttctgcaataatgtttcttttaaatgtaaggttagaatctacaaaaaaagatatactattaatactacctttcaactgaatttaaatagtacttccaaatcgaattttaaaagttaacttttaaagacttttataaaacattgtatgacaactgtacatcaatttacaaaatatagttaaaaatataatgctaccactgactgaaattatagagtttctaccattgagtatggtcggaaatattagttgctgctatcgcataggaatctgaggacttaaaaaacttacatggaatatagttcctataatatttcatttatatttataagatatatctatcatatcataactatattttaataaaaaggccaagaacttagtaatctgtgaactgataaattggctggttccttcagtatttaatgagcattcatgtgttcatttattcattcattcaatattttaacaatataattcagagccaggcactaaccaggggctgaacatacagtatagtttcaagctctaggaaggcttaatttaaataggggtatctgccatttgctagttaggtgaaaccactctttggaagctagatagtaagaggcaagctttcagaaatgccagcaggcttagtcagctttctcactcagttgaagttgttgccttaccaatgctaaattagatgaagtacccatcacagtccaacatatgttaacattcttccaagtgaaagtattagtaaaaaaagtttgtgtacattctttcagaatggtgatataaaactataataaggggctcaagtgcagcagaaaattaagcttctctaatccagcaaattatatattacacattgtcaaccacaattgcatgtttttgctaggaatcctgggtgtactgacattcgtgtgtgttttctgtgaccttggctaagtaaatcagaaatgtgcagtggtttagtaataggtctttctatactaatctgtagcctatgtaaaatgctttagatgggtacttttttaggcacaggtaaacaaagagaaataatgttaccccttttatcaggtcctcatagcttagcagagaagacaagcaaaagtgtgattaaaagcaataataagagaatattagggacacaaggcagggaaagctgtattctgcttgtgagtggaaaaagaggtaacgcaaatctcttgctgatataacaaaacgccataggctgggtggcttaacagacatgcatttctgatagttttggaggctgagaaattcaagatcatggtgccgatggattaggttcctgatgagggctctcttcctggcttgtagatggctgctttctcagtgtattatcacatttcagatttctcatcttaaaaagccactcagtccatcatgaggacccctttctatccctaattgctactcaaagtccccatctccgactatcatcacattaggggttagagtttcagctgagttcaaatctgatgtatgaacacagttacagctgaccaacatatgtcatatataacacatatgtcacatacagattttgagaggacgtaattaagttcatagcaatcaatattttagactacaatttgttaagcataattaaatcaaagacagaaaaatctaggtaaattgttaaataaccaggaggtaactaaaggatactttttcaaattctcgccagtatatgaaaaagctggtcacactctttaaaacaaattttttcttcaacactctggcaccatctcttctggttttatctctgtacctctggccacctattcacattctccattgccagcttttccccctgaaatcagctgtttactgttgcagtatttttgaactttgtcataggcgttctctgtacttcatttgcatatttgcctatgacaatgtcatctatcatcccatgattttagtcatttcttgccagttgactttcagacctgtatatctagcatagaaccctctttctgaactgcaactaagtatatccaaatgtctacacaacatctccttttggaggtctcactgagattcaacatgtttgaaaccaaattcacgatctccaaatttattcccgtccattattctaaatcttagtaaatggtattataatctatcagtttcctcaaaccagaaaccatggtgttataagtttatgtattattttttttctgacctcccctcattgaagtccatactaagccttaatatttcacatcacaaacatcctatcttatttctttccatcctcactgttacgcccttattcataccaccaccatttcttccctagtcaactagaataaactcataaacatctgcatccactcttatctcttcatatctattttcaacagtgctgcagattgaccttttaaactatagttctgagaatgtctctcatctgtttaaaaactttaagtatctttccattgctctttaagcaaatctgagttcattatataacacacttgaatatcagctccccccttttatttttttacaatttctgctttcccttttgtttcatatctaaaaataagtatgagaatgcaaaatacttgcacagaattactaatgttttcctagctgatactgagaattctgggtggcaagtttgtcaatgaaggcagttgagctggagtcagtagtaaaggggttttgaattcataatacaaaaacttttttatttcatagaagtaggaaattttacccccatgtattataagtagatatatcttctttatttcaatgatcttttggtcatttttccttaatgataaaatgtaagctacagatcagtggcatagctcggattggagtacttctctttggggttaaatattaaatatatgttggccatagttttaaagaatatcctataaaatccataataattgcttaagtagctaaaatcaaaatattatcctaggaaagttcagccattatttttttcctctgcaaagcaagactcccaatcttctcaagctagaatatatatatatatatatatatatatattttttttttttttggtatgtagaaatgaggattttaggaactgcatttttctgagatggaaagaaaatgcttagcaaaaaatgtctgccaatgatgacatattttgaaaacaaatgtattttcaggtaaccattaacaatatataaatttcacattagttgtattttaaagcatagaattcagtggcatttagtgcattcacagtgttgtttagcagtgaactttaattcaaaagcattttcatcaccactgaaggagaccccatgcccattaaccagtcagtctctgtctccccatttgtcccttctttcaattgctggcaaccgcttatctgctttctgtttctatggatttacctattttgaatatttcatataaatagaatcatacaatatgtgacctttgtgtctggcttctttcacttagcataatattttcaagattcatccacattgaagcctgtgtcaaaagttcattacttttttatggctgaataatatccctttgtttatgtataccacaatttgtttctccattaatcccttggtggacatttgggttccttccacattttggctactctgaatagtgctgctatgaacatttgtatacaagggattgtttgaatacctgtttccagttcttttgggtataaacctatgagtggaatcactgggccacatgctaatctatgtttgttttttatttttctattttttgtagggtcggggtctcactttgttgcctaggctagtcttgaactcctggcctcaagcgatcctcccatgtcagcctcccagagtactgggattataggcatgagcgatagtaccctgctttatgtttaattttttaaggaactgccaaactttttttttttttttttttacagtggctgcacaattttatattgtttgccgtctatgagggttctaatttccccacatcctcaccaatacttgttatggtctgtttttgttttgtattatttttgttctttattatcgccaaaattgtgggttttgatttgcattttcttaatgagtaatgatgctgaccatatttgcatgtgtttctttggccagttgtttatcatctttggagaaatgtctgttcgtgtcctttacctattttgaaaactgggttgtttatctttttttattgtaatagttttgttttcgtttttttttttttttaactgagacggggtcttgctctgttgcccaggttgaagtgcagtggtgtgatcttggctcactgcaacctctgcctcttggtttcaagcaattatcctgcctcagcttcctgagtagctgggattacaggcgtgtgccactgagaggtgacagcgtgctggcagccctcagagccctcgcttgctctccgcacctcctctacctgggctcccactttggtggcacttgaggagcccttcagcccaccactgcactgtgggagcccctttctgggctggccaaggctggagcccactccctcagcttacagggaggtgtggagggagaggcgtgagcgggaacccgggctgtgtgcggtgcttgttggccagctggagtttcgggtgggcgtgggcttggcggccccgcactcggagcagccgaccagccctgccggccccaggcaatgagggacttagcacccgggccagtggctgcggagggtgtactgggtcccgcagcagtgccagcccaccggcgctgcgctcaatttctcacagagccttaggtgccttcccgccgggcagggctcgggacctgcagcccgccatgcctgagcctcccacccactccatgggctcctgtgcagcccgagcctccccgacgagcaccaccccctgctccagggcgcccagtcccgtagaccacctaagggctgaggagtgcaggcgcacggcaccgggactggcaggcagctccacctgcagccccggtgcgggatccactgggtgaagccagctgggcttctgagtctggtggggccttggaggacctttatgtctagctcagggattgtaaatatacaccaatcggcactctgtatctagctcaaggtttgtaaacacaccactcagcaccctgtgtttagctcaaggtttgtgagtgcaccaatcaacactctgtatctagctgctctggtggggccttggagaacctgtgtgtggaaactatatctaactaatctgatggggacgtggagaacctttgtatctagctcagggattgtaaatgcaccaatcagcgccctgtcaaaagaggccacttggctctaccaatcagcaggatgtgggtggggccagataagagaataaaagcaggctgcccgagccagcgttggcaacccgctccagtccccttccacactgtggaagctttgttctttcgctctttgcaataaatcttgctattgctcactctttgggtccacactgcttttatgagctgtaacaccgccaagatctgcagtttcactcctgagcccagcgagaccacgagcccaccgggaggaaggaacaactccagacacgctgtgttgagagctgtaacactcaccgcgaaggtctgcagcttcactcctgagccagcgagaccacgaacccaccagaaggaagaaactcggaacacatctgaacatcagaagggacagactccagacgcgccactttaagagctgtaacactcaccgcgagggtccgcagcttcattcttgaagttagtgagaccaagaacccaccaattccggacacactggttaatttttgtgtttttagtagggacggggtttcgccatgttgccaacacaggctggtcctgaactcctgacttcaagtaatccaccagccttggcctcccaaactgctgggattacaggtgtgagccaccgtgcccagccatagttctttacatattctagatgttagacatttgcaagagtttcctcccattccgtaggctatatttcccctttttgatagtatcctttgatgcatgaaagtttttcattttaatgaagtacatattgtttattcttgttgtagcttatgcttttggtgtcataatctcagaatccataatgaaatcccatagtcagagatttatcctcatgtttttctgtagttgtttaatagttttaactcttatatttaggcctttcatctactttgagttaattttttatatgtggtgtgaagtagggggtccagtttcattttttacaggttgatactcagttatcccaaataataatttctgtaggtttagaaaacaggcagtatgattatgtgcaataattaatgagattgattaataagataagaacttgaatgtatctgtgcctaagaaatcagtccaggctgggcgcagtggctcacgcctgtaatcccagcactttgggaggctgaggcgggtggatcacgaggttaagagatcgagaccatcctggccaacatagtgaaagcccgtctctactaaaaatacaaaaaattagccaggtgtggtggcgggcgcctgtagtcccagctactcggtaggctgagacaggagactggtgtgaaactgggaggtggagcttgcagtgagccgagatcacgccactgcactccagcctgggcaacaaagcgagactccatctcaaaaaaaaaaaaaaaaaagaaaaaggaaatcagtccaacaggaaaaagcattgcatatcataagtcaagagcaaatcagaatattaaggtcagagataatagtttaatcaagagttgtgtaagtttttcttatcaggatctgttttaaagaaagacaatgaacttcaaggctatgtggcaaaaagttttgaatgttagttactttatgattgataatcaagcacaagaaactcatacactaagattgtagctcagaggaagtaaactcatctgttaattatccctaggtaagagtggaaagtttcagaataagattaacctaaaacctaattatttgctaagttagagtactgaagcctatggtcaattatattcctcttttctatgtcttgaatgcttcagagtctgatgcaacatgacttatagataggctttgagcagtgactcttgatgctctaaaagtactagggcttgggaccaggtaaaccgttatagctaagaaaataatatatgggaaaatgcttttaaactatggagttttataatattagttacatgtaactgaatctgtgtgaccttttgtgctgcttttgctttcctttgttacttcaataaatatgctgggcactataagtaaaatatttagcagaacacacatggctcctggcctcatagagcttcaacttattggagaatgcaaatagtaatcaataagcatacagatatgtaatttaaaattgtgattaatatgaagataaagctcttctatgcgtttccatttttatgtttttccccttattctttccactttttcccctttctgtttcctgccctccccatatacctaaaatatagaaatgatttacacatttgtttgctgtacaattagcctacactgtaggtgagaatgtattatgagtgtgtgtgtgtatatatacatatttgtttctcatttcctacttctcacagcccctgtctctttctgctttctgtctctatggatttgcctattctaggtgcttcatgtaagtggaatcatttaatatttgtcttttttgtatgtggattatttcatttactatttcttcaagatttatccttgttgaaccatgtgccagaagttccttactttttaaggctgaataatgtttcattttatgtatataccacattttgtttattcagccattgatggatgtttgggttttttccatgttccagcttttatattttttagttgtattctaatttgtattttgctataaagtcaacaggattctttgtatcctccacaggcagatatatcacttgagtaaatggcaagtatattttggaattttattttgtaactctggagattaactttcaatgtttatcccttaggttgtattcagacatgagtccatatacatatgatatttattttttgaggccatacatatattattctaaatttatttactactatagtttgtttccacatattttgggtaccatgtatatatataaatactacatatatatatatataaatactacatatatatataaatactacatatatatatagtatttttaaattttcttaaagaattacataagaaaatcttgagtgttataatcatttgatttttctgtgaaaagacagcaaagttactttccataagtcaattttgtcacacgaactcattctatttgatagtatttttttctttagaataaataaccttaacaatgttgggtttgaacatctgaattgaatgctaatgactaaataataaaatttattttgaatgacaggaaactgatacaaagggtttgtttagtctggaaagtatttcaggctttagaacagtttgttttcagtgtagattagttgcttcttaagaaactttgttctgaagaaaagaatgatatataatcaaatgtaggaatgttacaggtaaagttatcttcagatataaaaaagttttaaatttggtaatatattttccaatatttgtagttttatctagggaatataaaaacccttgagagaaaaattttactcttaaagagattcttatgatgtttttaaaggtagtgaaacaggatgcatgaataagggtgttcgctgcagcagtttggtaatagtgaacaattagaagcaatctaaatgtctcttagtgatagatacaaatacattgtgatacattaatataatttgatactctactgcatttaacatgcataaactagatctaaacttatcaaaatagaaatgcttaaaaagcaaaagttgattgaaaagaagaaagttgaataacagtatatatactatgatataatttctaagtgtaaaatgtttagaaatcacaaaatgatactatatatttttgtagatgtatatgtagacatacacatttgtaaaaatatagttacacataactgcacacatgtagacgtacacgtgtgtatgtactacatatacactatacacatacatatatcaaaaatcaaagtgatgaattaaatatggcataatgtgaatattttaaaatctagttgttacattaatgttgattatattattttccatacttttttaatgtttgaaatatgctttctactttttaaagtatgtactaaaaaagtaataattctacttctagttagaaacactaaaaggaatcttgtatatgagcacatatacaagaatgctcactacagcattgtttgtaattatggaaatttggagacaaccaaaatagcagatgatgtagctacatagctaaaattccaaaaaaacctatttaatagaatattttagccaactccaaacccaaaagtcagttttagattgattatagtctaaatgtgaagggttaagcagtaaagcttttagaggaaaacataggagaacatctttgtgactttgtagtaggccaatatttattcctctcctctcccctcccctcccctcccctctctttttgaaataaggtcttactttgtcactccgctggagtgcagtggcacaatctcagcttgctgcagcctcaacttcctgggttcaagtgattctcccacctcagccccccaagtagttggtactacaggcgcatgccaccatgcctggctaattttttgtacttttgtagagatagggttatgccatgttgcccaggctggtctcaaactcctgagctcaagcaatccacttgctttggcctcctaaagtgctaggattacaggtgtgagctactgcacctgcccaatttcttaaaccaggcataaaaagcactaaatagaaatgaaaaattgataaattggcctatgttaaaaccaagaacttaatgttcattaaaaaataccattaaacgaattaaaaggctactttctgagtatgaaaagatattttcagtatatatgtccaggaaagtagtagtactcagaatatatgaagaattcctgtgactaaataagaaaaggacagtcaacccaatagaaaaatgagcaaaacacttgaacagatatttcacataagaggacatccaggccgagtgcggtggctcacgcctgtaatcccagcactttgggaggccgagtcgggtggatcacgaggtccggagatcaaaaccatcctggctaacacggtgaaactccgtctatactaaaaatacaaaaaaaaaaaaaaaaaaaaaaaaactagctgggtgtagtggcgggcgcctgtagtcccagctactcaggaggctgaggcaggagaatggcgtgaacctgggaggcggagcttgcagtgagccgagatcttgccactgcactccagcctgggcaacagagtgaggctgtctcaaaaaaaaaaataataataaaaataaacaaatgagaggacatacggacatactaatggccaataagcacatgaaaaagtgttcatcttgatgtgtcttatttttctagatttttaaattggaagcttgcatcattatggatatttctttttttccaatttaagtattgtatgttgcaatatagatatccatctaaggattgcttttgctgtgccttacaaattttgaagtgtattttaaatttttctaagttcaaaataattcctagttcctcttggattcttctttgaaagtagaactgtttagaagcattatagaaaaatgttattcaatgaaacttgttaaagtttggtaaagaagactatttaggaccatcatcataggtagggaccactgcagtcggattttgcagttggggagaaaattggactcaactcctaatacagcatgggtaagtgggaatttatagctaaggtagaggtcagtggattggaaaattagtaagaggaaacatcagtgggaagggagattctggctaaactgaccttatcaggattttgattgaagacaggctagggtgatcagatacagcctagggggtggtggaggatgaggaacccagttagatattggccttgatttatatattgtggtggaagagattcttgctaaactgacttagtggagttccttgctaagactggattttacaaggaagtgcacagatgggcttaggagaaggttcaggagagttgactaaagattggttaagcagaacctctttgtcagaaataggttctttagtttcaactattttgggattttgcagacgtccttctggtatttatttttaattttattattctattgtggtcatagaagatgctttgcatgattttaaaatgcttttagctttactgagaattgttttatagcccagcatgtggtcttatcttgttgaatgttccatggcacttgaaaagaatatttgttttgctgttgttgggtatggagtgttttataaaacattcagttaggtcaagttttttgatagtgtttttcaaatgttctgtatccttacttatttctgtccactttttccatcaattactgggagaggtgtgttaaaatctcagtttaaatatcttcagttttttttccatttttttaaattattattatactttaagttttagggtacatgtgcacaacgtgcaggtttgttacatatgtatacatgtgccatgttggtgtgctgcacccattaactcctcatttagcattagatatatctcctaatgctatccctcccccgtctccccaccccacaacagtccccagtgtgtgatgttccccttcctgtgtccatgtgttctcattgttcatttaaaacacttttttagcacaggttttagagtatcatttactagaggcttgtttatctctactcattagaatgacccatctgtgttctctattgaatgcctctgatgttcaactaagattctctcttctctgactggtcgcaactcaaatgtatcccaatcctgtgtgagaaatattctgggaatattctgtttatagctcctgttgttctttgcctggccttgttgtgtttcatactatgcacatgcaaaaaaagaaataaagattagccacatactcaaaggaattcttatgcagatttctttagcttttttccactgtagattcctcctcacttggtcatatgcctcacaaattctggctgttttagacttcctaaactgcagtctcttgtttcaactcaatgagactgtcatgttcttcttgggacccctctccctgtctggaaagtgctttcaggcagaaatcgagccatcattaagggctctctctgtttatttgctttctctcagggattacagttctgtgctgcctattgtccagtggccgaatacagttgtttcctatcatttgtccagtaagaaatagattttaaattgtggtcctcataccagagtataagaaacaccagtgtaagtggatagtaaatcagagtcagtagctagtcagtgctcatcctggtcaggagtaccagggctctgcctctgtcagctcctccctcaaacacacagtaagatatggtttgttggtgcttagtttgactcaagaacaaggtggtccctgatgtctgtaaatatttattaaaagtagggactgtgtgtgttctttccaaaagaaacaagctgtaagtataaagtatgttttaagaagcaagaaataacttttccaacaactgcagccctaccttctgttgggttagtgatctgagagccaaggaaaactaagttgaggtaagttacacctgctttttctttgtggggccatcttgcttcagtatgttccacgttcttaaataaacaaatcaggaacctaatccaagcttaatcattgtgtggttgagtgtatgtgtgtgcatgtgtatgtgttcctcctatcaatctgtaatggacctgggaagctgccagtatatatcatgggatcccagtttttaaaatccttatgtgtgtgaattgatgtttataatatatgaacaaaaaatgagagtatacatatcaaagtgtaaacattattttttttccaggaagtatactgagtgaggggaaggagaggctacctaatttttacttcaaataactttttattgtttgaataattataacaataattacaacaacttgtgttgttgagtacataaaagtctagaactaatgtattttcctggtaaatcatttttgatcattgtgtgatgactatctttatttttaatttttttcttgcacgttttattttcttatgctcctttttttaaaattatactttaagttctgggatacatgtgcagagtatgcaggtttattacataggtatacacgtgccatggtggtttgctgcacccatcaacccatcatctacattaagtatttctcctaatgctatccctcccctagtcccccataccccaacaggccccagtgtgtgatgtttccctctctgtgtccatgtgttctcattgtccaactcccacttatgagtgagaaaatgcggtatttggttttctgttttgttagtttgctgagaatgatggtttccagcttcatccatgtccctgcaaaggacatgaagtcatccttttttatggctgcatagtattccatggtgtatatgtgccacatgttctttatccagtctatcattgatgggcatttgggttggttccaagcctttgctattgtgaacaaacatacaagtgcgtgtgcctttatagtaggatgatttataatcctctgggtatacccagtaatgggattgctgggtcaaatagtatttctggttctagatccttgagaaatcgccacactgtcttccacaatggttgaactaatttacatttccaccagcagtgtaagagcattcctgtttctccacatcctctccagcatctcttgtttcccgactttttaatgatcaccattctaactggcgtgagatggtatctcattgtagttttgacttatgctcctttttaaaaatgactttcttgcctttgatttgatacagttttttttttcatttctcttctgacctctaatttttattttttatatttattttttattctttaaataattattcttgaaattataacatacatcatttatttgacaaagtctaaagttcatcactagctgtatcctcctacaatacaaggaccttgaaatgtttaactatggtatctttgatgatccaatatcgttttgttgttgagaatgttagttctaccttattttagctcattcagatattgctatgattgctttagataataaatgtttatttaattccttgtatatatctgttagtgtctttcttcatcactgcttattttgttttataccttgcttttgagtacattttcttcttaaaatatatattttaatgattttttcatctaggatctatgagtagtaaactttggcatgtgaaagatattaattattttccttctggctttgtttgttgatatgagaactctgctgttattccagagatctttagttgttagaagtgttttcttctcaatctggttcatttaaagattgtctctatctttgttgtcctgaagtttcactaagacatttttaagtgtgaacagagttttatttactcttcttgcaattttttgatactctttaaggctattaattcatatcttcatcagttctcaaatcctgagctattaatattttgactgttatctcccatctgtactcctgccttcagtctttcaattctctccttgaataatttctattaaatgctttctatacttcttattgcaacatgttttgtatacctctactgttttccttcctttacctccttctgctctcttccattttatcaatttccattagctttttctacttgctattgaacccatccattgagttttaaatttctggtattatgttattattattaattttcattgctttatttcatatttttagatatattatttgattatttttgtctattttctgtttcataaacccctgttcttttttaatatatgtttatcacttctttatctttttaaaaacattttaaaaactctaatggtgaaagtaattttgattattctcttatctctattttattgttttacattatcccattttgggcagtgggatatttagactgtcattcatggctttgaacttatttatatacttattgtctccatgcttgactcgagaattattttctgtggtggcttttctcccatacattttcttagttgtggaagcctccctttagggatgattgtgtcttcctgaaccctccagtatactctggccatatgtccagtttttgtattatttttgattgttcatgtttctgtaaattgtatggctcagttttgaacctattgatttaggcttgggattctgatatcatgtggttgactctgtcctgtccccatcctagggctggagaactattttagtgaaactctaaccagataagttcagatattcaggttttcattcagcagattgttttctcccagtttcctgtcgttagctcatttttatctgtcaaccaggtagggccatgggtctaaatgtccatctgatatggtttggatttgtgtccctgcccaaatttcatgtcgcattgtaatccccagtggtgaaggaggggtctggtgagaggtgacttgatcatgtgggcggacttcccccttgctgttccattgatagtgagttctcataagatccggttgtttaaaagtgtgtagcacctccctctgtgctcttttcctcctgttccagccatgtaagacctgcctgcttcctgttccccttctgccatgaatgttaagtttcatgaggcctcctcagccatgcttcctgtacagtctgtggaactgtgagtcaattgaacctcttttctttataaattacgtagtctcaggaggttttttttatagcaaagtgagaatagactaatacaccatccctactcaggtctcacattctgaggtccccatgggcagtatttggttctggtcaaatactcacaatggtagctcaattctgttttactggaaagtctttttgcctttatttggcatctaggaatttaccattcttgttttcagtgttatgtattaacatttttcattactattttgcctagaatatctctgtgttaggatgtggttgagcatggcgggtgttgtggctcatgcctgtgatcccagcattttgggaggccaagatgagtaggttgcttgagtccaggagttcagcctatgcaacttggtaaaaccctgattgtacaaaaaattagctgggcatggtggcacacacctgtagtcccagctacttaggaggctgaggtgggaggatcacctgagcctgggaggtaggggctgcagtaagccacgattgtgccactgcacttcagcttgggtgacagagtgagactttgtctaaaaacaaccaagaagtggttgagcaatttaatacataatttttaaaattatatagtctgtattttaagtgtttagcatgtttattgagataaagttaacagaaataacttacttaaaacatttgattttccaggtcctcagtaaattcaattgtagttttttggatttgggcatattattactattttttattttatggagacaagggcctaatcttttgcccaggctgtagtgcagcagtgaaattatagcttactgtaaccttgaagtcttgggctgaattaatcctgctgcctcagcatcccaagtagctaggactacaggtgcgcgtaaccatgatgggctagttgttattgttgttgttattattattattattgtaaagacagggtctctctgtgttgcccaggctggtcttgaacttctagtctcaagtgatccccttgccttggctttctaaaatgctggaattgtaggtatgagccaccatgcccagcctgtgaatattattgatttatttttgctttcattttactcttctccattttatatacattaaaatatctttactgactttgatatattatttagaaatatatttaaatgtatatgtttgatttttttaaataaaacaatatggttttaagtaaatgtttattgctttttcataggatgaatcttgaagaagaattagatgaacttaaagtacatatatctattgataaggcagcaatacaagaattgaatagatgtgtggcagagagaagagaaggtaaattttcagaaaataaatacttaacagaggaattttaaaattgtgtaattcttgatgttttagtttcaatttcttttaagaatcttaccctttttgtttcttttccaacactttattcattgataactcactaacattttcatcctgagaaaattaaataaatagaacatctaaaagtcagctttgtaatttattaaaaaatctaggggagaacgtacagcaagatggccaaatagaagactttatgctgtgggaactccaaatttaagaactacctacacacacaaaaaaaacacctacataagaatcagaaatcaggtgagcactcacagtacctggttttaacttcaaatgactgaaagaggcactgaagagggtaggaaagacagtcttaaattaccagtgccacccttcccctatctcctggcagtggccatgtgacatggagagagaattgtgcacttaggggagggagaatgcagtgactgttggactttgcattgaactcggtcttgccctgtcatagcagagagcaaaaccgggccaaatgcatctcatgcctgcccacagaaagagcatttagaccagacctgtccagaggacaatcacccatcccagtggttggaacctgagttctggcaagcctcattaccacaggactttggggctctatataaacttaaaagactgtctaggccacaatgacttcaactcctaggcaagccctagtgcagagttgggctcagaccagtggacttgggtggcatgtgacctactgagacaccagccagggcagctcatggggtatttgtgccactgctctcccaacccttggcagcacagctcatggctctgaaaggaaccccttccatctgcttgaggaggagagaagaaagatcaaataggtctttgtcttgcatcttggacagcagctcagccacaataggatagggcgctagttagatttatgagacccttattctaggccctagctcctggatgacatttctagacacatcctgggctagaagcgaacctggtgccttgaaggcaaggatgcagtcccggcaggatctatcacctactgactgaagagcccttgggccctgaataaccagcagcaatacccagatggtacactgtgggtcttggctgagactctgagatgtgctggattcaggtgaaacccagggcatccccagctgtggtggctgtggtgagaaacccctgcatgagaaaagcagagggaaaagtaaagggtaatttgtcttgcaccttaggtaccagctcatccacaatgaagtagaacaccaagcagcttgtggggtcattgattccaggctttggctcttagttggcatttctagacctgccctgggccagagggaaacccattgcactgaaaggtgagtcccaggcctggcagcatttgtggcaagctgactgaagagcccttgggctttaaggaacattgacagtggcctggtagtactccctgtaggactgtggtggtggtgaccacaggcagagactcctttgcctgtggaaagggaagggaagagtgggaaggactgtgtctggtggtttgagtgccagctcagctgcagtggactagaacaccaggtggatttctaaggttttttactctactccctggctcctagatggcatctctggacccacccagggctggagggatcctgctaccctgaagggaatgacacaagtctgactggcttcacagtctgctctttgcagagccctagggccttgagcaaacataggtggaagccagatagtggttacagtgggccttgggtgagactcagggatatactggtgtcagttctgacccccagcatagtcccagtggtggtggccacaggggtgcatttgtcactccatccccagctccagaaggctcagcaaagagagagagactctgtttgtttgggagaaggaaagaaaacaagagtctctgcctggtaatccagagaattcttccggatcttatccaagactgcccaggcagtagttctagaagtcggcaagaaccccagtcttactggacttggggtgcccactaatgcagatatggactagatcacaacacccaagtcctttcaaataccggaaagtcttgggctgaatcaatcctactgccttagcatctttgtacccatcttctcaagaagattgggtacaaacaatcccagactgcaaagacaaaaataaatatctaacttttgtattcccagacaccagcaaacatccataaggatcaagactatccaagtgataggttacgctttgtgtccccaccccagactcatcttgaattataatccccataatctccacgtgtcaaaagagagaccaggtggaggtaattgaatcatgggggtggtttctcccatgctgctctcatgatagtgagtgagttctcatgaaatctgatggttttgtaaggggctttttccccgttcgcttggcacttctccttcctgctgccttgtgaagaaggtgccttgcttccccttcaccttccaccatgattattagtttccagaggcctccccagccatgctgagttgtgagtcaattaaatctctttcctttattactcagtcttgagcagttccttatagaagtatgaaaacaggataatataccaagaaaacatgacttcatcaaacaaacgaaatgaggcacctgggatcaatactgcagaaacagatatgtagcctttcagacagagaattccaaataactgttttgaggaaactcaaagaaattcaagataacatggagaaggatttcagaattctatcagagaaatttaacaaagtgattgaaaaaataaaaaagaatcaagcagaaattctggaatgaaaaatgcactggagtcccctcatagcagaattgatcaagcagaagaaggaattagtgagcttgaagacaggctatttgaaaatacatagtcagggcgggtgtggtggctcatgcctgtaatcccagcactttaggaggctgaggtgggaggatcacctaatgtcaggaatttgagatgagcctggccaatatggtggaaccctgtctctactaaaaatacaaacattagccaggcatggtggcacatgccggtgatcccagctacttgggaggctgagtcaggggaatcgcttgaccccgggaggcggaggttgctgtgaatcgagatcacgccactgcactccagcctggtgacaaagcgagactccatctcgaaaaaaaaaaaaaagaaaatacacagaggagataaaagaataaaaaacaatgaagcatgcctacaagattaatgaaatagcctcaaaagggaaaatgtaggagttattggccttaaacaggagttagtgaaaaagacaggagtacaaagtttattcaaagggaaaataacagagaacttttcaaacctagcaaaagataacaatattcaactatgagaaagttgtagaacaccaagcaggtttaacccaaaaaagacaacctgaaggcatttaacaaactcccaagggtcaaggataaagaaaggaccctaaaagcagcaagagaaaagaaacaaataacatacaatggagcttcaatatgctggcagcagacttttcagtggaaactttacaggctaggagatagtggcatgacatacttaaagtgctgaaggaaaaaacaacaacagacttttgccctggaataatatatcctgcaaaaatatccttcaaacatgaaggagaaatgctttgacaggcaaacaaaagctggagatttcatcaacaccatacctatcctacaagaagtcataaatggaatacttaaatcagaaaaaggatattaatgagtaataaatcatctgaaggtacaaaagtcactggcaatagtaagtacacagaatgacatacaatattgtaataccgtaacagtggtatacaaactactcttaagtagaaagacttaaagatgagccaatcaaaaaataactataaaaagttttcaagacatagtataataagatataaacaacaaaaagttaaaaacaggctggacaaagttaaataatttttatcagttttgtttttgcttgtttatgcaagcagtgttgttaatccagttaaaataatgggttataagatagttatatcccatatatataatgggttgcaacattcattgtaacctcaaatcaaaaaccatacagtggctacgcaaaaaataaaaagaaaggaataaaattttcgttttattttaggagaaaaggtaagagaaaattaccttcactacaaggaaaacaagaaagaatgaaggaaggaaaagaagaccacaaaataaccaggaaaccaacaacaaaatggtaggagtaagttcttacttattggtaatcacattgaatgtgaatggactaaactctgtaatcaaaatacacagagtaactgaaaggatgtaaaaatcagagccactctctgttgtatataagaaacgcttcatctataaagaaacatatagactgaaaataaacaaatggaaaaagatactccatgccagtacaaaccaaagaagagcaggagtagctatacttatatcagaccaaatagatttcaagcaaaaactgtaagagacaaaggtcattatataatgataaaggtgtcaatttagtaagaggatatcatagttgtaaatatatattcacccaacacgctagtacccagatatataaagcaaatattattagagctaaagagaaatgtagaccctaattcaatgatagctgcaggctttagtatcccactttcagcattggacagatcttccagacagaaaatcaacaaagaaacattggaattaatttgtactgtagaccaaatggagctaatatttacagaacatttcatccaatggctgcagaatacacattcttctccccagcacatcgatcattctcgaggacagactgtgtgttaagccataaaacaactcttaaaacattcaaaaaacttgaaataatatcaagcatcttacctgacaacaatggaatagcactagtaatcaataacatgaaaaattttggaagctctgcagacatatggaaattaaacaatgtgctcctgaatgacccgtgtgtcaatgaagaaattaaggaggaaatttaaaaatttcttgaaacaaatgataatggaagcacaacatactagaacctatgggatacagcaaaagcaatactaagagggaagtttatagctataaatgcctacatcaaagaagaagaaaaatttcaaataacttaacgatgcatcttgaagagctagaaaagctagagctaatcaaacccaaaattagtaaaagaaaagaagtagtaaagatcagagcagagataaataaaattaaaatgaataaaacaatatgaaaaaatcattaaaacaaaaaattggtttatcaaaaagctaaccaaaatttacaaacgtttaaccagactaagaaaaagagaacacaaataaatatcagatgtgaaaaagtagacattacaacagatactgcagaaatttaaagcattgttagtggctactatcaccaactatatgccaaattcatatcagctatatgccaataaattggaaaatctagaagaaatggataaattcttatacacatacaacctactaagattattgaaccatgaagaaatccagagcctcaacggaactataataagtaaagacactgatgccataatgcagaggctcccagcaaagaaacaaccaggacctggtgacttcactgctgaactctaccagacatttaaagaagaactaactccaatcctactcaagctattccaaaaggtagaagaggagggaatactttcaaactcattctacaaggccagtattagcttgataccaaaaccagacaaagacacatcaaaaaaaggaaactatagttcaatatccctgatgaacattgatgcagaaaaaacctctgcaagatactagcaagctgaattcaacaacacattaaaaaattagtcatcatgaccaggtgggatttatccaagggttgcaaggatggttcaacatttggacattaatcaatgtgatacatattatcaacagaatgaaggacaaaaaccataggatcattttacttagtcctgaaaaagcattcagtgaaattcaacattctttcatgagaaaatctctcaaaaaactggtttcattggaacaaacatacatcaggataataaaaggcatataggacagagctattgctggttatcatattgaatcaggaaaaactgaaagcttttcctttaagatttggaacgtgaccatgatgcctactttcaccactgttattcaacatagtactggatgtcctagttagggcagtcacacaacagaaagaaagaaagggcatccaaattaggaagaagtcaaattatctttatttgccaatgataagattttgtatttggaaaaacttaagagtccataaaaaaactattagaaaggataaacaaattcagtaaagtggaggatacaaaatcaacatacaaaaatcagtatcatttctatatgccaacagcaaacaatctgaaaaagaaatcaagaaagctaattccatttacagcagctacacctaaaagtcagtacctaggatttaaccggagaagtgaagaatcttcctacaataaaaactatagaatattgatgaaagaaattgaaggagacacacaaaaaatggaaagacatccccttttaatggattgttaaattgttaacaatattgttaaaatgaccatattacctaaagcaatctacagatttaatgcaagccctataaaaataccaatgacattcttcacagaaacagaaaaaacaatcctaaaatttatatagaataaaagagacccagaatagccaaagctattgtaaacaaaaagaacaaaactagaggaatcacatttcttaaattaaattgtactataaagctacagtaactaaaacagcatgaaaattgacacatagaccaatagaacctaacagacaacccagaaatatattcatacctccatataaactaattgttgacagcgttgccaagacatacattgggaaaaggacagtctcttcaataaatactgctgggaaaacaagatattcatatgcgtaagaatgaaactagtcccctatgtcttgccatatacaaaaatcaaacacaatggattaaacacttaaatctcagacctcaaactatgaaactactaaaagaaaacattggggaaagtgtccaagatgttggactgagcaaggatcttttgagtaatatcctacaagcacaggcaaccaaagcagaaatggacacatgggattacatgaagctaaaaagcttctggacagcaagggaacaatcaacaaatcaaagagacaagccacagagtgggagacaatatttgcaaactacccatctaacaggggattaataaccagaatatataagcagctaaaaactactctgtaggaaaaaatttaataatccaattaaaaaatgggccaaagctgtgagtagacgtttctcaaaagaagacataccatttgcaaatagatatatgaaaatgctcaacattattgatcatcagagaatacaaatcaaaactaaaatgaaatatcatctcatcccagcctgaatggctcttatccacaagacaggcaataacaaatgctggggaagatgtgggtaaaagggaactctcatatattcttggaaggaatgtaaattagtacaactactatggagaacagtttggaattgactcaaacaattagaaataggctgggtgcagtggcttatacctataatcccacactttgggaggctgaggtgggtggatcgcttgaggtcaggagtttgagaccagcctggccaacatggtgaaactccatctctcctaaaaatacaaaatgagaggggtgtggtggcacacacacctgtaatcccagttacttgggaggctgagacaagagaatcccttgaaccaggagttggaggtttcagtgagccgagattatgccactgcactccagcctgggtgacagaagtgagactccatctcaggaaaaaaaaaaaaaggaagtagagctgtgatatgatctagctatcacactgctagttatatacccaaaagaaaggaaatcagtatattgaagagatatctgcattcccatgtttattgcagcattattcataatagccaaaatttggaagcaacccaaatgttcatcaacagacgaatggataaaatgaatgtggtacatacacacaatggtgtactattcagccataaaagaattgaaatcttgtcatttgcaacaacatggatgaaattggaggtcattgtgttaagtgaaataagccaggtatagaaagacagacttcacatgttctcacttattggtgggagctaaaaattaaaacaattgaactcatggagctagagagtagaaggatggtcaccagagcctgggaagggtagttggaggaagtgggaataattaatggattacaaaaaaaatagttggaaagaacaaataagacctggcgtttgctagcatgacagggtgactattaaaaaataatttaattgttggttggtttgtaatgtaaaagttaagtgcttgaggtgatggatgccccatttaccctgatatgattattatgcattgcctgtgtatcacatgtcatctaccctgtagatacatctactgtgtacccacacacaaaaattctagagattattttataaggataaatgatactcatttttattattcattgataaagttttcctagttttgtttgtttacagttttgtaggtactatagtgttatgcttaatatcaataattcgttaatattttggttaggcattacattttttgggaaattatttagttcgtatcttttttcctggaatcaaaatcttagagttagaaggaaatttggagatcttcagatctgcaacctccctgacagctagcttaaatatgaccagtaacggggaatgtctcactgctcaaattgcaagaggattatctctttattaaagccaagataactatatttcgtatataacttcagtacctcattagaaaaattaaagattgatatgacaggattttttgttgtttaacctgctacattctaaccactgtacttttaggttttgacaatttatacttaataattagttttcatatacccttcacttggcttttgtcccagttactgttgttgctccaatgctcgcattcaggttactggtgacttgttaaggccaatatttgaacccctccatttaacacctttaatttttatcatatttcaagcttatctctttatcagcttctgaatcacattgtctcattttatgtcctactcttgctgttatcttcccgtctctttcagtggaacagtttttcatttacttcttaataactagggtttgctaagactttatccttggtttacttttcaaaattaatgactttatgtttttttgaaaaattatacatacttacattcgagcagtaagaaagaaaaaagaagaaagcaaagaaaaaactagttcacaacatgttagagataaaaatttttaatattatcatataaccatctcttttttttctttttcttttttttaaattttttaattttttttttttgagacggagtctcgctctgtccctgaggctggagtgcagtggcgccatctcgtctcactgcaagctccgcctcccgggttcacgccgttctcctgcctcagcctcccaagtagctgggactgcaggcgcccaccaccttgcccggctaattttttgtatttttagtagagacggggtttcaccatgttagccagaatggtctcgatctcctgacctcgtaatctgcccactttggcctcccaaagtgctgggattacaggcgtgagccaccgcacccggccataaccatctcttaatggccagatacggagaaggctagatgggtagactaattatataaaaagagtgtcatatttttgaaaaagagatttacatttattatatttatttggagccaactaaatgaagagaaacagaagtaaaggtaaatgaactgtaaactttaaataaatgtttgcttcaaaagaattaatttctttaagattaaaaacaattacaaaaagaaattaacaccttgctatgcaagatggaaaacccagaatttttacaaaacttttttgtaaaagttttttgtttcctcctcatcttgagttttgttcattaaatttctttttaaaaattttaccaaagtctgtaactttatatattacaagaataatttcctcagctttaaagtcttgtctctctatataacgaattcagtactcatcacatttttaaaagccatggcttttctatttatgaattctttcttttcgtatgtttcttgattagccagataaaattcaaagtattactaggcgcggtggctcacgcctgtaatcctagcactttgcaggccgacgcaggtggatcacctgaggtcaggagtttgagaccagcctggccaacatgacaaaactctctactaaaaatacagaaattagccgggcgtagtggtgcgtgcttgtaatcccagctacctggtaggctgagacaggataatcccttgaacacagtgggcagaggttgcagtgagccaagattgcgtcattgcactgcagcctgggcgccacttcactccagcctgggtgaaggagcaagactctgtgtcaaaaaaacaaaaaacaaaaaacaagcatttttttcaagaaggaatgaaagtagccatatttgtaagaacctagatgtttgagaatatgattcaacagggattaaatgggctgggtataattttattgggttacacccttttttcctcagaactttctagatgttactcatttatagaatcagtggttgctgtgaggatgtgttacagagaggtgtctgaattccccaacctcccctgtatcacccctgctgtggatgtcacttgcctttgctaagtggatgcctgaaaatttacttttttcaacttgatattcaaaaacttaaatagaatatgtcaatataatttgttctagatcacatattcctgaaatacctatgcatttattgtcaattaaaatattactttgttccaaggatttctcttttgcatatatttttgcatacttttctattccactttttatactctaaatcaaggaagttgtctttatgttagattattttttgtccggccttcatatctattttcttaacaattctttaatcttttgtcttctgcatccagtttatctcaagactttccttcatcagtaattcaatttttagccatgttttatcgttcttttgttctttttttgagacggagtcttcctctgtcaccaggctggaatgcagtggcacaatcttggctcattgcaacctccgattccctggttcaagcaattctcctgcctcagtctcccacgtagctaggattacaggcatgcaccaccatgcccagctaattttgtatttttttagtagagatggggtttcaccatgttggccaggatggtctcgatctcctgatctcgtgatccacatgccttgacctcccaaagtgctgggattacaggtgggagccaccgcacccggccttcttttgttctttcttacatttctatttaatctgtaataatgttctttgttattgttgttgttttcaatttattgtctcaattcttcaaattcttattttatttttggatgttttattatttcttttctgagcttgtattttattaaattcaggtttttggtaagttcttttcttcctttgtggcttttcttttacaatttggattcaaaatcggtattttgttaaatgtacactttgctccaccaactacagagtgttttctattgtagaaggggtgacccaggatttcaaattgttgtctggcttcagcagagtgtgttggatctaaccaggcctggtagttctcagtgttttttgctgagaaccatttctgctgctcttcattcctttctgtagatccatatttccatctggtgttatcttctttctgcctgaaggacttctttaatatttcttagagtgcacatctgctggtagtgaaattctttcagctgtcatacacctgaaaaaatccctatttttcttcattttgaaaggtattttcagtaagtatagaatgctacattgacagatttttttttttctttagcagttaattactccactgtcttctggtgtgaattgtttctgataagaattctgctgtcattcttactttgttcacgttagtatagcgtgccccacttttttccctcggctagtcagagcataaactactactgcacctgtatgagctttgcagtttgtttcctctaagttttctctaatccttttggatgttttttttttctcttaaacttgggtagtttccttaaatgcatgtgctgattagtacttggctgaagacttaaggttctcaggtctgtacatcttcagagctctccctgtatctgagtagatctctcctctatgacactttgccctgcaaactctagctcacttgacctccctggaacccagggtatgtctccttaatttaggaagattactggactacatttaggttttctgtttctgtgctgtagcttggaagctctctgtaagcagtaagctggggtaattaaagaactcacctcatttgttgccctctctcagggatgacattgtctgatgcccagtatctaaaaaccatttttcatacattttgtctagtttttagttgctccatatagaagggaaaatctgctccctctaacttacttttcttcttattgaacatgttttctctagattaaatcccaaaactttttccatgttccaaatatatatttcctattttctgacacctgtttccttctggctgcttttacaagtatcttaaaagttaagcatgtcatccaaaaaaactcattgccttttccctcaaatgaattcagtctcctctagtcttcccaaatgaataccttaagcccctaccatgctaaatttctctttactgaaaattgcaatttataacgtaatgggtcttgaatagaatcccacaatacctctgtcaagagcttagctgaactggagacagctgaaatgccaggtgtatgaatagctgctcgaagagaacaaaccaaaatgaaagttacagccacctttaattaattactgagatagtttaagcaagaggctaaaggggagaaagtgccagctccccatattttattttcccccattggtcaagtggatcaacatagaaatgagggttgtctcattgccagtggatcctcaaacaaaagtttcttgccatgtgatagacctgaggcattgggggagggtatgggaggatggttgggagaggaaaagtataaagtcagaatgagtcagaacgaggacaagtatcttcaagtttactgcctcctcccagtctcctaaggaggtttctcgagaaacacctaagcaagcctcagccaaaggcccccaataaaaatgcctccatattgagacacctgtggtagagatacagatacgtgtgtaacagtgtgattggccagggaaactagtgtccttgaccaggacctgtgtccttgagtgtaactcccttcagagactgcagtccattgacgtacaacaagtctggttggggagggcagctttcccccatgaggtgtgccaggtaaaacctttgtaattacctatgaccaagcctgacaaatcacatgtaaggtttggccaggagctagattcctcagtctttactgagtcacaagtgcatgaatatgttcacaaaccatttcttaccatgttcgtcattgaaagttgagggcttgtgtatcagacaatgcaagaaacaagcagatggggaaactcattcataaacaatagcaagcatttatttattgcatataggtctgtgtgttggctgaaacagctcttactgctgcaggttttctggtccagctctgtttcaggctgcaagtcaagtccacttctgctccatgtgtctgattcttgaacacaatgcaacaagtgtaaacatgaagagcttcttttgcctatgtttggaactggcacactgtcacctccacccgtgatttctttggctaaagcaagtcttcttattaaatacagccaacaacaattcgtactgtcagtgttagtttctatggaggattggggtagtatttttaggcctttacccagagtctactaggccttgcattattcctttcagaaattattagcaacaggcatgacagccaaatcccgagccatgttttaatgtcagcatctgagatttggcctttatgctgccagtgatttagtgtccactcctttgatatggtaacaaacaatttcattttccaactctagaagtactggaacttatacacttcccaaatttcaatggccagtgcctttctgagctctgatctttcttagagtagctagtcaagtgcagccagcaataaccaaactcatactatcagcattctgcactgacacctcctcactcagtataaaatttattaagttattaggtacattttttgccttccaggttatgccaggtggcagttttccaaatgttttgtaactacataacatgggttaccattttctcagcatcctgtaacatatattttgccacccaccacccagtcccaaaatcagtgccacataatttagtcttttatcatagcagcaccccacttaaagttaccaatttctgtatcccatcagcttttgctgcagaataaacaaccacaaagtctcactagcatgcagtaataaacatttatttcttgctcatgagtctatcagctgggataactgtgctgcaggctgcaggtctgttggttggctggagtgcttcaccttgaggcaatattggatttaggtctgctccatatttcttaatcccagtcccaggctgaaggggcagtgactacctgaacatgttcttttcaaggtggatgttggaaatttccaaggggtgatcagaagcatacaatttcttgagttctaggctcatttatacccatgtttccctagtccaagcaaatcacatggccaaactcaacattaatggagcagggatctgtactgcatccatgaaggtatccatgaaaggagtaagcatttgctgagtaataatctaccatagtatgatataaaatcttaagccagtgaacaaaagtatgctggagctgttagtatatgttgcgagcatatggctttctagatagtctgacccaatccagaaataaagcatctagaatggagtaaatggattgcaaatttcagattgtccttattaaatattaatttacaaaagcatagactttcataatagctgggcagcatacaatttaagttccagatttctggcaagtaactcaagtttacttactattaagaatagattgtgttggatacataccaaaaagaacatcaccaaaacaatcaagccttcggaaatggtcatcctactttaacttagagccaaatcaagggaacatcttgggaacaaaagggaaaaccttttaggcatattcaggttttctccaataaaggcaaaaacttttcaacatcaataaaaatgttaaaatatttacttcttggaatgattaatattaactaattctttgtgaccataatttaatgcacagtcattaatctgttgagcatatacctagtacctaaacatttaaggagaataacaaaaattgttctaaaacccatgcagtatattttataaataaaggaaggtcagactgcagtttcgttttatactacttacaattgctatccaatctagcataagggcattccttccagccctattcttggtgtgttaatatttctgatcttattctcttatttagtgacttctgctaatagcaaaataaagcccaaattcatttatcccactgaaaattagcccctgcctacctcattagccttatctttcatatgtttagcattattttttcctccctggaactgaaaaatcagcaaaataaaaccccaaaagtgctttagcgtttaacctctggaccagtgtacacagtactatattcctttcttgcaggttccatgtagaaaagacctcctcatctttaacaatagaactgaggtgtgacctcctatctaaagcctttttctgttctctttgtttgtaccctcaacatatataaatatataaaatattatataaaacatatgcattgtacgtatatgtatatacacacacaaatatatctatataaatgatttatacacagattttggttgcttctgttatgcttaaagtcatgcttctttgtagttgttaccaacatggcgctgtggctcacactgtaatcccaagattttgagaggctgaggcaggtgaatcgtttgaatccaggaatttgagaccagcctgggcaaccctgtctctaccaaaaaaaaaaagttgggtgtggtggcacacacttgtactaccagctacttgggtcgctgaggctggaggatcacttgagctctggaggcggaggttacagtgagctgagatcacgccactgcattccagcctgggtgatacagcaggaccctgtcttaaaaaaaaatgggaattttaaaattaaaaaaattatttttaaaacaagccaaaggagtattaggaatatagagaaatattaaagtaaattgaaacaaaagttaattgcaagaagtaattcgtaacatgaattttttttttttgagatggagccttgttctgtcacccaggctggagtgcagtggcgtgatctcggcccactgcaagctctgcctcctgggttcacgccattctcctgtctcagcctcccgagtagctgggactacaggcgcctgccaccatgcccgactaatttttttgtatttttagtagagatggggtttcaccgtgttagccaggatggtctcgatctcctgacctcgtgatctgcctgtctcggcctcccaaagtactgagattacaggcgtgagccaccttgcccggcccgtaacatgaaatttatatgaaatcagaaacacagttacaatgttaaacttcacaaagctaattcatttaaatataaagatcgaaattaaaatataatgaagcacttggaagtagaaaataaacagtctaaaatattttaaaagtgtgggcttaaggaatagcataaaataaaaagagggtgttacacatggctttcaagctagctagaggaattaaagatagcatgttcaaattcccctgattcatccagcgagctaataggatcgagttcatcaagtccccagcttaaagacattttatttttaaggcaaggaagcctatttattgggtgtaatttacaataaataaaatgaaaaaaaaaaaactacttatccttctgttttcctacctctcgtcctagaaaaagatacttacatcgtcctggtaacttcctttttagaatatttgtggctggtaacaaaaatgggctaattgtctttgaattttcactgattgaatagattcttcccaggcctcctgcccaggtaaactcaaaggggatggtctgggtctccagaaagaggtgccaagtgtaacagtcatatcaagtgattgaaattctctcctactcatcagaaacaggatttatttcttgccatttcattcatcagaaatgggacttcagttttcattggcttatggttacttctcggaggagatgggttctaattatagttggctgatctgactttattttgcctaagacaacaattttaaattaacacaaaaaccaaaaactttttcatggcagttcttgctgattattgcctatttatccccaattcacttatctgaaacagtgttcagagttatttttactcacaatacttctgacaccaattttataggtttttttcttccacccaacaactaactcattgcttctctaaactccaattgggcaattcagttcaattctagctacttagaattagtgcagaccctacagattaaggactgtgtcccacaggactgcctccattttagatcccagtcacaagtcccaggtttccacctgtatttctgaccaactgagtttaaattgggggttcccaggagcccttcctcagattagttaatttgctagaatggctcaaaaaagttttccatttactattgcttgtttattataaaggatacaactcaggaacagccaaatagaagagttgcatagttcatggtatggaggaaggaaaaggaagcttttgtgtcctttctgagcatgccaccttcagcacctcaatgtgttcaccaacttggaatttctccaaactccacagagtttgttatggagcttccattaagtagccatcattgattcaatcattggccattggtgactgaattcagtctccatttcctctcccctctgcagaggcctggtggtggggctggacgttaaaaccatctaatcacatggttgcctcctcttgcagccagtcctcatcttgaacctatctaggggctcaccaggaatcatcttattaagcataaactctggtatggttgaaaggagcttgttatgctttgcttgtaataacaaaagatggtcctattactcaagaaattccaaaggttttagaaactatgtttcaggaactggggacaaaatccaaatacagtggaccctctgtatccacgggttccacatccctggattcaaccaactgcagatcaaaaatatttgaaaaaaaattgtatctgtattgaacatgtatagactttttatcttgttattccctaaacaatgtagtataacaatatttacatagcatttacattgtattagttattataagtaatatagagattatttaaactatacaggaggatgtgcataggttatttgcaaatgctacatcagggacttgagcatggttggatttaggtatcccaggaaggtccctggaacaggaacgactgtatgtgtttcttattgtatcacaagtaccttctgaagtaaaacctacccactatgattctcattttcttttcctaaaagtgaaataaaaatagcaatattctttaggaaattgcccatacaataagttgataactgttttcctttcttaatccctcaaattgatataatcacaaactgacctttaagaaactttttgtatgaagcttcatattaagatcagggaaaaaacaatgataatagatttttcaaatcatttgttaaattaattaaaaaaaagaatctaaaagaatacaaagtaaaagattgcagaaaactttatattaattatttaagccaagaggattaaaagaaaaaatatagaaaatagaatatactaagctcttaaataactatgaataagcaaaattaaaggttaatgagaaaaagaaaaaatggagagaagaaactcctgagaaagaatataaattagaatgaatgtttatactagtaaaagtaaagcatttaaaactaaaatatcaaaaataaatctccagtaaagtgaagcatatgctcacatctaccataggaaagaaataggagtgtgtatttctaactaggtcttgttggtttatttcccaaatcctgggatccttgaagagaaagagaatcaagggccagaaaattggatccttgtttctttccatggcatgagcttatcttcttgagcgttctgtataaaccggtgaaggggagaaacaaacgtcagcagataagtacaggtgaacatggttagccaatctaccagtggacctcacacacatccaggagcaaacaagcagcacacaaattcatttttaaatcagtcttcaccatttactttattggaagtatttagctattgttggcatcccatgctctttgaatatagaactattatttttaagatgaaatatttcactcagaagtataacagatatttaaatgactagaaaggatgaattgtatttgcatattatttctatactgctgaaagattgctgtaaatgaattcagcaccatggtgttaggggactagaagaagaaacttgggaactgatagattattatcaaggtaaaggtacttattccccaggtggcaaattctacctatcctagcttttattatccttcggatactgttctaattatttcataagtacagaagttttaattgggtatgtcatttttcaaagacaaaagaaatgcctaattcactctaacaaacttgttagtcactgtttataccaggaggatttctactctacagagaataatattgttttctttttcctttgttgagaaatcaaagttttacactgacctacagcagccaagcatactttaaagcaaaataatctcaggctaacacagatatatatccttttagttttatatattcttttttgtcccctttttattccttaagaaatgttatattccagaattaattcactaagaaaatgttagtaaaatttgtcatagtaatttatctgataagaaaaaagttatttataggatttgatatattttgattttagtattaactgaagttttatgactttgttttttctttaaggttgttaagttacttgtaggttttggcttggttgaaaaggttttggcagtcaaatgtatagctagtgtaggaatgatttgtagctataacctcacccatatacctagctttctatttgttatgaagtcacagtatttctagaagagtgatttgtatggtttacctcacccagtgcatgatccttcacttgaaaaaaaggttgtggtaggggttgttacaatttcaatccaccctaattctgttactgtttgctttgttcagcaatcactgtgatcctcctggcagggaacaagatccagagaacaaaactagtagtgactgtgtagataaaaaggtaatgaattctgcttttaaggcaaagggggaatagtctacaaaagaatgaaaataggaataaaagtgtagcattgttaacctgaagatctattgtacttttgaaaaatcttatactgaaaaaaaaaaaaaaaggtggcactacaaagatacataattatgttgctaaaaatcttgaaaagggtcattgtttagttactggccaaatacttgacaagaaaatagcctagattattcacagttgaaaaaccatagaaccctttttcttaaaatgacaggacagtatttcagcagtacacgtggtatcataatatattatttattctctaccagaacagctctttagatctggtgaagatgatgaggtcaagaggagtactccagagaagaatggaaaagaaatgttggagcagacattacagaaggtagtctaatctttaagatattgagctgagcaagttaaatctgaattttaacataaaggattatattttaaaacgagggcttgtaaatgtaaaccttgtgtgaatccttaatttaaattcataattcaaaatcattggcttgccaaaatggggtaaaaaaaatcaatgttagtgaaataaatgtgtaaacacttgtgcttccattgatgtagattaacattattttcaaaaggtgaaatggagagaatgagaaaaatagaaattacagaaatgtagactatatgtgcttgttagttataacttagtttaaagtatattttaataagactgctgtacttccacaaatatagagatttataatatttgatctaaaatactgagcatagttatagttttgccacagtaaaatggtaatatgtttatagttttaatgttaaacatgaaaatatacgtgactcttctcattttagataaaaatttataccagtatgatttagtacagcattttatgttttaataagatcatccatgtaaaccttagtcatattataacatgtctatcattaatagtaaaatactgttttaaaatattaatatttacctttataattttatacttaatttgcatttttataaataaatacattgttatcaagttcaattaagtggatctaattattaacactttgttataaagaaaataatctttaaatagtttgttcttgtgattgtcatttggctacattagattgattttagttttttacagaaccttaatacttagataaagctgaaaatgtacaaatatataaataaaaatattaacatagtaacttatatattgttgcatctctgaattgacttgtaggaaatctagtgatttacagcagataatgtgattgttcatacttctaacacttgtcaggtcacaaaggctgtcatctcattattactgaatgacacatatcaagttaacatagtaacacagagaactagaaatgcttacattcatttatctttaggtaaaatgattaattgaattaatctatgcactaccagctaggatgtcatacagttcacactagcttatcaccgttttttcagaacaatatttttatttgccaggttttgtataatttttgtatctatggatatgtaatactatgctactatttcttgccttagggtagaaaccctgaagaaagccattatttcattccatctgccataaatgaatgctacaatagtagatccagacatccattttaagacctgaacaaccaatataaattattttcattgtactgtatgtcaagttggtatactattttttatatttacctaatgtagttttatcaagcacaagttaattcctcatgtttgagtttcattattttaaaaggttatatatgaaactcactcaaaataaatttaaaaaatagtaataagatgaaaacaatatttgtatatagtagaaatgaaacatatatgcagattattttgaaaataatatattaacatttcacattgttattggcagaattgtgtcctgtcccccacatttatatatattaagagtcctaagctgtattatctcagaacgtggctgtatttggagatagggtccttaaagaggtaattaagttaaagtaaggctattagggtgagccctaattcaacatgactggtgtctttatttaaaaaaaggaaattagaatacagacaaatacagagggaagtccatgtgaagacacagggaaaagatagccatttacaagccaaggagaaaggcctcagaagaaaccaaccctgctgacaccttgatcttggacttctagactccaggaatgtgagaaaataaatttctgttgtttaagtcacctactctgttatactttattatggcaaacctagcaaactaatacacacatttcatagcttcataatatcaggcattgtatttcagttttgaaaagagcctctttttttttttttttttttttggagacagagtcttgctctgtcacccaggctggagtacagtgggcagtgttggctcactgcaacctccgcctcccaggttcaagcgattctcgtgcctcagtctcccaagtaactgggactacaggtgtgcgccactatgcctggctaatttttgtgtttttcgtagagatgaggtttcatttcaccatgttggccaggctggtctcgaacccctgggttcaactaatctgcctgtctcagcctcccaaagtgctgggattacaggcatgagccactgcacccggcctgaaaagagccatctatttggtatattattttaaatgttcagaactataagaaaatatgggcttgagctgaattataacccacagattgaatacttttaacagttccccagactttcattctcaaatatgtattaaaatttactttgctgtttttgaaggattaaaatcagtttaacaatttttgagagtataccttgaataacactttaataagtgctatggattttcccttttcaaaatgtttagaagtagtgtctctgttttgttatttgtcctccattttaaatttaaataattttgaccagttctcatgattaaacatacattcatattaggaagttaacagaccttaaaaccacagacatcttcagttggtatgtatataggggtggaaagttgtggcatctttcctcacctatcataagggccacagttgacactcctataataaaaggcaggttaacacgagaaatacataacatttatttaatcaaagttttatgtgccacaggacgcttcaaaaacaaagacccagagaaaactgtctatttatgtgcttaggtttgataaagaaaggatagccatgtagaaatgtatctgtacaaaaggatatgtctatggtaataggctaaggaggggcaaaccaagcaaggcctgtctgctcagattcttcttgccctctgtgtagacttccttcctccctgggtataggacaggacccctctggaatgaaagtcttcaaggcagaactgagaagggagaaagtgacctttcttggttttatggcttgcttttggggagaggagttctagtttgtatgacctgccttagggaagaggaattatgtttgatatgacttcctttagaggagaaaaaggggagggtgacaggaaggcaggagatcttgcttctgaggcacttccagtgaccttcaatttaaggtacttggcaagccaaagtgacatactttggtgtgttgtattctgagccccaacgtatgtaaaattttaatgagttgtccccaaacttaaatggatttcagtcaacagaaaaaaaatgctaatttccagaattggaatctcaaatttaagatatttatttgttatatttgtttataacataatttaattgaaatatacagctgatttaatggctaattcagactattcagcacaagtaattatattttagttacagcagttttattaggtagatgttaaggtgaatgataatagaaacagtaataatgataatgataataaattgtttactacttactgtcaggaattatggtttatgatcacatttaatactcccaacaaaactgcaagatgtaggtattactatcctcatttcacagatgaggaaactaaaggtaaaataacttaaatattttaccagctaaagcaagtagagttggaagtgagatatagacctgattcaaaattctgtttcccctaaaacatactgcttcttaataatatttttgtatcaccaaagtcactgtttaaagaaaaaatgtggaccaatcaaggcaacacaatgcgaccccatctctacaaaatataaaaaattagccaagtgtgatggtgcatgcctctggtcctagctccttgggaggctaaggtgggaggatcacttgagcccaggaggtcaaggctgaaaaaccatgatcgagccatggcactccagcctgggcaataaagtgagatcttgactcaaagaaagtgtaattacttacttgcatcaaatatgtatttaaaaaatagagtatgttttactcactcccctttggaatttaatatgcaaaagtattttaaaatatatttatgaaaagtatgctgatttgggcagtgattaacactccttcaataaaatttagaggtagagtgatttggaaaaagtaaaaaggattctggcatagatttttttcttgaacactgtattttttgtcatattaatcagctccccaataaagtgtttacattgagaaggaacaatacaatctctttcacagaaatatgcagaagtctacaatagtttgagacaaaatttttcagatacctttattccaggtcatgtgtaggtcctttaaggacataggtccaatagtaggttaatatatcataccatggaatagaagtgattaaaattaggtgagattcttcatactgtgttgagaaatacccatgccccaggatagtgtagtcacttagtaaattaatgttgatttaaatgaaagaggttgaacattaaaaaaaaaagggtaatatagaaggatgtgtaaatcagacatgactgaaattcatgtttaggaaacaatttacatcttcactattacaagtaaagtttagtaaactggaaagtgttaagaatatgtatgttttatcttgtatatttctggaatattattattttgaatcattggttgttgtcttagtctcttcagttggctatagaaaatgctaaaactgagaggattataaacaatagaaatttgttgtccaagatccaagtgtccaagatctgagattcagtgtcttgtgaggactctctttctgtttcatagatggtgccttcttgctgtgtcctcacatggtctaaggagctagctagcttctggggtctcttataatagcactaatcccattcatgagggccccaccctcatgatccaatcaccttccaaaggcgccacctcatcatgccatcaaactagtgaacaggtttcaacatatgaattttgtgagggacacaagtattcagaccatcggagttgtcagtatatcaaacatgtttctctttgaagaattttgttttaaaagtaaaaatgagttcatatactttttcagtcatttagattgttttgcttgtctccagttttttcttgactccaaatctttgttcattttccatacacgtctgagtaatttttctttctcatatgccttgttgaatagtgggaagggcacaaaatcctgaatttggatcccagttgaatcccagaaaagtttacctctgtgaaatttaagttttcagaacctctctttcctgtctggaaagataattgttggttctacatacctcacgttttgagatggtcagaagagatcatgttgatcatgtttttgaaactattttgtaaatagtaaaatgtactttacaaacaataacacttattattaataagatctaaatgtaagtcaactcctccatgaaatgtttgaaattatgaactagaattaattgcccagacttatgatacttagattatatcctttattaggtttatgtatgcaggtgttggtcttttcaaataattttgaaattccttaagattaacaaatgtgtgttgccattgctatgtcctataacacaagcattgtttattgaaataaatgggaaaattttaatttatgtgcaaccttgaaatcattataatttaaaattgttagactttattatttagtaaactgttcccttatcacataaactgaggaccacatgactactaaaattacatttttctaatttagaaaaaaagcagcctcagtagattactttatattgtcattcctttttcatatgattgtcgaatattgaaaaaaagttatttattattacagtttatctacttttagacatttgtgtatattatttttctctgaaatatttttttccacaatgaatagaatatatagccaaggcacttatgatctcagaagacactgcagtttattagcatacttagttctgtcactgtgtagaattttaccttcttttaccatctgtcctttattcaacagatacattattgcatttttgaatgtattcatctgcactgccttagaattatctagaaattaagtactttatatttattttgtccttgtgctaaatgtgatttttatttcataagttagaaatggtaataaagtatagtagattatggtttttggattcttaaaagaataaactctttcctttaggtcactgagttggaaaatcggctgaaatcttttgagaaaaggtcgagaaaattaaaagaagggaataaaaaattaatgaaagaaaatgattttctgaaatccctcttaaaacagcaacaagaagatacagagaccagagaaaaagagctagaacagataataaaggggagtaaagatgtagaaaaagaaaatactgaacttcaagtaaaaatcagtgagctggagacagaagtcacttccctgaggagacaagtggcagaagctaatgcattgagaaatgaaaatgaagagctgatcaacccaatggagaaatcacaccagtcagcagacagagctaaatccgagatggccaccatgaaagtgagatctggacgatatgattgtaagacaactatgaccaaggttaaatttaaagctgcgaagaaaaattgctctgtgggtcgtcaccacactgttctcaatcattccatcaaggttatgagcaatgtgtttgagaacctcagcaaggacggctgggaggatgtgagtgaaagcaggtaaggctctcattaacttagctctgtggtggggacactgcgcatatgtaaagcactagcaaatggagattgaatttcaactactgtcgatttggtattcagaaaaaatactgtcagatcctttgaaatatcttgggaggtcttgttctgagcttattgactgaaatttgcatgcaaaattagccacaactgcatgagtacttgaataggtgccaggaaacccaaaagaaggcaatgcttgatttctttcagtgatgctattttcatgcagtcatgaggcttgaaattgacagtttggcaggttgatttaatctgctggccctttgcatattcaccactgacagctaaggattcccaggcaagcctactaagtcggtttagttatcttgtgacataccaacctgggaggagaaacaattttcccccttaatttagttagataaattttgaatgacccatttcagcttgttaccagatgtctacaagctgtttaacatcctttaaattaagaaccatcttcactaattattttatgtatgtattatgcaaagtcattgtattaactttaattgaatggtggttaaaaattagttctttaaagttatagctctaaagattcctagtcttaagatatgtacccctagtgaacagcaacaggaggatactaaaaatctataatgcttctttctcttacccctggctatacattcatatatgcacttgaaacacatcagtaaaactgtcagaggcctgtgaaccagagcaactccatcttaaataggagctgggtaaaatgaggctgaaacctgctgggctgcatttccagatggttaaggcattctaagtcacaggatgagataggaggtcagtacaaaacaaaggtcataaagaccttgctgataaaacaggttacggtagaggagccagccaaaacccaccaaaaccaaggtggccacaagagtgatctctggttgtcttcacggctacactcgcaccagcgccatgacagtttacaaataccatggcaacatcagcaagttaccctatgtggtctaaaaaggggaggcatgaataatacacccctagtttagcatatcgtcaagaaataaccataaaaatgggcaaccagcacccctcagggctactctgtctatggaatagccattcttttattcctttactttcttaaaaaacctgctttcactttgcactgtggactcgccctgaattccttcttgtgcaagatccaagaaccctctcttggggtctggatcaggaccctttcttgtaacaaaaccacaaagacgaatgatagaacacctcttttttacatctagacagtagggaagttcagtgttgccataattgctaacaaattgcccaatttgccataattttaaaaattctgccttgttttataatgacatatgtccttgattttccctagttttttattttgttttgtttttaaatccctaatagtgattctgttttagatttgggatgcctccggatacttttcctaatcacagacatagaactgaaaattaccttaaaatgtggtccccaaacttgtttgcatattagaagcacctggaggttttataaacattccaaaggttaggtcacaccccagacaaattaaattataacctttggagtgggatacaggcctaagtattttttcaagtttccctgttgaatccaatgtgcagacaagtttgagaaacactgtttttaaacatcatctactcaagccccttgtcctcaggcagttaaagaaactcaaaaaacatattcatgaaggaaaggccaaaggaccaaatctgcattcccatttcggtgttaccgaggttcttctttccttctctcaatagcaattagaggtaaaaacttacttcccacccactaagcgttatctttatatctcattattcctctgtcttcaaggaaattctagtgctagctactaattctatcttaaccacttggtactaccacactattcaaaataaagtggtgccatttacttatgtgcaaatatgtatgtatgaataaataatcaatagttaggtaattcactaatatactttttaaattttatcatattagtgtttccagaaagaggtcccaattcagaccccaagagagggttcttggatctcacgcaagaaagaatttgaggcaagtccatagagtaaagtgaaagcaaatttactaagaaagtaaaggaataaaagaatggctactccataggcagagcagtccccaggggctgcggttgcccatttttatggttatttcctgactataggctaaacaaggagtggattattcatgcctcccctttttagaccatatagggtaacttcctgacgttgccatggcattggtaaactgtcatggcactggtgggagaatagcagcgaggatgaccagaggtcactctgatcactgtcttcttggttttgatgggttttcaccggcttctttactgcaggctgtttcatcagcaaggtctttatgacctgtatcttgtgccgacttcctatctcatcctgtgacttagattgcctaacttactgggaatgcctcccggcagatctgagccctattttacccagcacctattcaagatggagttgctctgtttcaaacacctctgacattagtgcatgtgcacaaggtcacatactttgagagacatatcatacaatatctcttaaaatataggattgtcatttgtgttatttagcagtaaaactcaattttacaccatgattagtgttacatttcctgcctgacagaatgccttcaagagtcactcagctgcaaaagaattctcaaacggctagaaattcttgcactagagctttagggacttcagaagattctttcttttagatttttatagacaaaaatataagagttacttggatattgaaaaaaatagtatgtatatatataattttgtatatataaaatactatatcatatgattatcaccttctcagtatttatttcccatagttgaatagtatttacaagagcatgccttttcagtgatgggttttatcaggaggaggtgtttatatcttcaagaagaaaaatagaatttcagtattccaagcaaattaaagaaagagaagtgaagtttgtagtgttattgaataaaaggggctcgttgccttatgctagaagtcaatactatgacactgggtttttgagaaaagaaaagctttatattgcaagttgacttacaaggagacaggagtgtcaagctcaaatctgtctcccaggctggcttcaaagcagtatttttagaaagtgatggggggagggggagttctgagattaataggtgattggtgaaaggaaaggggagatctgcaaagtccttgagtggttatctcttcatgctatcataagttgcatatgcaattctgggatagtatgaaacatgcagtggaatttcagtctgtgacatcagcaagctcgttctgtgcagactccagtcagccacattggttccaactgatttcagctagttcttttatctcataagcagagggagtttcattaagttgtttcttttttatttgccgcctgcaaactcaagaatttctgtttatcattggtttctttaactctttgaggcatggtttcagaagcagagaaataagaatttattgaggagattataaagggttgcaaaacgtgccataccaaaataagcaattttggcataagaattatttcaaactgaagccagttcagaaaaagcagttacaagaaaagctctcttatctcccgctaaaagcagtacatacatttaccaaggtattccttcttccctctctgccaaaaagggataaaaactaatcactggagacaacttgagtccctaatgagcctggaggtagcaccagaggaagctacgttaacacattttaccaactagccttcatctaccattagttttccatatatttgccttcctacaatttgctgttccttgggacgcaagtcctttcttttcccttatcacttctttaaatagttgttgttctttgctgaagatgctatgtaaactggagttctaagccacctctttgagctactcacttccacgtagtcccatgtattatatgtgtgatacacatgttaatatacttgtttttcacttgttaatctgtcttttgttacaggggtctcaaatgagaacttagagggaaaatcatttttttccatccctacagtcatactttctacttctattttctcttatcattaagttacttatttaattgcctggtcacatttctcaaacacaacataaacttccatgattctatgtatttagcctgtctgacttcatgtctctccctactagtgcattttattctcattcaaaattattttacaagaaactgatgctctttgacttttctttttctttttgcttcaggaatatggcatttggatccttttaaagttttcaaccttagtgctaaagccctttccatcttccttccattttataaagcagcatattcactcacattaccaccttttgtaaacagatgataacaactgatggggttcaggacatactcctcccaaaatatagttgaaggaatttgaaaaatggcaggtgctagaatgactctgtgaccttctcccctgaaacagattataagatcctcacataagaggtggcttccttataccagaggaaaggaacgtccttatctcaaaagacagaggaacaccaagatgaatctgaatgaacagccacactaagtgtcccccagtttactatgcttagctcatactcttttgtcttaccacattttcccatgactttctatttttcatcaaacctcgcatgtaaccgtttcttcgggtcctcatttccttatgaaggctcccttatcatgtaaaacttatattaaatagatttgtttggttttcttttgctaatctgcatttttacggtgtctcagccaagaacataagttggataaaagaaacatattttttctccccaacacaactctaccattatttatttatttatttttttgagatggagtcttaccctgtcacccaggctggagtgcaatggcgtggtctcggctcactgcaatctccatctcccaggttcaagcgattctcctgcctcagcctcctgcgtagctgggaataccggcgcacaccacaatgcccggctaattttttgtatctttactagagatgaggtttcaccatgttggccaggctggtctggaactcctgacctcgtgatctgcctgcctcggcctcccaaagtgctgggattacaggcgtgagccactgtgcctggccaactgtaccattatttagagtatatcttagggattaggaacgtggaatctgttaccaaactacttttgttcaaatcctaactctcatcctctagctgtgtgaccataggcatgctatttgacctgtctatgcttcaatttcattatccataaaataggcataatgataggatcatattcatagatacgttgtgagaaagaaataggatagaacattaaaatagcacctaaaacatgttcagtactgtatgtttattattattaaaaggaatcattttttttggctatctgaaacaccccttaccccatcctcagcatatttgtatgtatgtgtgaaatgtatatgttaattcattcattcattcccagttgtggtcaagaatatgaaaaattctgcaatcaaacagtgtagtctcacataacaaagatttatttttcaaattgtgagtacaggtcttttttaggcctgcattttgttgctgtttatagattccacacacacataaaaatctttatgattgcaaagatttttaatcttggaaatttttatactgctattttttaatgacctatacatttcatttgatcctcattgaagtcctgattcttctgtgttctccactaaattggtcaaaaatcggtttgtctgtactttctgaaaatagcaatcttgctttaggttcctagcattttattcctaggttactgtagatctagattccatagaactttgcatatagttagtctcttgacacagtatcttaggataaagtagtagagttcctttcatgttgttaagtttttgatggatgaccagactatatatacatagcagactgtgaagaataagtgaacaaatacatttcttgaatcattaaataatattcattgtctgactacctaatatagtacggtacattaaagcaaaatccatatagagattttttttttttaatgacgtggagtcaagctctgtttcccaggctggagtgctgtggcacaatcatggctcactgcatcctcgacttcctgagctcgagctaccttctacctcagtctccttaggagctgagactacagcacgtgctaccgtgcctggctaatttttcaaattttttgtagagatgagatcttgctacattgcctaggctggttttgaacttctggtctcaagtgatcctcctgccttggcctcagaaagtatttggattacagatgcaagccattgtgcttggcctagattagaggtttaatgaaacaatgaaaattttaaaagtattacaagaaattacaagattacttgtttataactttggagcatctctaggaagtatacttaagcaagagatgaaaatacagagccagatatgaaaaagcgttaatagaactttaaacatctatatagtaacagatatataaaaagagttaaaagtcaaatgactaaccagaaaaaggtatttacaacacataaagaaggtaaaggactaatatccagaagatttaaagatcatctacaaattatataaaaagacgcatcaatagaaaatgggcagtgctatggacaggaaatattaatggcttgaggagatgactcagtgaaccaaagattatgaatatgtctgtagcagacagaggtggtatgtggaatgcctgacaagcatgacaagaaccacatatagacacctaaggctatgcgatttctgttgacaactgttctctattcaaaaagctagtactactgggaagaggctgcagcagtggcagatattttatttccacaaatcccccatcaaaataaacaaaacaaataggaaggcatagccaaaatctcaaggatagcatctacaatagaattagtgacaaacccaaaatatgaacaggtagggacagccatcgacagctgtatgacttgcactgtatcaagagagagaaaattggtgtccggagaaaagaaaaatacagttcttctatgagctatctataccaaaagaccagaacttcctcactgaactaagtcccacatggaggggatgacactgtgaaaagaaactgaattatagggacagtagccccctctgttggttatgtatcaacttgttatgtgtttttggatgagattaacatttaaatcagtgagctttggataaagcacattgtcctccagcatggagataaacctcatttagtctgttgaaggcctgaatagaatataaagaatggcctctgtgagcaagagggaattctccagaaaattgccttcagatttaatctgcaccatcagctctcctgggtctctagcctgccagacttcacactagaactagaaaattgactttcctgggtttccacctgctggcaattggactgaagctacaccattagttctcctgagtctctagcctactgggccatactgtagatttggacttcctagccttcacaatcacatgaaccaattcctaaagatatatacgtgcatgcatacatcctgttggttccatttctccagaaaaaccctgactaatccacctctctacttcccactcccactccaaaaaaagtagtgaagattgagatcaatgttgagggagtgcgtcaaaagaggcatttttcagtatatcaaaaacttggaaggaaaagttggaagattggtgacagggaggtctgtgggaaggttggtggaagattggtggcaggaaggtctgtggggaggttcgtggatggaccttttggaagagatacacacaaagcccattctgtgaacaaaatgacccattgtatagatcttgcctatttcacagctatctgagggcttgcttaatgggttcatgaacaaagtggctatggcaacaggtatagcttctacatggcacaggtgtcctgccactaatcttccaatttttccttgcaagcttttgaacaaaattgactttctttcaccaaaacttgtctggcgactgggctactggcactgttgaatattcagcctgttcacaaaaaagaccaattgcaaatcccaaaaaaaagcttcattctccagaggaaaccaaccagtctcttagtgtcaggttgattacagtaggcctcttccatcatggaggaggcatcaattttttttttttacagtagttttaagtattttaggtatggttttgtctattatatttttaccaatattaccattcttagatttacaaaatgacttatatatccctatgatattgcagaaaactgcctccttggatgcacttgctcaatcttgatctcaaccttggaggtaggactgggaggtagggaggtggcctagtcagcattttcccagagaagcagactgaaagacacattttcttcttagtttgagacagagtctcgctctgttgcccagactggagtgcagtggtgtgatcctggctcactgcaacctctgcttcgcgggttcaagcgattctcgtgcttcagcctcccaagtagctggggctagagatgtgtgccacaacacccggctaatttttgtatttttaatagagatggggtttcactattttggccagactggtcataaactcctgacctcaggtgattcacctgcctcagcctcccaaagtgctggaattacaggtatgagccaccaagcccagctaaaagacagagtttatggcaagggatatatgacaatgctctgtgtcttcaaattcactggtattactatatttttcattattcaaaggcaactggctgtatacgacagtagatgatcaataggctccgttatggcaccagctagaagacaatattgaagttagggtatatgccctaaactgagagtttattattttatctccaagaatgcataggtccaggaataaagtattttaggttggcgtggccgctgtaattatttaaccaagtaacccactggaggagtttttgcttctcattagtatgatcttgggctaggggatttgagagtcctgatgccgaaggtaggaaagttctttgagggaacacaattatggtctgtagaggtagacgctgagattgtaccctggccattttggattccctatactgagctaaaaagcgtcaaaaggagctacggtattagccagagcaattatcccaattattgaggtaaaattaggaggaccatgtttggaaaccagagaattcattatacacctgttagtactcctttacctagtagtcctctgtatttgctgtccttggcagtgaaattttaaaaagttgtgtacaatccttgtttcaaattccattcatcccttcatcatccttctgaaacaaatttttttttttttttttgagacagagtcttgctctgtctgccaggctggagtacagtggcgcgatcttggctcactgcaggctccacctcctgggcgcaaacgattctcctgcctcagcctcctgagtagctgggactacaggtgtacgccaccaccccaggctaattcttgtatttttagtagaaatggggtttcaccatgttagccaggctggtcttgaactcctgacgtcaggcagtctgcccacctcggcctcccaaagtgctgggattacagatgtgagccaccgcgcccagcctaaaacaattattttgagggtcactaccactttgccaaattcaaaggttgattctcagtcctcaccttacttgacctctcagcagcatttgacacagttgatttctacctcttgttattatagtttgccataccatactctttattttcttcttctcactgatatttaacttcagtgtcatttgttagttttgtgacattccccctcagtctctcaatttttaagagcttcagtcattggacattgtcttcagtcagtggacattttgtgttgctataacaacacacacaaaaaaataccacagactggataacttataatgaaaggaaatttatttcttacagttccggaagctgggaagtcccaggttgagagcgccacatttgatgagggtcttctggctgtgtcatcatggccgaaggtggaacggcaaggagcctgatagagcaagagggggccaaatttgcttttataacaagcctgttcttataacaaactcactcccatgataacattaaatcgttcatgaggactcatgatctaatcacctcttattagattccacctcccaacactgttgcactgaggattgtgtttccaagatgtgaactttggaggacacattaaaagctgcactcattgttttgtgatctcatagtatttattaacatcattgttaccacctatattccagccaccccaaaatgtatgtatccattctatacctcacttctgaattttattttattattattatttttatttttttagatggagttttgctcctgttgccctggctggagtgcagtggcgtgatctcagctcactgcatcctctgtcccctgggttcaagcgattctccagagtagctgggattacaggcatgtgccaccacacccagctaattttgtatttttagtagagatggggtttctccatgttggtcaggctctgaattttagacatgtaaagttgactgtcaacttagcatcatacttggatatcaaatagcctaatacaaattcctgggctttaccccaccaagcctatttcagctgctgtcttcctctttctcactaatgataattctatctttacagttgcactgaccaaaagcttgataccatctttgattccagtctttctgtcagtcattacatctactctgtcaggaaatcttggtggatttctttagaaaaatatccagaagttgaccatttcttatcaattttgtttgtcatcactcttatatctatcatcagttgcctggaatatgaaaagaactttcctaaccaccctccctgctttcagccttgtttttagtccatatttactgtgttctacctacactggactgactgttgctcgctgaaagcaggaacttttaacttagggattttagtttgatgtcttctgcctggaatgtatttagccagatatctaaaacaaccaactccctctcctctaagttttgcttcagtattactaatgatcaatctatttcagatttcagcctgccaccattttacctcccataatttggattccttcctcttatcttgctcattttttccccagtggtccttaataatttataacatactatatcatatttcagatttattgtgcttattgttttcttcgtggatagactaaatttattcatggatagactgtaaagaatttgttcatcaattctttcacatgcatagggcatagtagccattcaataaatgttttttgaataatgaatgaataaagaattataaagagaaggaagcactctgccccatcactaagacacgtctccctccttctgcccctgcccaccccccaccaagggctctccaatcaaatctaaacagtttgttttgagagtgtcttattgtgaaatatgctgctttttatgacacttttcataccactttggccattacatattgaatttctgctaagttttggccaaacaaaaaagaggaatagaacataaaaagaggtaaacaattatagtagaacacataagcaaatagattatagtattctgattcagaaataatgaattctgggatactgaaataacttgtagatttgatcaattgctgttggtattttgaaggagaacccaaatgatatgagaatatgggaaacagaaaagtgtagttgtgacattaaaaacacaaagatgggtaattctatagttggtgtttttgaaataaatcctaagtaaggttctgggacattataaaagaatactttgtgaatgtttcttaaaagaagtagtgatttctcaaagccagtatgagttcttcaagggaaattcttatcagactaaccagtaaccttttaaaatagaattacactaaatacagaacatctgaattccatcaaagcatgtttatcaaattgtgattaacatgacgttgagagggatgtaaaatacgtcacacaatagaatcaagatccccaaagatctcagtagactgggaatatagttacacaaatgcctacagggtagtttatttggctataaaataccagttgcactgtacaatgggagaaatatgtggctttaatagttgtctgggtggttttgttaaatcttatttgaaatactttaggtggttttgttaaatcttacttgagtctatagtatgatgtatacgccagagaagcttacacacttttagtctgcatctaccaagagttttactcagtacctctcatagtgtcccaggaagatgaaactgaattctggacatgatgctccatcatgataagctgaaacacattcaagactgaccagggaggctgggcgtggtggctcacgcctgtaatcccagcactttgggaggctgaggtaggtggattacctgaggtcaggagttcgagaccagcctgaccaacatggtgaaaccccatctctcctaaaaatacaaaaaattagccaggcatcgtggtgggcacctgtaatcccagctactcgggaggctgaggcaggagaatcgcttgaaccctggaggtggaggttgcagtgagccgagatcgtgccactacactccagcctgggtacaacagagtgagactctgtctcaaaaaaaaaaaaaaaaaaaaaaaagaccaaggagataaggcatctcaaaagtatatacgttaggaacatttgaacaagctagggatgttattcttcatggtgtctcaagcagcatataatgatgtctaaatagttaaaagctcatccatgtgggaaagggacttacttaaatgttccacacaacctcaacacttcctgtctcctacccttgtttatttttattttttttctctttaacacatcactattgacatagtatgtattttactaagtattcttgtttcctgtccctctaccctgaccaggataaaggttacatgagggaagggattttttttctactttgttcactactgccttagccttcatgcccacaaaagtccctgggcccggctgggtgcagtggctcatgcctgtaatcccagcactttgggaggctgagacgggcagatcacgaggtcaggagatcgagaccatcctggctaacacagtgaaaccctatctctactaaaaatacaaaaaattagtcaggcgtggtgatgggcgcctgtagtcccagctacttgggatgctgagtcaggagaatggcatgaacctgggaggcggaggttgccatgagccaagatcgcgccactgcactccagcctgggtgacagagcgagactctgtcttaaaaaaaaaaaaaagtgcctgggcccatagttggtgcttaagaagtattttattcagtgataaatagccataagggatggaactagaatcagtgggtgaaagcttcagagattcaaattttgtttcaggtgaaggaaaaactttgttagaaatattaaacttttctggccttgttgggaaagtagtgcatgctccaaccctggaagtgttacaacaattgcttcctgagttaacacttggttgaagtactatcgaaatgatgttagtagggatttgaaattagataatctgttttcttgatgggattctataattttgtacaatatatttagattcattttccctttcacattgagaaccagtaaatgcccacgttaaacttgcagttttatatacaatctatgctaaaatattatttggtcttgaacttaagacaagtacatgtaacaacttttattcttggattttatgtccctacttttttctaaaaagcagtgattctgaagcacagacctctcaaactttgggaacaattattgtagaaacatcccagaaaataagtcctacggaagatggaaaagaccagaaagaaagtgatccaacagaagacagccaaacacaaggaaaagaaatagtacagacatatttaaatatagatggcaagaccccaaaggtaaatgacatgattttgcttaattgtatgctatgttttaaattttatcttatgctttataacttaagtaaataaatgttactactgatttaatttgaattcttacaagttaagtctttaaaatatacagtgaaaatattcacttttaaataattttcaagtacttgtttgttacagtctttttcatagacgaaaataaatactattcttataaatcttaaggtatttatatctcagcaaaaaagtggttaataagctcattattgttttcaggtatatgaaatattccaaatgatgaaacttctttttgtatattagtctttgcaatgataaagtcatttagtctgactaaatctctaaattacttatttctaactagcctctcaatgtattttacattttgaaaaattgaagttctaatacaacttattcagtaattcctactgctgatacatcatggcaccaaatgtttacctatttaacataaatcagtgaaaaattaaggaaagttcatttctattttgttgtaaaaattaggttgtctttgaattaacctataagattcttttaaaacataattcaaaaacatttattttttgagctcttgccagcactttggaggaaaggtcttctttagttactaccagaataaagttcagaccaagaatatatgctaaatgactgctgattgattgataaatagattttatagaaatttttgctgctcttcattgatacttgataggttaatctttctcatttcagctactttttcatgtatgttgaggtatatcattgtgagttaagtttctgtgattactaatacaatgttgagtactttctcatggttattgggcatttggaattttttagtaaattgcctcttcaagtctctgcccattttccaaatgagttgtctgtatttttcttactggcttagacatttttatatatgctatatatgagccttttgtgggttatgtattgtagatatcttttcctactccatggtgtgccttttttcttttctcactggagtcttctgaagaatataacatctcaattctaatgtggccaaacttaccaattttttgtttatgaatagcacattttgtgtcctgtataatgcattgcttactgcaatgtagatatatcctatgctaccttccatgttgtcttttcctatatttttctgatttcctatatttttctgttttgattttcacatcaatgtctagcattgattttttcatgtgatgtgagatagggattaagtttaccaatttttccccaatatttgtcattaactttttccttactttattcaaaggtgccacctttattgtaaatccaatgtacgtaaacatagggatatttctctaggctttttcttctgttccttcagtaaatgtatcagtatcatgctgtcttagttacattttagtagtcttgattgcatgttgaacaagtttcccaccttcttgttcatcaagagtctcttcttggtcctttactcttcaaaatgaatttaaaatcagcttaagttctacaaaaactttttttgggattttgatagtgactctattaacctaaattaatataaaacaagaagaagacgctgaaaggtagagagaaggcagcagaccagctaggtacctcagcactcaaggaacaacatggtggtgagttctttgggttttcattttgcttcatgtatcctggcctggatacctgaaatccccaacctagaaacctcagtaggtcagacaatacatgccctggataaaacccttcttttagccaaaggacctggaaaaggccagcctagcaagacagaaaagcttacacagtaagtgtcctactccaggcaaacaccagagaaaaattgcaaccctgtttccagccccatctgtaaaggcctaatgggaacctagactttcactcttacctggcaataagtaggcactcttcacctctcctcctcctatcagggtgatgccagagaggaccaagtgtggagctagtgataatgacctcctcctgggatccctaacccctgggctgcagactggcacctgttgtggcctgctaggaactggcttacacagcagaaggtgagaggtgggtgagccattgttacggcctgagctctgcctcccgttagaccagcggaggcattagactctcacataagcatgaaccccgctgtgaactgcacatgcaagggatctaggttgctgctccttatgagaatctaatgcctgatgatctgaggtagaacagtttcatcccgaaaccatctccacctccccgacccactccaccccctatccatgcaaaaattttcttccacaaaactggtttttggtgccaaaaaggttaagaaccggtgactccctcctttccatgtcattggagatcacatagggaacctggatatccacctccattcagcattgaaatgcctttcccttctgagcaagataatttcagaggccaagtgcagagatggggaatttaattactacttatacctaacaagcccccaccccctccccatgatgtcaatggaagcccagtggggaacattaactaagtccccctccattatccagccatgatggtatcagcagatgcctattgggtagcctgaagttctgccctccccaagcagtaataaggtggccctctccaaccaggttgtcaactaagactggatttccacttccaactggcagtaattagatggtgtgctccttgccccatcagtgtggtgtcagatgagtcccattcaaatgagattcaagtaagatacagaaccttgaagttctaatacttgaaatataatagccaaaatgtccaggatacaattgaaaatcacacctcataccaagatccaggaaaacctcaactatatcaacagaagcaaaaagcaagatgacagatgttggagttacagacagtccccaactcactacaatggtttgagttaaaatttttctactttatgttggtgtgaaattgatacatgtttagtagaaactgtactttgagtacccatacaatggtttttttaatcactttcagggcagtattcaataaataaattacatgacatatttaatactttattataaaataagctttgtgttagatgattttgcccagctgtaggctaatgtaagtgttctgagtaggctaggctaagctatgatgtttggtaggtcagatgtattaaatgcatttttgatttatgatgttttcaacttaatgagtttatcaggacgtaataatggatacccattgtatgtcaggaggcatctgtatatgacacgtatattaaagttgctgccatcaaaatgcttcaacaagcaattatggacaggcctaaaacaaaacaaaatagacctaaaacaaaagcaatagactatctcagtaaagaattagaaagtctcagcaaataaatagaagatataaaagtacccagatctaaattttagaactgaaaaattaaataactatgtttgccccacagatggtggcattaatccttatcacccaaaattgattcagatgtcaagactgatggcaccgtacacccgccattattattcacataatggaacagagaatctagaaatggatccacataagtatgaacaactgatttttgaccaaggtgcaaaggaaggataatcctttcaaaaaatggtgctggagcaattggatatttctacgcaaaaaatataggaacctatacctagactttacactttatacaaaaattaatttgaggtggctcacatataaatgtagaatattaaatcataaaactttcagaaagaaatataagagaaaatcttgaagtcttagagctgagtgaagagtttttagacatgataccaaaagcatgatccataaaagaaaacaacagtaaattagacttcattaaaattaagaacttttgctcctcaaaagacactatatagaagaggaaaagacaagccacagagtgagaggaatatttaaaaaccatgtgtctgacaaaagtctcatagcttgaatatgtaaagaacactcaaaacttaacaggaagaaattaaacaatccagttacaaaataggcagaagatatgagcaaacattttaccaaaaaaggatatacggatggcaaataagcacatataaagattttcaacttcactattaggaaacagctaaagtaaaaattagtgaaaataccaagtgctgaccaagggacagggaaactggatctctcatatattgttcatgtgaatataaaattctatattacagcactctgaaaaagtttgtcagtttcttaaaaactaaacttaccatacaacccagctatcacacccttagacacatcccacagacatgaaaatatatgtttaccaaaaaaacttgtacatgaatgatcatagaacctttgtttgtaatagctgaaaactgggaacaaccaaaattctcttcaatagctgaacagctaaacaaactgtggtacatctgtaacacaggaaacttctcagcaataaaaaggagctaactattgacgtatacaatgtcctagctttctgacctgaaatttctcatcttggattgtgaactaggctttctttcttgccttctgcattctgtgttgctatttaagtggaatttcaaggtcacaagggattgtcagttctacattttgctggccactttgttggtcacttttgtatggtctctgaatttctgctttcacttcatttttgacctctgacatttcccttgtattttttgccatgttagaaatacactttaagtgtgtttgtttcatagcatgagagttttcttgagtttgtattcagtaatagtactggaaacagaagcccacttctttgtaatttaattttagctactgttaatttgataccaaatctggtgactgatattagtacttcaattggtagctgtagtttggattttttttttaacagtgctcagtgcgtggctgatacttaaatactaattaaatcttaataaagcaattaaaaatttatatgccagttctgaagataagcttaaatgaagcatttcaaaaatattttgagaaatgaaacattgttagggttttatatttctgaaactaatcatttgaaaggaaaaccttattttagatataggcttctgttccatgtgttaatcagtttcatgactttcaggcaatttgttgctggattgggatcttttaaaaagttctttttaaaataagaaataattttctagattgcatatatctatgtttcccagccaatacattcttaaacaaggctaggcactgtggctcacgcccataatcccaacacttttggaggccgaggcgagtggctcactggataccaggagtttgaaaccagcctagacagtatggtgaaaccccatctctaccaaaaattcaaaaattagctgggggtggtggtccctgtagtcccaggtacttgggaggctgaggcatgagaattgcttgaacctgggaggcggaggttgcggtgaactgagattgtgccactgtactccagcctgagtgacaaagccaaactctgtctcaaaagaaaaaaaaaaaaatcttaagaccacatgttttactactaatatatacaattttaaattggtgaaacgttttgaaaccaaaagtcaacaaggcttccttttattcagcctcagtgtattagaatgccatgaggaaaacatacagcttcaggaagttattttattattgtcagcattatttttagctttatttgtcagaaggctattagcttcatttgtcagcatataatagagtatttgagaaaagggcctatattttcagagaataagttattaattattcacattttacttttgttacggttaccatatttactcctaagtttttaagctatccctagattaaatttctacttctttggagttgattttgtatctgtatcttctgcctgctggtttaagttcagtgtatacaataagttcatttgtaagttcttggtatcagttatagaattttatcatctagagtttaaaaaatatttttttcaattttttttgtaagaggcagtcttgctctgttgcccaggctggtctcaaactcctggcctcaagcagtcctcctgccttggtctcccacagacttaaaaaaaattctgcataaacaattgtattttttaagtaaagagatgttatttatatcagttcacttgatgttgttattgaagaataataccatttttatgaaatcttcaaatttaggactattttcatgataagaatgccaaaaaaccaacttttcaaaagaagaattgcaagatgcaaaagagttcacatacagcagttcctactagaggtaagaatgtatatgcaattaacaatatgtcttttacaatttaaatctaatttttaaaatatgaacaatattgtttttatgtagtcaacagagaaaagtacaaaaatataactgcccagaaatcaagtagcaatattattttattacgagaacggattatatccttgcaacaacaaaacagtgtacttcagaatgccaagaaaacagcagaattgtctgttaaagaatataaagaagttaatgaaaagctcctccatcaacagcaagtatccgatcaacgatttcagacaagcaggcagacaataaaggtaaagagaactttaagattgaacagtagtatactatattgtaaaagtggatattttgttttacatgtattatttagtttatatttgtgttaggcaggtctatgagttttaaaaaatcccaggcactgtttactagtgtaattagtttaattactggacttctttaataaggcccatattaaaggataacatacatgagggaaggaactctgaatctaaaagacactttactagcgttcctgttcctcttagtttttctcatctttgaaatatttttacatattctgtattgtgttacatcttagtgtttaaaagcaggcttcatacatacacatagcttacccgtttgcctatgtttgaaactttgtgtttatgataagttacattattaaactaatatattcatcagttactctttgcaaatgctagtataaaatgtgaagattttaatgtaagtatctattttaatgtattccagtaatctatctgtggttctttttactcaggcaaatagtcaacattataccttactcctggtaaggtaatcttaaagcacaagtttaacttacactttgagatgaacttaaagcaaatgaaaaagaaaagattttttgttctttaggtcttcattctttacgctatttgcttgtgtaatgaatgatttgttagaaaattattttgcacagaaaaatttatttcattatattagaaaacaatctttcaatcactgtctcacataattttaagttacacttaaattctctaattctagtatctagtgctttgattcaaacaatacatataaacactttaatggtgaaggattagtgttatgccatttaagaattgtgttctgactttattcccagagtagccttatacccaaaccttaactgcattccaacttacaccagaagtttctggattttacaggcttggccattggaaatgtggcagtgggataccagataagactgagctctatgttagaatttagacacagccactgataccacaaccactgtataggaaccacatttcccaaaatgatttcatcccatatacattttactggctagaattttcttttcttctctttaatatcctctctttcttccctttccttttcttttctcctacgcttcctttctttcttctctagttaaatgacattgttttatatctcaccgtgatattataaactatctgtattcctaggttttttttgtgcaaatagcaaagtgacatgaaagaacattttttaaaagaaagaaaaaattctcaactttaattgttcaatcttattatacaaaaaacatttgaactttttggtgttctcttaaataatttactagaccactggcttttcataagagtaaattctgatattgtcagaggaaaattataaaagattagagttgttacaaaaattattttcctcattctccttggaaaaggattttcttcattgagagtttgaaaagtagtggtatagttacttcttgggagttccttaaattgcatacactatgagaaaaataaaaatagtaccctagggattcaactaaaaatctgtgttagacatacttttttttccttttttgcaatcaattttaatgtcctttcttctaatttttgaggtgccatacttggtagtatcaagtaagaaatccacattttagcacagatttcaactacttgtaaagataaaattaggaggtataaaaagcacctcagttactgcatggttcatctgcattttagagagagtatagtatagatgatcaaatgaattactttcatatgaatttctccctgaagttaccctcaattctagctatttcaaatctcatctattccaaggtaaatgtcttacttttgctactatgttataggtataacttatatttcattgttatatgtaattttattttttaatacaaattttctttagatgatagaaaggtccaagaacatctaatattcaaaaaagtactttaggaaagagtaagaatcagaatttagaaattttccatctcaaaaatcgctatgaactcaaataaatgtaactagtgattaactagaattagatttaatttgaatattctgtacatatggagaaataactgatgtggtaactaaacttagaattctctactgataaagtaactccccaaatattacatagatacagacaaattctctttagttaatacattggtatagtctttctgggctctaacataataaccaaagcttgggatggaagatgtcaagatcccagattctcatctactgggaaatttttcaggttaccaacttgaggatttgggtagtatctgttgatttctgtgatatttttaataactgaacttaggtaaacagattaagttcagcctttcttttcctgcctatttatggtagaattcctatatgctcggtaaatattctaatttaattattttatatctgtatcttgtgattttaaaaccctcaacattttttttattctaaagtattgaatcaggcatcagtaggttttgaacttataggtcttgaatttattgtgcattaataattaacatttaagacagatttcaatatttgggcagcctccatactaaagatattactttacactcaggaaaacttttcaaagactttcaactttttcatatgtaattaaagtaccattgttcgttaagaggttgataagaggaacacaaagtattctttggtatttttttccctgtcagtttcattgcaatgtgttttaaaccattgtagaatttcctcaaaaaagcttagaagaagaaatttgaactgtataggccaaactgctaaagttttggaagaaaattttaaccaagataatagattttttacatgtttagactgagctgtcatcactttaactgtatttttttgtttgtttgtttgttttttttacattttgcctactctaaagatatgtgttacatatagatagtattttacaactatgagctaaatggtatactaggtaaatggcaaagatttgtgattcccaaaagcaggtactgtaaatatcattgtaaaatattctaaacctattttgaaatgcgctatagccctatactaagcattattctatagatggaatatataaatagccatcaactattttcaagaaaaattaagtataaatcttttgcatttgttcaaagtatgtatccgttgccacaggtgtaaagatacgagtaaaaaacatgctagccccattcttcagagctcccttttaatatgaggaaaatgttatacacatgcaatgtttaattttataaatttatttatgcttctcaggtcatacactatttaatttagacaaaaagtaggaaaataatgatattttctcacactaggcattcaaacatgagaaattaactttgttttctataaaagatttttggaaagttaggagatacagagaaatagaaagcatatataagaaataaccttatacccttcagaaattaacatatattcttccactgtatattttaaagatagaaaatgtgataaataaagctaaatttttatttaatcattatctacagccccatcctcttctacctgtctctggagacactttcaggtgttcatactaattttccaataatttaaaaaattgttgcatacatatgtacattgataaataatatacagtgttatttttattgtagtatagttttttgtttgtttttgagacggagtctcactctgtcacccaggctggagagcagtggcgcaatctcggctcactgcaagctccgcctcccaggttcaagcaattcttctggctcagcctcctgagtagctgggactataggcacgcaacaccacgcctggctaacttttgtattttcggtggagttggggtttcaccatgttggctagggtggtcttgaactcctaacctcacatgatccacccacaccagcctcccaaagtgtagccattgggtcctgggcttttctttgctgggagactttttattaggctttgcttttgttacttgctattggtctgtgcaggttttggatttcttcatggttcaatcttggtagattgtatatgtctaggaatttgtctatttgttctagattttccagattattggcatatagttggtgacagtagccactaacaatgctttaaatttatgcagtatctgttgtaatatctgctttttcacctctgatattatttgtcttctctttttcttggtctggttaaaggtttgtatgttttgttttactttttgagaaaccaactttttgttttattgatttttttcatattgttttgttcgttttaatttcatttatttcttctctgatctttattatttcttttcttctactaattttgggtttggtttgctctagtttttctagttcttcaagatgcatcattaggttgtttatctgaaatttttcttcttttttgatgtaagcacttttaggtataaacttctctcttagtattgcttttgctgtgttccataggtcttggtatgttgtgcttcgattatttgtttcaagaaattattgaattttcctcttaatttcttgtttcttaatttcttcacttgtcattcaggaacatattgtgtaatttccatgtgtttctataatttccaaagttcctcttgttattgatttctactttaattccattgtgatcagagaaaatgcttgatacaatttcaacttatttgcaatttttaagatttgttttgtggcctaacatatggtctattcttgagactcatccatatgctaaggagaagaatgtgtattctgcagctgtttgatgaagtgttctgtaaatatctatgaggttcatttggtttataatgtagattaagtctgatgtttctttgttgattttctatctggatgatctgtccattgctgaaagtagggtattgagatctccagctattattgtattgtcatattgaagtctggctctctctttaatgctaacaatatttgctttttatatctgagtactccggtgctggatatataggtatttataattgttatatcctcttgctaaattggcccctttatcattatataatgaccttttctttctctctttatatttttttgtctcaaattttaaaaatatgatataagtatagctagtcatgttcttttttggtttccacttcatggaatatctttttctatccctttattttcagtccatgtgcatctttataggtgaaatgagtttcttgtaggtagtgtatcattgggtcttgttttttaatccattcagctactatgtatcttttggttggagagtttagtccatttgcattcagtattattattcatagatgagtacttgctactgccattttgttatttattttctggttgttttgtggtcctctctttcatccttcctattttcctttgtgtaaaagtgatttttctggtagtagtttttaatttcatgctttagtgtgtgtgtatatatctgttgtaggttttatgatttcaggttaccatgaggtctgcaaataatgctttgtaaccaattattttaaactgataacaactaaactctgattataaaaacaatagacaagcaaagagaaacctaatatacactctccattttaacttgatccaatccccacttttacagtttttgttgtttatatcttttttgtttacacatcacaattacactgttattctgtatttgtgtatgtacatgctattaccagtgagtttttttacccttagatgatttcttactgcttatctacatccttttctttcaggttgtagaactccctttagcatttcttgtaggacagatctggtgttggcaaaattctcagcttttgtttgtgtgggaaagtctttatttcatattagtgtttgaaggatatttttggtgtgtataatacactacgataaacgttcttttctttagcactttgaatatgtcatgtccctctttcctggcctgtaaggtttccactgagaagtctgctgtattagagctcttttatacgttatttattttctttttctgctcttaggatcctttctttatccttgacctttgggattttgattattaagtgccttgaggtagtcttctttgggttaaatctcttatttggtttaattctatcaccctctgatacgtgaattattctcctgtgtatttttaaatagcccatctttaagctcactagtctttcttctccttgatcaagtctgctgttgagagactctaatgcgtttttcagtttgtcaattgaatcgttcagctccaaaatatctgattggtttttaaaaattatttcaatatttttgttaaatatctctgataggattctgaattttttctctgtgttttcttggttcattgagcttccttaaaacagtgattttgaattctctgtctgaaaggtcacatatctctgtcaccctgggattggttactggtgccttatttagttcatttattgaggtcatgttttcccgagtgtttttgttgcttgtggatgtttgctggtgtctgggcatgaaagtgttaggtatttatcctaatctttggattctgggcttttttgtgctcatccttcttgtgaaggctttctagatattcaaaggaattgagtgttatgacctaagtcttgggtcactgaagccacaaatccgctaggggataccctaatcccggtaacactgtgattcttgcagacttgtaccaccttggtgggcttaggtaagatccaggagaattccctggattgccagacagagactgtcattctcttccctcactttgccccaaacaaaaggagtctctccttccatgctgggttgcctggagttgggagaggggtgactgagtcacttcgatgtccaccactgctgaggctgtgctaggtcactcctgaagctagcaacatagtggttattgcccaaggcctttggcaactagtgcctggctgccactgatgtttatttgaggtccaagggctctttagtcagcaggtaatgaatcgtgccagaactgggttcttctttgcagtgcagcaggttctcttctggcccagggtgggtctagaaatgccgtacaggagctagggcctggaatctggggcttcagagatctgcttggtgatttattttactgtggcagagcttttacccaagttgcaagacaaagtactctttactcttccttctcctttctgcaatcaggagtctctcactgagcttccctgcctggagtaaagggaggggtgatgtaaacactctctttactaccacaactgatgtctcagtgggttatgtgcacttcagttcaactggctccaagcccagcacagcacccagacttgcccaaggaccgcagattttattattgcctttcatatttattcagtactgcaggacactttagttagctggtagtggagcttgctggaagtcagtttcctaccagtggggtgaaggactcctctagggcggggatagtttaaatgcaccttctctgggcaccagcagaattccgccttgtgttgtgttccgctgtgacaggactttgctctgtcccccaagcacacagattctctctcggctcagtgtagcactgctggggaatgagggaaggatgatgtaggcaatgcaagactctcttttctaccctcttcagtgcctctttctttgctatgatgttaaaaccagcttttaacctggtttgcctgattgcttacctgaattttggttcttaggaaggtgctttcttccctggataattgttgaatttgatgcttctgagggaagaaagtcactggagttctgtttggccattttgctctgcttccctccctcaatctcatttattattaaacttaattcgttagaatatatttaaggtaaattttcttaaaatttgtttctgattaaaacaatgtattttttctccttacatattaaaatctgtattgcaaaagtgaacatcaagggatagaaatagggtaaggcagactatattgacttactcttccagtttgaatgatcagatttttgacttaaaggtgttactcataatttaattgaaacatgaaaattagtcccaaatcttaagactaacaggatgtaaatgctctctttttttgttccaataatattacttaagtgtattatggctgtggatacctctttctagtaacatatgtgtcatcctaaagactcaaacagtattagctcacagagacaaactaccagaatcatattatcaaagaaaatgtggccattacccatagcacactttttagaaagtctgttgaatgttttatagtaggcactaaatatgtataaaacttcagctgacagattttgctgtggtttcaatatgtcctccaagttttatgtgttggaaacttaatccctaaattcttatgttgattagaggtagggtaattaggattacataaggtcatcagcagggtccctatgatggaactggtagctttataacaggaggaagagaaacctgagctgactggcacactcttgccctttcaccatgtaatgctctctgccatgtcatgacctggcaataaggccttcaccagatgccggaaccatgctcttagacttcctagcctcccaaaccatgagctaaataaaactctattcttataaattggctagtttgtggtattctgttgtagaaatagacagcaaactaagacggatatcacatgaaatttttgtggagttatacatgctgtttagtgtatcttctaaaaagctctctcctgaaataatatctatatttagcgaaaacagagtaacctttatcattcatttatatatgaatggatgagttattttattgattatctctcaatgtttgtttaaataacaaaattggtttcaagagttgtattattgctacagactgaattgtgttcctccaaaattcatgttgaaaccctaactcctggtttgatggtgttgggagatggggcctttgggaagtagttagagttaaaggaggtcctgtgggccctcatcatgtggttagtgtcctaataataataataagagacacccgattctactctctcttccataataggacacaacaagacacctggcatctgcaagccaggaagcgatctgctgctagaagctgactgtgctgacaccctgatcttagatggctagccctctagaactgtgagaaagtaaatttctgttcttttagcaacccagtctggtggtttgttttgacagcccaagcaaactaatagattttggtgccaagaacagggtgctgcagtaacacatcaaatgtggaagtggctttggaattgggtaatagctagaagatttttgaggtgcatgctggaaatacgtaggttaagggtgattctactgaggtttcacatggaaatgaggaacatgctactggaaactagaggaaaagcaatccttatgataaaatattttttttaaaaaaaccttggattggctgaattgtgttctagtgttttgtagaagatagaacttgtgagtgatgaagttggttgaaatttctaagcaagcattacaggaatggcttgatttctcctgattgcttggttaaatctaaaggagagagataaactgaacagaaattattaagcataagtataccacaacttggaagatatggatatttttcagcctactgatagtgcaaataacgagaaaggttgttttgaagagaacattaagagtgtggctgtacaatcatttgatgaggagatttgtgtgaatgtgaaccagggacctaatccttcttagcagaaatcaggaacagagattggattatgccaggagcaaccagctgggtctaaaggaaatgaagaaatagacaatgaaggaaagctgtcaaacttcttggattttctggatgggccaatagatctatttaactataaacctgcacaatctttcaagaaaagagaaggaccccaaaagcaattcacatattgccatgttgccactcccatcacgggcccagagtgcaaaggctaagggattagagctacctccacattggttttaaagagaaagaaagtgtataacttctaaattgtagtaagaaatagaatttttaaaagtgtaaaaagtagactaatatccattaatctaaaactatttactgtttgtcttgtttcgatagtcttcctacatcttacatattgttatctgagagagctaaagtccaaaatttttgtcatgttgtatttatatccatatgtacatgtatataatatatatacattttatatatgtaataattttatttgagttattagaatcttttttatgaactcttgttctcttcttggactttaatttcttcttttgtatctttaatcattttaaacaaacttatatattctttcaagtcacatgttcttgaggttctaatcttcctgtttattttttctgattactttgagccaggatgggatgtttctacatgtgtgtacagttttaatttgcagctcagcaaattaaaattgtaattcattgtggtaattccttgaaccctgtctttggggagcattcatccagactacactacttaatatttatgttaattttcagggtagtaagattcctgacctacactgaaaaattcagatttcaacccacatgaggtaaagtcacagatataaacattcccagtagagataactgagaatttttgtactctgccctggtcccaatcagagacatatttctttattacctttctatcctagcaatattttttagtctacccttgaactgaagttgcagcactccagaggattctcaaatttggcctctccgagcccaaggtcaaagtttcagctcctgctcccacaattcctgaagttgctggccctggtgatttccatgcagcaggtgctaccgaacctccagtcacatgctccgtgctctgctgctggctgctctctataggtgactatgatcccagcacttgagttgctgcttctttttttttttttttttagatttttcagcaatactcgaaaagaatacttgatatcatatattttctatgtgatacagagggttttcaggttatattgtcttccagactgccaatctttagatagtttaaaaaaaatttacctgtatttcctgtcaaatatgatatcaaagattgaacaaaatatttaaaatttcatgagtaaagagtacagtgggtgtattttagcctgtaaatctcacatgaactttcagtggctgttttcttttttttctaaattatttactagaagaacaaagacaaatcatactaatacatataggcatgacagttcaatactattccaattccttttcccacttaatattttctttacttcatgattctgtgtatttggtggctaaggcaattaaaactaccaacatttaaggactgatccttgaaaatattattgcccttagttgaagtaagccagtgttggggctctcaacggtggattatcacatctgtaccatagtagtcatctttcctcttgtctcagatttccaaatttggctgcatagtaacccattaagatcattctttcattcatcaagcattgcttgggtatcttctgtgtgctagggtccatgaagtataatgggaacacaacagtgaactagacacaggtatggttttactctcatggagcttatttgtggtaagagacagaatataataaccatgcaacagaataagtaaaataattaaagattacagagagtgcattgtaattagggataaagggagagaatggttggttttagatcacccttgttcaaggaatggcatttctgagaaggtgacattgacaccaaggcccaaaggatgagaggtagtgtaacaaaattagcagagtcactttcaggtttattaggagtcctcttgcacttttcaacttcatgagtacactgccctgcagtacagaagaaggataataaatattaatggggaaaagttagtccagacagattatgataataataatagtgagaatagctaacctttacgtgcttactacgtacagggcatcttctaagcactttgtgtgcaatcattcatttaattttcacaacatccctgtgagattagatactatttttatctccattttacagaaattaacttgtataagttcatatgcctactgaatgactcagctactgtatgccttctcaaaagtttattttgatttgttgtatttattttttgaaaaagctgattttgtttttcagtaggttatatttgcacagtggaagcttttgcaaacttagtatttttcttatttgatctttataaactgtgacataattattctcattgaaaaaataattcagttgagatccagagagtttagttaacttgtgcatgtttatttcactagtatgttttagatcttttgctcatattctggtgttctgactctaactagtaggccttctttactatgcaatgtttcaaataaatgcattctcaaggtcacaataatacacaattataggaaggaaagttattttggtgttctaaaatcagaatagcatatatattaaatgattaagaactttaatcattggatgacctttgttatttactttttaaaaaaattatatttatttattaatttattccagctcattccttgaacgatttgaggcagttagtgtctattatcgtgagttatttttatagattctttgaaaatacagaaatgctctagaaatatcatcagatattacatatttggctttgtatatttatatagatgttttaaataaaaataccactttatagtaataattaaaaacaaatctgcataaaactcattatatgagccaactgtggaagtagtcaataaaaatatacataagcagattcatagtagcaacaccctatttatctgagcttgtcttatctcaacaatgctaatatataagacttcttagctgtaacagaagttcctggagacttcttagctataacagaagttccccgtgatagattcaagaattgttaatggaagctattgtagactgtggcaacagttgtatgactatattcgctacagctgtaattgttgcttaaagtacccatgggaacattcttcaattaatcatcttcagaacaagggatatcatacactggaatatataaataaagtatttgagtatgtatttatatttcatatcaaattaaatttaaggcacttagaaatataacatttttatgatgctttaaatttgcaaagaattttcacatactttcacaatttgagaaatacagaatatccatgagttaattggataagaattattatcctgtttttatgcaggaaaaaaagagaccgcgtgggtaaatgacttatccatgggtcatggttagtaaatgggaagtcaaaatcttgaaccttgtgttctgactatagagtcatctctctctaatcatcctgcacagatttttaagaaaataaaaataccgacatattttacattttaccccttttaagtatagtagaattttttcaaaattatattaaaaatataataatttgagtccaaaaattttagattcacatatggttagccaagcaaaggaattttattgctcttactagtttcatttgaatggacatttaatatttggcaaaaaatttcaacttcagaatatggcttctgtgatttccatagctaaacactttgaacacattttctgaaaacttaccatattgtatttgaattgattgttcatctgtctgaagaaggtatgaagttattgacatccgtacttgtatatttaatctttatttctagtctgattctataacttttaaatgtaactaatataaaataaatgatctcatcaggtgtgtgattttatacatctcctaaaattctccctagactctttccaagaatcatattcctgttccagtccgtgttatcatagctggcttaagatttcctataataaactactcttttcaattgtcacccattagtaattaatatcattaatattaccaaaattacctatcttttaaatcatactatttgaaaactctctagtattctgtcacaccccttatttacccattttaaaattattgatacataatagttgttcatatttatggggtacatgtgatattttgttacatgcatacaatgtgaattgtatgcattgtgtgggtaattataatatccatgatctcaaaaatttatttctttgtgttgagaacattctagatcttctcttacagctattttgaaacatacaataaattattgctaactgtagttgccctactgtactactgaacactagaacttattccttctatgtaactgtatttttgtacacattaaccaagttctcttcaccccgacgcctgccaccctttgtagcctctggtaaccaccattctactcactaccttcaagtgatcaattttatttagcacctgcatgtgagtgagaatatgtgatatttgtatttgtgtgcctggcttattttatttatcataatgtccctcagttactcccatcttattggaaatgacaggattttattcctttgtcatggctaaatagtattctattgtgtatatatatcacattttctttatccattcatctgttgttggataactagattgattccgtgtcttggctgttgtgaataatgctgcagtaaacatgggaatggaggtatttttgacatactgatttcatttcctttagctgtataccccagtaatgggattcttggatcatatggtagttctatttctggtttttttgaagaaactccatactgttttccatagtggtgtactaatttgcatgtccatcaatagtgtatgaaaattcccttttctctacgtcctcactagcatctgttaatttttgtctttttgataacagccattttgactggggtgagatgatacctcaatgtggttttgatttgcaaatcagttatgattaatgacattgaacattttttcttataccttttggccatttatgtctttttttagagaaatgtctgttcaaatcttttgcccatttttaattgtgttatttgtttttgctattgtttgagttctttgtatattattgttattaatcccttttcagatggatactttgcaaatattttttctcattatttacgttgtctctttgttgattgtttccattgctgtgcagaagcattttagcttgacataatcccatttgtctatttttgcttttgttacctgtgcttttgagatcttactcaaaaaatattggcccaaaccagtgccctgaagtgttttttcccagtgtttcttcctagtagtttcacagttgtgggtttcgtattaaagactgtaatccattttgatttatttagccattcctgagacttcagtgagccattaattaacagtcctaggaacattgtttaatgtgtagaagattaagatctgtcccagctacatcacttactaggtataacaccagaaggaagcaacacattttctaagtgattaattccttatctttaaaaagataaaggatcaaacaaatatatttcataaactaggaagcatcttattaaagcacttctctgcatgcttagggatactgataactcttctgcaaaagtattcctctacattgtgtgtaaatagtagaattgctgcctttttgttttccatattaaatcattagttttaaggtaaagttattttcatccttatggtgatcttgtatcaatgtgagagacccagtactttgaaacatgaatgaaatgaagtaaatccaaacctggagaaatcaggggaaatagcagaccactagagacaaaaagtaaaatttatcaaggcactaaaaaaacaaaaaacaaaaaacaaaatccttcaatggaatgaatgaatgacagcttaaactgtcagccaacatgctaaaaaatatttgtaaagcacaagaaattacaagtggcctgatgtatttgaaaagaaccatagagagtgtttagaagtgaaatcatacagtgagtaaaattaaaagttcactgactgtaattacatacaggagaagagcttcagaattagttaactggatgagggaaatgactagatgatagatagaataatttattcagaaaatggcatagagacaaaggaatgaaaaacacagaagatatatgagttatgaagggaaaaagaaggtctgtcattaattaggactcctgaaggatgggagattaaatggtgaaaatttttttttcaagagaagttagaatggcaactgacttctcaaaagcaatactagaaaccataagacagtagaacagatcttcagtgtgtgctgaaataaaatgcatcagtataaattctattctctgttaaaatatttcttaaaatgaggatcaggccaagtgtggtggctcatgcctgtaatctcagcactttggaaggcagaggtgggcagatcacctgaggtcatgagttcgagaccagcctgaccaacatagcaaaaccccgtccctactaaaaatacaaacaattagccgggcatggtggcatgtgcctgtaatcctagctactcaggaggctgaggcaggagaatagcttgagcccaggaggcagaggttgcagtgagctgagatcatgccactgcactgcagcctgggtgacagagcaagactctgtctcaaaaaaaaaaaaaaaaaacaaagattaggaacagaaaaaaaatgtctaacctccaaatctaacattattctccactaaattcctcactagaggaagctatttgattagagtaaaagtgatctgagatataataaaattgaagagtaaaaaaagtgacaaatagcttgacttataactgtctttaaagttaagctttaagtatgatgcttactgtacattttgatagataacatatcaagttaagaaagttttcttctatttttagctttcttttttttttttgaaatggagtctcgttctgtcgcccaagctggagtgcaatggcgcaatcttggctcactgcagcctctgcctcctgggttcaagcgattctcctgcctcggcctcctgagtagctgggattacaggcgcctgccaccatgcctggctaatttttgtattttttagtagagagggggtttcaccatgttggccaggctggtcttgaactcctgacctcaggtgatccacccacctcggcctcccaaagtgctaggattacaggcgtgagccaccgcgcccagccctatttttagctttctaagagtttgtagtggtttttttttgtttcttttttgttgttgttgagacagggtctttctctgttgcccaggctagagtgcagtgacgtgatcatggctcactgtaacctcaaactgctgggtgtgtgtcaccatgcccaactattttaaaaaattttttgtagagatgggatctcactttgttgctcagggttgtcttgaatacctggcctcaagcagtcctctcaccttggcctcccaaagttccgggattataggcatgaactaccatgcccagcctgtaagagtttttaattaggaaaaattgtttagttaaataactttttgaaatttatggagatgataataagagttttccccaatttactctgttgatatagtgaattacattaataggtttccttatgctgatctattcttatattctgggggtaaactctacttaatgatattgttctcttattagattatataactgcaagatctgtagtgatagtccttgtttcatttctgataagaggatttgtgtcttctttttatttttcttgttcttgctagaaacaacaatttagttgatttttcaagagccagctttttgtttcattgattttctttgtttttctattgtcagttttatttatttctgctcttatctttattagttcctttttttctgcttgctttgggtttattttggtctttttctaactgcttgctataagatcttagaattctcttttctgatataactgtttagtgctataaatttcccttccatcactgctttagctgcatcccatattcttttaatatactatattttacatttcattacgttcttgctttttaaattttctctgaaccttcctctttgacttgtgtattatttaaaaatatattgtttaatttatgagtgtttgcaggttttcctttttcttttttgttatcaaattttagttttattccattatgaccagaggctagtctgtgtatatttccaaatttgttgacgttggttttatggtctacatatggtctatcttgttgaatatttcatgggaacttgaacaaaattacgatttcagctgctgttgaatagagtgttttatagtatttggtagcaattaagtatgtttaattaagttatgtacttttttttaagtatataggttgtctgtgaagtctctcttcattcctgaaggatatagaatttgcagacaacagttctttaagaaaaaaaaaaagttgttgttttggaaaacaattgtgccacttttcttttggcctccatagtttcagttaagaaatctactgtcattcaaattagcatatccctataagtaatgcattatttctgtctggctactttcaagatttttttgtctttcattattaaaagttggcttttaaaagtagtccattacttaaattttgacttctccaaaaacaagttattaagaatgtattctgtattgcaagataatattttttcttcctgactgtacgagactagaaaaactgtctttaaataatcaattactcttggcttatttctgccctgctttacctcggttctggagcttagtgcctagagttctactaggaatattcagtggttttgttttttggttgttgtttgtttctaagagatatttttggaaagagaggcactcattctggtctcatctgctttatagtttctacaaagcccttactgttccaataatgctttctggacttagttatttttatgaatttatttttatactgcatttgcattacagtggtataactacccctccaaaaacggtaccttttaaacttttatttaagataacacactgtcacaatggctgttaagactatgattaaaagatggtaggaggagcattttgaaatatgaagtggaatttgaccttagactatgaaaggtagtgagagtactcaaagagtggctcttttttttttttttctttgagacagagttttgctcttattgcctaggatggagtgcagtggcgcgatctcggctcactgcagcctctgtccaccccggattcaagagattctcctgcttcagcctcctgagtaactgggattacaggtgcatgccaacacgtccggctaatttttgtatttttagtagagacagggtttcaccacgttggccaggctggtctgaaacacccgacctcaggtgatccacccgtcttggcctccccaagtgctaggattacacgtgtaagccatcgtgcccggccagggtagctccttttttacgggcacacttcccatctgacctgtcaaggtaacaaattccctagccctcgtccacccagctggtatttccagatctttatattagaatgtggctgtgcctctaggctaggggatataagagaaacaaataaatgtatttccttattcttatccaagtggtggtctagcctccttttgtgatatttatttacctttttacattataaacaatttaaaagcaagaatatgctttacctaattttgtatgttctatagtgcccacaccataatttgataaatattacatattttctcaatattcatagaaaacattatatactattgtttagtttatgattaaacatcattatcttctctgatttcttgatgaattattgattcccctaccgtctgagtcagatccagctaaattctgcagaagcacgttttgctgcagaaactttttcggcaatggcaatcttaaagcagtttcctttttagaatttgagctttcaaatttgcttcatatgttgtccaattacattaaccaaataatcttaaattagtttaatcaagcctcaaataaaagacttttgctaagtgtcagaatttggaattaaaaacagcagagcacagcccattcaacaaatgccttgggttttctagttaatctagcatataaacattgagcatgaaaactactaaatctgaagagacctttagcaaccctttaacactaaaagggccttatttcgtggatcttcattttaaaaatttctgtatttggagttatgtgattgttactgtatccaaacttatatttgtccttggtttatatttatttacagaattcttatttgaaagataaaaggtattaaactgtaccagagccattgtttttttcctgtcaggaattgcagaattttaaatagcctcatttccgtttttgtgatctgtgttcacaccgctagtaataatgaagtagaaaactactctttttgtaccttattgctaatctccagagttttcttttaccttaccccaatagtttgtgtagtacacattccttgtagggtattcattttatatacgtcagattctctagggccgtggcttttgccagatgaagcacttttgattttgaggctgatgaaacacagtgcggttattgatctgtgcgtgacatagcctgtctctctcctagcagagtgtagcaacatttatccaggaatttgtgaaatgtcactcggatcatgttcgcaaggcaaactgtgcaaaacccaggatcagagctgagaatccatgtggaattggacgtgactgtcttattcctatgtcctgtcttctattctagatgaagcaagtggtatttgttaacagaatatctgtgtcctatattagactttgtaggaaactattattaccacttggaacactgtatactataaaattgcacttcttatactctgttttcagattcatttcttatcttaccaaagaaaatattaatatgagaatatgtgacctgaatagcatcagttagaaatttcttttctgtttaaaataaagcagtgttataatatattgcacaattttatatttctggtagtgtcctgattttttacatcaacatactttcagataggtgtgtctcatcaatatcaatgtttcaggaagtgaaaaattgtagcatatttatcactattgaattgatatactatttaactgtgcatatattttagagtttggttttaaatgactagaatatttgtatgcacatggataagtatgtttgttacaattcaatttagtttaatgtacctaacacatgtaaagcgctataataatggaatattcaacaatgaattaaatatgaaccttgtccccgataataacacagttgaacatatgtataataataaaaggaaactgtgagatatagagatatatatgtatatgtgtgtgtgtgtatatataacatggatgtttaaatgcatgtggagagagagagttattcgttcctgtcattcttgattaaggcttttgaaggagtggtatttgggcttaaccttaaggttttgtatgattttggaagttgtgtgcattgaacaaagtcattagaagaaaggatagcttgaaaagacatctagctgacatagcagtttgttgagaatagtgaataatctggtttggctgtggttctcaaccctgaccacttattattctcacctagggaactttgaaaaatacttgtgccaaggcctgaccgtagaccaattaaatttgaatatctaagagttaggccctgtaccttggtagttttttaaagctctcaggtgattctgatgtagaataaggactgagactaaggctcgagagactagagattgaatgcaagcaactagataaattattgtttaaatatcaaggcaaaagatgattaggaagagatctagacaatattagtagaaatagaaagttttttaaaaaacaagagactttgcagtgttataatcccaaaagtttgatgaccaattgcatataggaaggtaaagaaaaaagaggtatttaagatatttttcaggtttttaacaaagtgagtagaaagttgatgatagaagaattgtatttgtgacaatgtaatacactaaatattgtggtgagaaaataccaagaaagttgaataaaatattaaaaagggcctcataaatgcatactagaacttgcaaaaagaattaaaaagaaactaaatccttaggatctaaaatcaacaacagcttatcgtttgtagccaaatggtaatttgttagtgaactggaaatatcaagtaagtagtaggatatatgagtttaaaatttaggggataagcctgggctagacatataaattttgcagccatgagtatgtagatggcatttaaaaatgaagctgaatgaaatcaccaagggcgtggagataggtacaaaagagataaggtccaagatctgagctctaggccctccaatattcagaagttggacagatgagaaaggaccagaaaggagagccagtgaaagggaaaagcaagagaaaagagaatcttagaagccaaatggttaaagtatatcaagaagggaatgatatactttatcattctctatgccaactgctgcttattagaatcagttcatgggaggaattgaggaatgggaacagaaagagaggaattggaggatataattaaatatgcatacattttagagttattttgaggagatttgctggaaaagggagcagagagcctctaaaatataaacatctaataacttaggctcaaaataaataattcatgtattgataatatcagtacttttaagtaatgctgataaaaagtcattaaagatatacattattttaacagagcaataaaaagtctttctctaagtatttatcaaaaatgttcacataactaggccacaaaacaacattccataaatttcaaaggatttgtatcatataaatagtattatctaacacaagtgaagtagaaaatactttaaaaagttaacttaaaaatatctgatgcgaatttatagaggcatttctaaaaactaatgggtcaaagaagaaaacaaaatgaaaatgaaaaatactttagattgaatcacaatgaaataacacagatggaaacttttagaatgtgactaaggtggtactcagatggaaatttatatccttaaatacttgtagtaagattagaagaagtctaagaatcacagagctaaacattttatttaagaatgagaaattgaataaacccagtgttgtagactaaatatatgtgttcccccataattcataacccccaatgtgatcatttcaaaagtggagcctttgagaattagttagggttacattagttcatgagggcggggcccccatgatgggattaatgcccttataaaaagaggaagaaacaggagatctctctgctctctgccatatggcaacttggaagaatggcctcaccagacaccagatctatccacaacttaatcttggacttcccaccatccagatcataataagtaaatgtttgttatttaagccatgcagtctatgataatttattatagcagcccaaactaagacacccaaataaaatagaaatattaaaataagggcaaagttgatactgtagaaagtaaaaatgcagcagacatgatcaacaaatccagaagctggatcgctgagactaataagttgacaaacattaacaagtgttgataaggatatagagaaattgtaaccttcatacaatgctatgggaatgtaaaatggcacaggcattttgggaaatggtttgacagatcctcgcaaagtgaaacatagagttaccaaataacctaccatttccactcccaggtatacatttaagagaactgaaaacacggccgggcatggtggctcaagcctgtaatcccagcactttgggaggccgaggcgggtggatcatgaggtcaggagatcgagaccatcctggctaacagggtgaaaccccttctctactaaaataaaatacaaaaaaaaaaaaaaaaaatgagccgggcgtagtggcaggcgcctgtaatcccagctattcgagaggctgaggcaggagaatggcgtgaacctgggagacggagcttgaagtgagccgagatcacaccactgaactccagcctgggcgacggagcgagactccgtctcaaaaaaaaaaaaaagaactgaaaacataagttcacataaaaaacttgtacattaattgatagaagcattattcatagtagcccaaaggggaaacaacctatgggtccatcaacttatgaatggagaaaaaactgtggtgtatccatgcagtggattatcattcattaataaaaaggaataaaatactaacatatgttacaatatggatgaaccttgaaagcatattgctgagtggaagaagctaataataaaagaccatatacagtatgattctacttatataaaatgtccagaaaaggcaaaatccatagacagaaattggattcagtggttgactagagccagggatgggaaaggagtttctgtaaatgggcatgaggttctttagaagtactctacaattagtgtgtggtgataattgcacaactctgtaaatatacaaaacatccttaagaaataaacttaaagaagtgtacaccacctttaaaagataaaaacgtgccaaccaagaatattatgtctggcaaaactgtcttcaaaaatgaaagtgaaagagactttcccagacaaacaaaagtagagggacttcatcaccactagacctttcttagaagaaatactaaactgagttcttcaagttgaaacaaaaagatgctaaacagcaatacttaaaagcatgtgaaagtataaaggtcactggtaaaggtaaacagtggtgtgtaatcactttttattctggcatagaaattacaataataggtattaaaaaacataactaaaaatatgataatgaatacataatataaaaagatgtaatttgtttcaccaaattacatgtgagaagtaaacgtatgaatattttgtatgtgattgaagttatgttgttatgagcttaaaagattgttataaacaatatattttatgtaagctccatggtgatcacgaagaaaatacctatagaagatacatgaagaaagtgaaaaaggagtcaaaacgtgtcactgcaaaaaaaaaaaaaaatcaatgaaatacaatgaaagatagcaacagaggaaaagacagacaaaagagctataagacagaaaacaaggtagcaataggaaattttttcaccatcagtaattaaatataaatggattacattccccagtcaagagatggagagttgccgaatggattaaaaaaacagaattcagctatatcctgtctctatgagactcactttagttttaacgacacaggcttatagtgaagggatggaaaactatattccatacaaagggtaagcaaaggagagaaggggtggctataccaatatcacatattaaatcaaaaaccattataagagacaaagacattcacctgaaagaagggcctattcaccaagaagataaaacagttataaatatttatgtggcaaacctcagaactcctgtatgtataggaaggaaactttgacagctgaagggagaaataggcagcaacacaataataggagacgtaagtactccactttcaacaatggatagaacaagattaatccggaatcagaggacttgaacaagactgtggaccaattgaacctaacagatatgtagagaatactctacccaacaacagcagaatatatattcttctcaagtgcacatgaaatattttccaggatagactacatgttaggccaaaaacataccttaaatttaagaaggttgaaataatacaaggtatcttttctgatcataatggtatgaagctaaagagcaatagcagaaggagaactgtaaaatccacaaatgtgtagaaattaaacaaaactttctctgtttttgagatggagtctcgctctgtcacccaggctggagtgcagtggcatgatctcagctcactgcaccctgcaccttctgggttcaagtgattctcctgcctcagcctcctgagtagctgggattacaggcgcgagccaccatgcctggctaattttttgtatttttggagagacaaggtttcgccatgttgaccaggctggtctcaaactcctgacctcaagtgattcactcgccttggcctcttaaagtgctgggattacaggtgtaagccaccatgcccagctaaaccaaacactcttaaacaaccaatgggttaaagatgtcacaaagaaaattagaaaataccttgagacaaatgaaaatgaaaacataacatacctgaatttatgggctgcaagcataagcagttgtaagagggaagtttatgtactgtacacttgaaaatttgttaagaaagtagatctcatgtttttttaccacaataaaaaaggtaaaaattttctgataaaattaaatatctgttcatgataaaaattatcttagcaaactaggactagcagggaactttcttattctgttaaaaggtgtctaccaaaaacctgaaacagttctgttaaaaggtgtctaccaaaaacctgaactagccatcatacttaaagaagttagatgcattctttttgaaatcaggaagaatacttctatgcctgctatcattgtttgtctttgatgttgtacttgagtacctaaccagcacattaatataagagacagaagtgaaagttaaatatattagaaatgaagaaacaaaaccatcattagttcccatgcattatgcttgtctccacagaatctgaagacaaattactataattagtaagagatttcagcaagattgctggatcagtaatatacaaagataataggactcatattcaccagcaatcaacagaatatgcaatttaaaagaaaaatattgtttaaataatagcaggtattgtgtggtatctaggaagggaagttgtattacaatttcagggattgttaaaatgtgaaatagtgtctttaaattgctatatggttgaggagtctatatgtgtatatattctaaaagtataaagaaaggtaagggaaaaataaacaacaaagttattcaggatagtgattatttctggtggatcaggagagacgttcatagcttcaactgtattggtaatatattgtcttagttgactggttaacacatgggcattcattgtatttttctttatatacctatggtatattgaaatatttcattaaaaatgaagaaggaaatctactgatgtcattagcccagagaaagaatgctggaggtggaacaaatctttgcagcaagatcttaagtttgggggagttatctgctatatgggcaaagaggagtcagagaaggagatccaaaagaactgtacagagaatgtggaggaaaaattgagtactttaataaagaaacaagggagagaaagtttttaacaagaaaaagagaagctttggtcaacagtgtcagatcccatagaggaactgataatagaaaactgagaagagactgttggactttactaagaagactgtattaacaagactgtcttgatagcaagtgatagaaacagacttcaaactaacataagaaaaaaaacacaaaatcaaaggatgaactgtagatcatagacttggtaaaggtacagaaaattgcagacagacactctaatgtttttaacgcttctttctcacatctcttcattccagaccagaccagctttctccatgcagctctggccatgcgtattggccatgtggtaagcctacattcttatagctctacctcagagaaggaaagaacttctctgcttaaatttggggagccacaggaatacaaatactttgtctgtatgtcattttgagttaggatttaggttatttcattatatgttaattgtcacctacatgagtaattgacaggaatttcagagtcatgagggtacagagtagtttctattgggcaggactgatttatacattgcagtacttatgtattctttgctgtcacccacttcagttgccaatcattgtggcactcaaaagtgccccaacaaatttccaaaatacacacacatctgggtagtatgtactatttgagaactactgatttagaagaaaagcagatcaactggcttgattaataaaaatggaagaacacctagacttaccctcttactaaagatctacatgaatcattgtccttgatgtagcataactgcctgagagtcaggtatttatttgactttatttattgagtgacctactttgttaggtcaagcctttttacttgaaagaatatgataaacagaaaacaattctgaatagaaaatgaagggaaggctgatggtagaagttcctatgtggaattttgtgtgttggaaaaaatagcttttcagtgaaatctatgagaaataccttgaataatatagtataggtcaaaactttgcaaatctcttttttctatataaaggaaatttctactctatgctatgaaagactttttttggtaatttttacatatgttggtccttagttttttaaaatcccattttaaatggtatcagtaactttttattttatcaaatccaaagatttttaaaagtcctttctaaaaatgtccatttttcactatcttgaaccttatgaaatttatacagggaatagaaaaaaacattattgcttctcttgagaatttttatagggtatatttataaatgatcaacatgatatgaatacttagtactgctgctgttaaatttgtaatgagttgtagggttttgaaattccctgactggctttcatccaagcactttatttgcaagacttagatacggtacaaccaacgagagacatacagttaactattgaccctgtggggaaaagcaagagagatcagattgttacagtgtctgtgtagaaagaagtagacataggagactccattttgttctgtactaagaaaaattcttctgccttgagattctgttaatctataaccttacccccaaccccgtgctctctgaaacatgtgctgtgtcaactcagagttaaatggattaagtgcggtgcaagatgtgctttgttaaacagatgcttgaaggcagcatgctccttgagagtcatcaccactccctaatctcaagtacccagggacacaaaaactgcggaaggcctcagggacctctgcctaggaaagccaggtattgtccaaggtttctccccatgtgatagtctgaaatatggcctcgtgggaagggaaagacctgaccatcccccagcccgacacccgtaaagggtctgtgctgaggaggattagtaaaagaggaaggaacgcctcttgcagttgagacaagaggaaggcatctgtctcctgcctgtccctgggcaatggaatgtcccggtataaaacccgattgtatgctccatctactgagatagggaaaaaccgccttagggctggaggtgggacctgcgggcagcaatactgctttgtaaagcattgagctgtttatgtgtatgcatatctaaaagcacagcacttaatcctttacattgtctatgatgcaaagacctttgttcacgtgtttgtctgctgaccctctccccacaattgtcttgtgaccctgacacatccccctcttcgagaaacacccacgaatgatgaataaatactaagggaactcagaggctggcgggatcctccatatgctgaacgctggttccccgggtccccttacttctttctctgtactttgtctctgtgtctttttctttcctaagtctctcgttccaccttacgagaaacacccacaggtgtggaggggcaacccacccctacagaccctatcatgaaaatatttccgtttttaagtattaagatgtaattcatatttaggatatatttaagaaacatatgtctttcgctagcttgaatatatgaatttggagctgcaaatgatgatctttagcctttgactctataacccccaaagttggtaatatttaatttagattaatgtgataatgtagtcttcctaagaactgattcaaatgtaatttaatgtttatattcatacttttcagaggcttactgagaaattctttatcttataaaatttaaatttcagaaatatatcatggtctattataaatttttagaagtcaaaaattattctaaggaatactgatgcctctcttttgaagcttatgtaggaattaagtattatgagcaatttaatactatatatggatattgatttcctctggctagtccacaaaggccttttagagcaataaaataccataaaataagaagtaatactattgtaatagcacaccacaaggacaagaaaacagtcaaataaaagtattgaaatctgatttctaggaaaaccaagtttaatcagagatgaatcagcagtcttcatgagacttctgcagatatttcatagtctgtttctgataactcagtcattataattgtactttaaaagttatggcctcttttcatgtgtatgtctttaaaatttatgaatgcggtatttcacatagactgcagtcaaagaatctctcatccgcatttactctgagagaaattgcctggtgggcaactcactgccatcagggtcccagagcttctcccgctgcggtgtcagctacaggaaccttatcccagctcaaaactagatgctatcacatatcctgttgcctgtctgcactcccataggaaagtagtaattaagttccaacagagccatgttgccaagcctaaagacaatcctggtgccataaaactggcagatacattcagccagctcacgaatacactttggggccctccccatagttgaggttgcagaggtttcctgtgttgagaaaaaagtgtttggaaaagttctcccaaactgccctggcttggctttaaacgtgttggcgtacacagttgcggtccgctggcccagcgtgcttctccacctaggtggtcgcctgcactctgctccggtgctgtgcatgctgaatccttggacacttgttggtcccccaaggtgaaactatcagcaggactcacagtttatcaccatgggtgccaacatcccacctcagagaattgctgaaaaaactgaatcaaatatgagtggtttattcaactgaagttcaaaatctttgatgaagcttatatcccttgtagtgtagcctgtcagttcctggttaactttcagcaaaacacattttcttggtaagatggaagaattctgaaaatcgatgaccatggcatgtgaaagacatgatttaagtgaatgtctgccttactttcaaacagcaaatgatgctgtccttaagtgacagcccaggtctcgccacatgcctttccaattgttggtgtggctggtctttcatatgggaagactgtacttggctgatcatcttctgttcatttccggaagtgagctccaagggaactgttcagtaacttcatgtaagtttacagataaattccttttgaagtttccgggccatggtttgaagaaaggccatgggaagcgtcttttgttccatgggaaaaatgaaaagtcgccttttctgcataacctagaagatcagggagtttgaggccaagtaccgtactcccttcattgtttccaaccatggtgttttaactgcccattaatttccttaattcagttacttcaaaggtaacatctaacccatttggaaatgcattgtcaccttgacatgtatcactcaaaaaattcacttgtctaaaaaattcctggatgaagaaatttttcacgggcttcatgagaattccacattacctcaatgagatttttagccttaaaaacatctccagttttacaaacggtgatattatctttatttagtccatccaagcccataaaaatgggcatgttgaacagccagatctttgtttttaagaatttcctgtttagcttcactttcaccttcagcaaattcagtttcattttctgatgctccaaagccagatcctcttggtggaagaggctccaaactctgcgtgtacaatgtcctcaggcttccttctcctgctgccacctcatagagctccccaggcctgaccaagccttggttatgagggcaggaggctgccgttctttacttagatacagataatgctgttaacatcaccctgaaacatcaagtattatttttgttgatctggcatgtttattttttttcttggttctttgagtggacattcacttaaaacatctttaaattgggatggattcttttcttcttactgccactcaactccagtaacaaaaaaatattgacaaagagggtgaaggaagaatataattaaagtggtgaatagtaaataggacatgtgaggaatagctatttctatgttgaattaactgaatttaagcaggagaaggagagtgaaaaagaggagttccgaaagacattgcacagtttctcctttaggacatcaaatagcgctaccatcctctttctttcctattgaggaaaggagtcagaatgggtatgcattgcaacctcatagtcattagtaagcatgtcatatgtaagtctcgtgtttaggagggctatgactgaactcataatattaccatataaacattgagaaattatgttggtagtgaggatgatgaattattctggatatacttttggttcccattatctgtcccagtatttagtacctggtatttagttttcaagagagcttttcttctaccattaggtatatctcccagtgctatccctccctcctccccccaccccacaacagtccccagagtgtgatgttcccctttctgtgtccatgtgatctcattgttcaattcccacctatgagtgagaacatgcggtgtttggttttttgttcttgcgatagtttactgagaattagtgggtgcagcgcaccagcgtggcacatgtatacatatgtaactaacctgcacaatgtgcacatgtaccctaaaacttaaagtataataataaaagaaaaaaaaaaagagagagcttttcttctcgtaacttaaacagaagatttgaaataacaacaaaccaacagtcaaactcttttttctgtgaatagacaaatgtttatttttcccgtgaatacttgaaagtcaattgtattagttgactttctaaatttcacatataacgtgtttttactatccattattttccccatacttgtgggaacagaagtttaagtgatgtggttcaacaaatccaattaaaatgcgttcatttagttattcagattattttgaaagacactaccttgctaatatcacataggttaaaatttgctataaaggcatataatgttaaaactattcatataaattaaaagtacttgttaaatgttttgagtatttttggtctttcagaattaaaagtattagtaaactgttttgaataatttgacacttgaaataatagtgttgattttcattttgagaaatatttaaacacagttacaaaatatttaattggacattagctagaacttgtgttacaaagtataagggcattgaattaatttaactccttgtaaatgttattgagagtagcgtatctcttatccatatgcagatatccatatttctctgatagaacctaatttgaacacatcaagacagattggcattttcagacccataaaaaaactgctttgttaattgtaaaccatatttagtatgaccttataacaaagtagcaccttaagtgtcatgctgtgtctttaatgtgcacactggagctgggttcatctgtagcagacaactacacttcatgaaaagagtttttttttcttgataggcaattagcagtaattaggaagattcacctcaataagatgtcaacatgagattgtttaaaaaagttgaatgtcagtgacttaaaaaagaaagttcctctgacacctatgtatggcatgtgaaacatgaaatgttaatttaacttttctgcttattattcatgcacaatattattttgtcattcagactctgcactgacagagtgtaagggtgttaaaatagtgttgctggaataaaaagaggattaatctaccattggccaattagccaaaaggtacttaatggtctctaaaggctactgaagtctaactactagcaaaagcattggtgaaaagtcctctatattaccttcatttgcttgacattttgtgaaacatagtgtagccctttcataactgcagttgtcagaaaatagtatataaatgagtgatgcagtaactcagtggatttttcagaagaaattttgttacataaataattacatctctgcctaagggttttttttggttattggtttttaatttttaattctttctcttagtgatctcaagtattgtaacaagaaaattaatgttttaaatttaaaagtcttacttttaaattactaaacttggaagttattaatctgaactatttacctttttaaataagttgtatggaaaatatttgttaatgacatagaaaatgatagcattgtcttgataactcatacatttgaattgactgtgaatttagtcctatacctggacagcatgcagaattttatttctttcagttttatcccctttaaaagtataatattctcaataaaagaacgttgattctattcacaggagggagaatatcattaagattatggtgactttctagggagttcttgcctgtagaatttacatatattctgttcaattagaattttctctccagtctcatttatttacattctggtaacagaatttatgttgtaattttttagaaacacaataataagattttaaaattgctgcctgtacttaattatgaatcagaataatcagattatgagaatgtaaatgaacttatttctgtattcaacattaaatagtcttaagtcagtcctaagcagaatttaagatgagagattttggagaagttattggaaacagatcattctcgtttaatgattgcttttctctacttggattgtcaagccctttgtctttcaaaatgagaaagaaaactcggagagtacattattgttatagatgggaactaagcctcactttttactctggttactgattggcctttttcaatattgagcgtctcaccgttgctccagcatggactgcaaagtgttctttggccaccagctgtttcctccatgggcctccaagaaaccctgatccagtgtctctggcattccacctcatgtttggctggatttactagaattttgtgtctttatgtttcagactccactatcccaactaagaatatttccaaattttttaaatggttcattactttaaatttttaatccagtggtaaaaaacaaatgggaaagactgaactgtgtctttgaatgctgtaggatggatattgtccagaaaaaagctgtaggtcagaatcactttcattttagaagtaaagagctatacccgatcccattcatttcccttggagcactgcttgtaaactagttggatacccaacagcattttctttacatgtgctacaactagcaacatgttcgttgaataggcagatattgaatattttattctttagagacatcaagatcagagagtatctaaaaatatattgttttgggagtaattagggaaatgattttctcagctttttttctacgccctttatttctcattattgggcctgaagaatattttccaagggccttgttttattttttctggtagttcattcctaaacattaaaatgtttaccaggtctccctgatggagaagggatgcctgatgtcctcagactgcccccagtttactgaccagtgacttggcaactaccttctcttgactaaaagttggaaagcagagtggtcatagatctaagctaggacattcaatgctgtacttagcttctagatcacattttacagaacaaatcaggggaatacggggagggaaacaagctctagccagcatttaccagacaggaattgaaggtagcagcagttccctcagcttcctgttttgtttcttcatagcacttactatagtttattgttacatatttctggattatagaccagtagctacctaaaggcaaggattatttataacctttttcttactgaaaacagagaactagtatagtgccaactacatagtgtgtgtaaaaagaataaatgatagatattgaatcgggttctgaatctaggtactgcatatctaaatctcccagcaaatgtcaagttggggccacgaaaaaaagcagtttgtgaatgaaatcccatataagaaaacaagggaaaataggccaggggtgactaatttaccctattcatgggatcctacagttgcagctgagagcagcaaacaaaagcttctggtcagaggctttttgcttgtcagttaaactacaaaatgcagatctggtagaggcaatttatatttctagcatagaaaatggaacatacaaataaattgaaaaagaacaaaaaaaattaaaaagaaaatgggggtcaagcacagtcgctcatgactataatccaagcattttgggaggccgaggcgggaggattgcttgaggccaggagttcgagaccaggctgggcaacacagcaagatcccatatctacaaaaagaattaaaaattggctgggtatgatggtgcatacctgtagtccctgctgctcaggaggctgaggcaggaggatcccttgagcccaggagtttgaggctgtaatgggctatgattgagccactgcactccagcctgggcaatagagcaagacctcatctgaaaagaaaatgggacagtttgtaaagcaattgaataaataaaatgaatacaaaattatggataaagaaaacaaaattaatccagagtgagaatattatataaactctacgcactgtggggtttgggatactttcttgagatgggacagagtggtagtaagagaacaagaataagttctagaaaggtgttgattaaaaaaaatcaggacccatattaattttctgtgctacaaaacaaattaccacaaatttagcagctgagaaacaacatatgcattcgttacctcacagtgtcattgggtcaggagtctgatacagcctagtggggtgctctgctcagaatgtggcaaggttgcaatcagtgtgtcagccaggctgccttttttgaaaaattcagttacttgtgggtataggactgaggtccgtggcttgctggctaagagccaaggatcattctcaactcattgaggcctcccttaggtcttgacttgtagctcgtctcataacatggcaacttacttctttaaaaccaacgggggaatctccctgatctcagagaatgcctctggccttctttgaaagggctcatctgattaggtcaggaccagagaagaaaagcttgcttttgattagctctcagaaacttgattagggacgctgaccctaattacatctacagaatcctctttgcatataacgtaatgtaatcatgggaatgatagcatatcgtatttctgggtcccatacaaggggagggtattgtaccagagcatgagtcatctgagaattgtgtctaccacaggatattatactgaagagtaagtttttcagtacattcttatttcttcttacagtcgcttagagagttctttccttttcagggatttatgcttcctcaatgttaaatttaaataaattattaatagatagtgtctagtttaaaaattttatagtgttaagttctattttataacctttggttagaaataattgactacacataaatcaatacaaatctcagtacttattgaagtcaacttttaaattgaaatagatgtttaggagactgtagacggattgcactgctgcggatatagagtcagaggagcatatctgccttcaatacctgtgtagtagtgtaggagggatcctagattgattctagtcaaacaagtaactatgacttaagacgagctaaagttttctgtcatgggagaaattaccaggttattatgtatatacgtgttaaagttttattaatctagctcctcagcctttaacacgcttctcagacactatgtagtagcctttaccacaagataacaatgctgacaataatgctgcacgttgaacatctactacgtgcaatcacagacgttttaagattctgtcctcgagatcacctttgttaggtagacaagcaccatctctttttaaatgaggaaacaaagccatgtgtttatgtaagctcactcagctggtaagcagtagacccagagaattcgaatccggaaattatgactcttccatgtgtgttttgttttcacttgttcttaacgtgacttaaatgcttataaatatttgcttgaagatggaaaggtaatagtagagaaataggaatcatgctgctaataaacaagaaaaatcacaattttaagagtaatcttaatttgttggtagattttatagcacagtctctttctaacaaggtcacccacaaaagttgtctcacagcctagagcacttgtaagcaaaagaaagttatttatacatttttttctcatctatagctttctcaagtaagaagtagaattttttaaaccgacagaagttagtaatagagctccagttatttgtccacaatgctaaggagaaccaaaggtttccaaactgatggaatgtgtgatttgcatatttcctctatttcaacagatgctgcatagcatttctatgcatatatacctaacactggaaatatgttttcaagattgtagattttaaatattgtttaatcaaaacattatattttaataaagtacaagtcatttagtttactgcctccataatttcagtatttcttcatttaatacatttttatattgttaaattgaagttgaaagttacatatgcatgtcttttagaagaatgtatttattgacttggtctttcctcagtggaggtacatttatagtgtcaggatctgccaggtagaaagattagacagaaatctagtggcatacaagtataacaaatgagagaagccacctaagtatcccagtaagaagaaaagaacaaagaagccttcaagaaggaggaatactaagctgccctttaaagatgagacagatttcagcagaaagaaacaccacgtgtagagtcatccatgtaaaaatggcaggcaggtttggggagtggcaggcaggtttggggaatggcaggcaggtttggggaatggcaggcaggtttggggaatggcaggcaggtttggggagtggcaggcaggtttggggaatggcaggcaggtttggcttcatgtgatgcctgactgcaacacaaattgaagcctaatcttagagagccttattatccacaaacatttgagctttattctgttggaatgaagaacctatgaagggctttgattaagggaataactggtcagtgtagttttaggaagttgtataaaaggtggaatgaaggtagggaaaggttgacgggagagagagggttgttgtaataatcttaatgagataatgagggtttgcattaagagagtggctgaaaggaatgaaaatgagaaacactgtgtaatttatagaacctgacgattggatgaataaatagagaatgaacaaatagggagggagatggattcaaggttgaatattagccaggaagatttccaggtttaaggagattaagagtttacttttagatattaattattaggctcttttggggcaactcatgaacaaatttcatggaacaaatttcataaacaatttcctaaaaatctatagaaccatacttttagattataaagctaaaatatagccaaatagtttttttcaccacagcatactttttatgttaccaaaacagtttgatctcaagtatatcaagttctagttttgagtccatgatctgaaatattcatatttaataatatgcacttacatatacaaatacatatataattatggtatagtttctagaaattgtgttttaaatatagtgttaatacttaagtaacatgtttcatgtttatcttactgtacactttagctacatcttttgctatttctaattggaatttcaacaaagaaagatttttccccctctgagagatttcagtatcattttgtctaattgtaccttatgttaaggtaccacattataagcttctttggaataataaaatagtaatgcaaacaccctcttaagcagctctgagttgttatgccattatagtttggtgacattctgctcactatagatgggtgaatgagaaaggctaacgttaagatgggtttcttttatactccttcataaaaacattactattatgtcatttagcaaaatgtttatgctattaaaaattcaaaatgtaaggagtttagtgcatttctacctcaacattagaaacaggacttttcaacaatcaatcaagtgcataaaactgagcgagtttgtttgcacgctatttatttgaactaaatctctaacaagcctcgtctgctaattggacttaacatttatgttgctaaatgagaagcattttggctgctatataggatggtaagacctacccagtggaataaacagctaacatctgttatcttgtcctgctccagcttggcttttcccagttaagtactacatcagctctgaagtcaaggttatcaaatatgtgaatgtctggctcacccatgtatgtgtgaaggtaaagaaatagtgcatcatgagtcaggaccagccaaccaaaagatattgagtatagctggttcactttgttttacctttgcaagccatactactataagcaaaatctagtagaggttaagatttttgtaaagtttgtataataactataattaatttcagttctctttaatattttcctagctgtagaattttatgctgataattgttagattaaatatagttacttttaaaatatatttatatttattttctttttttaaaaaaaagaagctaaatttggatttggctgggcttcggaaagaaaaagaagatttactaaagaaattggagtcctcatctgaaatcacaagtttggcagaagaaaattcccaggtaacatttccacggatacaagttacatcacttagtccttcaaggagcatggatttggaaatgaagcaattgcagtataaactaaaggtgattataaaatttattaagcatgaaaacatacattatgcttgaatcctgcaagacatatttatatgaacactaatttattctaataaaggtaaattatgttatagataatccaaaaaattattaatattgccttcatcattaatttttagcctggtagattcttatctggtaatcaatactaccattctctgaaaaagacaagataccatgaaatcctaatttaggagctgatttaaactggccaatatctgctactctaatacttctttctgcccccatgcctccctccagctgaacagaatcctttcaggcatgtaatgcgtcaacataaacagaattgcttttctctacatacttccagcaagttaaacttgagaatgaaaccaacccacttttgctctctgcttcttctccctcccatttatctcctccttctctgtctccaaccaacaaccaacttaaaatagtaggaagtatgtagagaaaaagcaatgagaggagagaaaaaaaaaaaaagaatctaagaccaagcgaaactgtcagcaacttaaaagtaaggctgtccttagtttaaatagaattactttgtaagaaataggatttgtgagtgatcctcacacttaattggaaagttcattttcatgcttcttaagcccatttattcctcacatatttaattattttcttcagtggggattgctagctagaagctaaaaagagcagtatatatgggaccattgctataatgtgagtcactagaaagaaaatcctgattgtaaatgcacagagtacattagaaatggaataatcatccctgttaggagggtattggaatactatgttgaattgtcaaatagactcatcattgttttcggtcccaaataggatatgtgcacccttcaataatacatcttttagtgcagatttactcataggataaataggctaaaatttaaaatgaatgagtttattattgcttgaaaataatttgctttattaatagtaaccaaatatacaaactagcattgggattcttcttgaataccatcttctttagtcaatttatgtgtataacttgggtcagtcacaacattttataatcttaaataacttataaaatattagaaatgtgaaggaagaagtgttgtgcaatttcggggcatgaatcctaaaatgtgtctctgaaaatgtgggataaaatgtgtaaactgaacatttcagtgttaaggtttcatatagagaagataaaatcattgagctattccttgatcttatctatcacatagactttaattcttacttctgtgattcttcatatatttaagtcctcatgattctgatataactttgtttttcaccaagataaaatagagtgctaggtccagtattgtctaatctgacttctaaaagacataaatagttttaagttgatttatacataaatcataatttataatttttacataaacagtttttagttgatttatattttacttattttacttactacaaatggtctaataatttttggtaataatagatccatatgagtgtctgtaagttctttgcattatggttttccatggtataagtttttaccccacatacaaatctctctcttgctttggaggaatgtgtgagtcagaaagagaactaaagcaattagtgtgaagtgattgtccataatctaacatagagtcttggaacactgaccaaactgtatagggacaaaaaggataagtttttacttttgtcttgtttcatgttttcacatagaaatttcctagaagaccaagtacctttaagtacataatattgtctactactaaaaatttttgttttgatgctggtttgtagagattccgtaacaaaataccacagactggttatcttaaatagcaaacgtatatattattctcacagttctgaaggctggaagtctaagatcaaggtgtcaacagttttcatttcttttgaggcctctctccttggtttgtagatggctgtcttctgcctgtgtctttacatggtcttccttctatgtgtctgtgtcctaatttccctttttataaaggcaccactcagactgaattagattccaccctaataacctcattttacctgaattatctgtttaaaggccttatctccaaatacagtcacattctaaagtactgagggttcggtgagaacttctacatactaatttgtttaggggaaacagaatttagcacataacagatatcaaactgctaatatagtgattttctaataagtagcttattttctacttaatgtttttagacttaattgagaaaattggctagattcgaatatactaaaagtttatatacatcttttctatactatccagttaatattagacttttctgtgtaattttacatatacttttctgatgtctctggttcatttacagttgagaaaactgagacacagaaagaataagttacttgtccgagatcacacaagtactgtacatagagccgagatgagaactcaaaccatctggctccatagtccatgctcctaattactatactatgcaaattttaaaaaaatattcaataaacttagtataggaaagctgtaacagggatgactttttaccattgtgacatttttgatgtgtgtgtttcacatcatacatcaaaggatgtattacaaggaaattaccagattttaagttatgttacagatatatattgtatagtagggaatggaaaagggacaaaggagctgggtttcgatcactttttggccattaacttctcgtcaacctggtcaaggaaattacttaacttctctagaggtctaaagcagggatacctttctacccatctgataaaaatttttgaggatcaaatgaaatagctgttagatttagagatcttggccaaagtgtatctcaacctggcattgttttatttattataaattgcttttctctcaattctccaagtcagagttaacagcattttcagccacataatacagccttaagtctaaaaacagaaaagaatcaactagttatcttaatatctacttaactcattgcattgaagatactgtcaggctttatttactgcctgtatcttttattttaaatacaattctaagtttattttacttctcagcagaaaacaccttcagtgcagcacactagaagtatgcgtattaaggggtaggatgattgtttttaggcaggaataatgacacagaagcaaaaaattacaaacaaaagattgacagagaaaaaaaggcaatatgaaaatgttaaggtaaatacaaaattagaaaagcacagtctgggaccatttagaggagcgataagtagacgtttatatcacagtagtccctaaagccatcactatattatagtatagtgataatataatacatattagtatatcatatataatttatagtgataatatttatgatatgatatcactatattaacatatcactattagcttagcataatcatgggtgtccgtatttctaactgaatgaacaatcatcagagaaagaattgaaaattaatgattgaagcaaacgcttcaattatttgataaattgactagtgtgactagtgtggaacatgttattcaggcagtgctggaaataagacacaatacatcactgtaaacgtgcaaaatatggtagaaattttgattacattacacacacatttgatcaaaacataacattcaaaagagttaccatgttgaggtagctttgggtttttaagaaaaattaatgtttcatgtaaaaattaaaattatttcaaatgttttatttgtatgttatacccatgagatatttaaagtcagtctgatgaattacatttaccttgggtaattaatagtttaatcttttcaaattcaaattatttttagcatgagtcaaacatccaaacctaggaatagttctaatagaaaaaatttattgtagtttagaaatattagctaaataactactccaaatattttaaaagctattatattttattatatttatattcatttaatacctttaaaacttaacaaatggattaatgtgagtatgtcaacactatcttgagtgtggaaaaactaaataccaaaaagactaagtgatgtcttagattacacatttagttggaactagagtcaaaattgaaaggtgttctaacactctagttaccacctctggttcctaggctctactgacaacaaataccacagaacaaacatgttttgctttgaaaaactaataattatttacaaataatgtaataagtagcattattaataacttcaagtaaagaaggattgagtattcatgaggttttctatcagttaccattattctctaacaaactatcccgaaacatcgtggcttaaaacaacagtttattatttcttaagattttgtgggttgactgggaagttcttttgctggtctcttctgggctacctcatatccctggattttttcaaaccaaagatttccctagttggaagatacaaaatagcctcactcatagatcggacaattggtctactacctgtcagctggagtaccttggtacacttccacatgatacatcaactgtattcctagcaaggtgatcctggagcagcattccaagaagggaaagagagaagccacaaagctttaaggcctgggaactgaaatttacacaattcatttctgctgcattcttttcgacaaagcaagtcacaagccagactacgttcagtgggttaggaaatggattcccctgcttgatgagcagcaaagcatttgtgaccatatttcgtctaagatgttagtaaatccagtatttgttttaagtgatcttcttaaatcattaaaattcttaattattcacatatttacattataccaggacaactcatatttcctgtaaatgtattttggatacatactctttgcaattcttaaatgattgtgttcctctatagtttggcatgttatataaaagttttagtattattatttctattacagcatataaaataaagcatttaaaatattaaaatattcattttaattattgtttaccataattattgtagaggtattcttctttagaatggcacttatttttatgctgccttagaccaaggttgtaaggtatatttaaatttatttctatttttaatctagaatgctactaatgaactcactaaacagtcatcaaatgtgaagactttgaaatttgaactcctagcaaaagaagaacacataaaggaaatgcatgaaaagtatggtttttgtatttctatccattgtatttggtgccacctagtggcaaccagctctattaaacgtgctccaagaaactgctaatgtttacgttttccttccctagttcatatttaaacctacctaagatgaaagtttaaggaatactatgtatagcatgattaatggcaagctatttacttttttaaattagataatgatgaagttaaatttccgttattaaacatatttaattttgaataaatacaaattaatggcttcgagacaatgaatgaaaaactttacaacgtggtggttatttggccccccaaatatatgattagtatttgtattggatttaatgcctaagcttataaagctaaggtaaaaaaaggaaagttttgtttgtgtttaaaataactggaggttatggaagtttgtactcttgtgtttatcagtacaaagattttaaatgctctatcccactgaatcaaaattattttctttctgtatctttcaaagctacactattgcttagaaatagtaagatgtttagatagaattccagttgtcactgatacatttgagatatatgtatctcacaaacacacctgtagacctcattataagtgaagagcacttaaaagtgatatgaatagataaaagcattagacaaaaagcttggttaattttttaactgataatattttgaagtttatttatcaattaagagtaagtcttgcttattgtttaacagggctctagattaacactctttgaatcctggcttccctacctactaggcctatgcctaaatttaataatattaaattaggttcttacgaggaataaatgagttaatacatgtaaagcacttataacagtgactggaacattgtaagccttcgatacatgttagctattgtcattcttgttttagtagtagcagcagcagcagcagcagtagcagtggttctcacagcatctaccattttatacttaatagttcatcaacttatgctaaacagctgtgtggattgaatctcaaattatattaaattagaagatattatggctaatttagtttcattacaagagtttgcatttgtttattgaagtataagatttttttcttatcatttttatgcttttgattatcttcatatatcactttgatttttcacagcaatgtaaaaatgtaatttaaatgaaatagttctaagttttcataagtgttattaatttttctcatttcttatatattttgttttaatacatatatgtaattatataattaccaagtcacaactatagattttacaagtgttcaaaatattaaaagaacaatatcttatgcagtgcaattcattttactgatttacagtgtcaatatcacgtagcatttaaaaagtaacagtaggtataatattggataaaatgtaagatatcaccactgttaaggtattttctgtcactcttgatgtcacctttttttttttcaaggatatctcgaatggagagggatataactatgaaaagacatttgatagaggacttgaaatttcgacagaaagtaaatttggaaagtaacaagagttttagtgaaatgttacaaaatcttgataaaaaggtatcaatttttatctttactgacactaaaaatatcacttcctgttgtaattactctcttaccacaaacatttaatcctaataaatgtatagaaaatattgataggatatgtatttactgttacaaagtaacactctttgctctgaaagtacattatttattttaaaattcaattctctaaaacctcatacataatatggccacacattctgtttctatttataaatatcccatgagaagattaaaaatcctcaatatttctaggatacataattacattttattcagtattttatttaaaactgtaatttatgatagaatcaagcttatatttcttagtgaaaacttgattacctataactatcagaagttctttaaaaatgtactttcttcttggatacccttaatgaattttacatgggaatggagttgtacatgcaaagggagttgtagttaaagtagttacgtaatatatgacccaaagtagaagggttttttttgtttttttttttttgaaggtgcttttttcacaactcataaagcaccctgtgctttggcattcactaaatgttatccacacctgagagaacatctcctttactttccttgttgaaaatgaaaatttaagtatctcttaggtcaaattgatttaagaaagaaacttttacatgagcatgacaaatccatatggattttctttctcttctcttccacacatctgtgcaagttaaaatcacttcctataggctttttcaatgttatcctttcaattttgctattttttaacttcaataataatttcatacatagccttggaatctttatataaataacatatatctttagtggcattaaactgaaaaactattttttctgttatgctttgagttacatacacatattataatcttataaataagctatatatatatataaaatatcctattgttttatttcatccaaaaaaaggtatgtaatagttattttagagaatacaatggaaagttacctttaacttggcttgtttcagagtcaaaacaatcatctcctgccttaggaagtttagattagtaattaatggatatgtagtgaacattaatattgtgttattgggtgcaagaataaacataccagtattcatttagtttgtgtgcaattttagtttttgttactgatttaaggattgttactttcattcataatatgagttctgtaagtataatacttgaatttgatagcgttatgagaaaataaatggaagtagactcattcactcatttagtttctgttggaacaaacacagtatattactagaatgccttcaacaataataattacctttatgcttttaatgtaggtaaagacattaactgaagaatgttccaacaagaaggtatcaattgattcactaaagcaaagacttaacgttgctgtaaaagaaaagtcacagtatgaacagatgtatcagaaatctaaagaggagttagaaaaaaaggtatgcttttaaaaagggcattttagattacagatggaatataatcgtgtttgtttcatttttaacattgttgctttttccttcccaaaaccacaagctacttaaacacttcagataagtgcaaagaggatttgtatctctacatgaaacgccaaacattggtttaacattaaagatatttctgtattagagaaaacaggttgtgtttgtcttgatagtttttaagaaatgaaaactattattgaacactggtatttatacaagtagatctaaattttgtaggcccacttaaactttcaaactaaatgtttccatgttatgtggaggatcttttggtctaaaatagcttccatgcttttaattatttgtaatctttaaaaatcataaactaatttagatgataagtatatgagaatatgtacttaggatgttttattgaaagttaatgaaaataatcattaattttacccaaataataaatacatagagagaataataaaatattttccttatttgacatgtataactaactcttccaaatctgtttataaaatatcttttattttatgactgctgatcttttgcaggatctcaagcttactctcctagtatcaagaataagtgagactgaatctgcaatggcagaaattgaaacagcagcatctaagcagcttcaagaattagcattgcaaagtgaacaggtcctagaaggtgcacagaagacattgctgttagccaatgaaaaagtagaagagttcaccacatttgtgaaggtttgaattacttgtcgtttactaacttgtactttactttaggcagataggcagtagcctacttgagatgatttggggaataaagtttctttctgctttcctaacacagaaagcatcttcttctaccctatttatcacattgctaataattcctccataaagaatttatttttatagtttgaatttaaaattttctaccatcttattaatatttctttcttaatgtcaatttagttatgaaattgtagtagtcaagtcatctggacaggttttaagttgaaagaattaagctgttcccaccctactctccttttgaaaatcgttcaagcaggaacaaccagaaacttgctcagtgttcagtgatgctaagagacatctgaatcccaggccacaaactatcaagacatggaatagacagaggaatggcacatgacaaacagaacaaagagaagacaaactcaagtatctgcagaggtgtaccatctagaaattatctaaaagctgaagagccctagaaagccttcattcccctagacatagaagttaataacattttatgccactattgagtactccacgaagaggaaattccttactttgcttctttggaaatcatagataccttgggagttttctcattttaaaaatatctgcaaaatgaattgataaaacattttatctcctttatctcttttaatgaatatttcaactggtgtgaagtcaagccaataatgcctgcctctgaggatcctaaatgattgcaaagtattaattttagtaaatgtaatttaccttttccagattcaaaacactattttttgtaaatgcttgttgaatagtttcactgtttaacttatagtgaacactttcattaaatattgtgacttataccctgctggtgggaatgtaaattagttcagccactgtggaaagcagtttggaaattctcaaaaagtgaaaaacagaactaccatttgacccagcaatcccattattgggtacataaccaaaataatataaatccttctaccataaagacacatgcatgcgtatgttcattgcggcactgttaacaatagcaaagatatggaagcaacctaaatgcccataaacaatagactggattaagaaattgtagtacatacacaccataggatactacacagccatagaaaagaatgagatcaagtcctttgcagcaacttgaatggagctggaggccattatcctaagtgaactaacacacaaaggaaaaaccaacaccacatgttctcacttataagtggaacctaaacattgagtacacatggacacaaagaaggcaacaatagacatcggggcctacttgagggtgagggtgggaggaggatgagaactgaaaaactacctattgggtactatgtttattacctgggtgatgaaatagtatgtacatgaaacccctgcaacacaaaatttatctacagaaccaacctgcacatgtatccctgaaactaaaattaaagttatatatatatatagtcattattttactcatgatgtagaaccatttttattatgagtattaccttcataaatcttggtttttgttttatattcaacttagcattttgtttgtggagcttttggctaagatataaaatatgaaatatataattatgagatttattcaaaatgctaatcattgtttttccttgaaacattctttgaatgtggcactttaaaaaagaaggatgaatgagaatcagaagttttcaaaatagaaaaattaatttcatgactgtatatctgattatcatatacttgaagtttcatgacttccatgataaggtaatgggtatatttctccatacaaagtagttcagcaaaaattatctttaagaaactttttctttatatccaatgatataaatagtatttaatgatgaagtgggtatctaaactctaattattcaagggtaatgttagtccttcatattgttcagcaacagtgatattgagtagatgtcttaatagatgaattcaggattgctgtgttttcacgactttttaatttgaataatgtttcaaagattatataatagggaaagatgataaatatggacaggctgtcttcggtactctttcagaatttttacactttgtttcaggtttaaattaccttcatcagaatcctgtttctactgcatttaaatataatacacaatattgggccccaaatctattgaatcaaaatcctgtctggagtggagcctaatctgcattttacaagttaacgaagtgattattatacataataaagttttagaagcacttccttacattgtttttaagaattgaattcaaataacaatacatatcagtttgacatttagtaagaccatttataactcatgacttccaatggcaatttgacatttgtttttcttaaccgtgtcttagtgccaacatatagttgctattggtaccatgtctgctgtataacctatttttcaaatatagggccaccagcaaattaatagccaaaaccatatattgatggcagagactggatatttgggtcttaagaaaggcatgattatcatctttcttgtccttgcacatatggccctaggtctaggcagaaatgcttaggacccaccatctgaagcagcatatcatcaatgactccttaactactaccacattaggtgcgttagatcaatgcttcctcctttttaaatacttaagaccttccatagctgggtgttattctgctgaagtctaatcttctttcccactactctttcacccatattgtgcttactcctgcctttgctcaagttttcttttcacccaaaatgccttcccctctttgttctctccttcagatttaactctgggcctttctctgtcatgaatctgtcctttaactctgtagttaagaggatagagctcaactctgccatttactggctctctgacttcaggatcgtgactgattccttgtgcctcagtttccttatctgtagaatgagtttaataatggaacataagcgaagtgagaatttaagtaagttacaatagctaaagatcagaacagtggctaattgctatctcaatatcaactattattatcagtagtagtaatagcagtagtagtatggctctgactcgtctcctgaacatttattatatgtacattaacacagttgtaaacttgtatttttctttctgtttcaagtagattaaagccaacttgaggaaaggaacgttgtcatttgttgtcttcagggtattgttacataacagggctcagtaaattcttgaggaattgatttacgtctgcttcaagaatagtactggacttatagtcactgctcaaatggaaaactctgtgaacagtgagaactatgtgcattccttaatgagcgtagttaaggaatgcacatggtacctacatggaacattatgatcaccaggactcattctatgcagagcttattagggtatcatgtacacaaaagtacttaataaatattattagtagtattaatagtaataatgtttgttctggccctgttgtggaatctatgttccctttagtcttttcatttattcatagggcgcaaccagattatggtagaggtggagtggccatctgttctagatctagtcttgaatatggaatttggccctggggtgaaatcaagtactttgagcatctgggctggatatatgtggcagagctgaggctttgaattctcctaataactgaataaaacacacaagggaaatttctagaagtatttgctcagtttgactcagccctgatacaggcttgttaatgtgcctgtatgtgagagtcatttgccaagctccatcttttcagtggattttgttagctatgaaataaataccagccaaaaaaacagtatttagctggaagcataaatggtttcattatcaatatgtacttgctttggtaagatttagtaagatgcttttggtatataaatttcttgcttctttagtgaatacatttgtggagcattagaattttaattttacacatacaattgttaataccttggcactgttaattaagatttataaacaggtctatgatacaattcaagttgaattaactcttttcaccctgtcattatactgaaaaaggaaatgacagctgtgtttagagaaaagtttcataataaaaatacatttccttatttggaaaactttatgtaaattatatctcaataaagctgtttaaaaacctgttttttaaaaattcattttttatcccaaaaaccatgatgggaagagtgactccagagtctttcagccacgaatttttgccttcctcacaatgtaatcttactgaaaaaagtccaagcaatccataatgattcgatgaaactaaaaatgacatgtatcgcagacaaagactcaaagagtggaaaactaaatctaataaggcagaagtgggatcgtgtactatattttccacaaacattattggtggctggttacaataaattatagtaattgaaaagtaaagtaaattgatatgtatgtctaaaaaccattcatattttgacaatatcctcagatattgggataattcctagctcatgatatcccaagaattgcaagaaggctgacatcagtttttggaaattcagttaacatttattgaatgcttactttgtgccatacagtgtttttacttaacttgataataagtgttagctatggatcattattccactgatatgtgtagagtgacactttttaaaacttacagtgtttttagcaaatgataatttacagggtttttcaaaaccctttgaggtggctttagagttgctcagagagcaactgagcagattttgaactggtaatagaaggcaattttgtaacagataagagagaagtaaagataaaggccagatggaagtagcacccagtgttgaaaacaggctgatttgtttattttaaaaaagaggaaagtaatgctgagacccaacatgtaaatacaaggcaagtgtgaccttataaaaatgaaaagttagctttgatatatgggtggaaggtaaaacatttcagtgaacctagcacagtgaaggctctactatatctgaaagatacactttggatgggaaaatgatcattcatgcattatgaagtatatttcaaccaaacaacatagtattttctaataatcaatgcattggaattgaaggcatatggaatatatcatgtagtaacaacactactcattatgtaggccacctagtattgcttatacttcatttaggtacctctttaatgatacttacatggtacatgagggttgatcttggaattcctgtattattcatacctacttagaaattctgttgggatgagtaagatgtaggaatgaatattcaaatagatctcagaagccaattggaacatattagagtcacgcaccccaattatttgtatctcattttagaatgctagtcatacagcttagcacccggattatctttctctccaacacaattctgttatgacttatggtgacttcatatccatgtaagccatccaatcccctattggatattccctttctattcttcagcatcctcacttccaatgattattcccatcatcatacccctgatgtatggttctcaactttggatcaccacctaccttagggagcatttggaaatgtatgtgggtgctttgtgttacactgactggtagatgctactagcattcaatacccaggagccagggtggttaaaagttctgcattgggaagaaaaatctcatacagtgaaaaattgtcatttttctcaaatgccaaaaatgttcccactaagaaacactacccttggccttgtcattacgcataactgaattccaaaatctccatttccagcattttattctttgaccactatttctttttgtgctcatagtgcaacaatttttgacctgatcgtaactcaaattcactggccttaccactttttcactaattactaccaccctccttcccactgtgcccttacttccctcctcatgcagcatggattctgtgttgtatcatcgtcactttcttgcatatatcctcaacttcctcatatgtccctttgtcatattcatgtggaaaaaactcaaacctactttattttgaatctctgcctacttcccacctgaacccaaggaagtgaatgtgattaaataaaaacataaccatgctgattcatctttatttaaacagataaccaagaacttcaggtgggctctcagcactatgtgataatcctaattatatagttcccagtgcattcaggctccacatttcccagtcattctgctatcttctcaaacctccagcatcctctgcttagccactcaatctcagctgcgtctttcactgagaaaacagaagcaacccagagataatttcctcctttttttcattacctttatttttcacattcctcccaaatctgtacccacatactgtcccttccctcctattgggaatgaaccatctgcatgcccgtctagagctaatacctcactttgcacactggattttatctcctcatattcgcaaggactttggccctgtagtttcaaccctacactttgtatcaccaatattccctctatattggatcactttcattagcaaacacacaccatttaccaaaaaaaaaaaaaacaaaacaaaaaacaacccttcatttgactctgtatctcctctaactgctgactcatttttctcctcttttatgtagcaaaacacctcaaaagtgatacctattctctacccactttcttatcttccattctgttttgaaccttctccaattaggctttcaatcttattaccccgccaaagtagtttattcaaagtcaccagtaacctccatattgcccaatctgtgatcagttctcagttcttagttcttatcttatttgaacccttgggagcatttgatatcgttgatcactccttcctccttgaagcacttttttaaagccttccttatgatgtactacactgtattggttttcctcatcacatctagccggtcttctctgacttctttgctagttctcattctcttcctgacagacataagtgttggagtttcctagggttcagtctttatacctttcctcttcattatctatactcgctctctagacaatctgtaccaacactgtaatttaagatgccatattctgacctatgactccctaatatatatctgttctcatcctgtctttgaaactatggatttttaaatcttcctgcctagttgtgattttcacttggatgtctaataggcatctcaaacttaacatgtacaaaaaagttgaaaaaaaattattttgcttctcctagctttttttctctatcccagaacaatattttcactagtcatccagatggttaggctccaaatctgtaatcatcttcggctcttccctttctctcatgttgcatttctgatacttcaaatcgtgtctgctcctgtttgaaaatagacccaggagtctgctacctgtcaccactgctgtggttactatcacttcttgcttgtacctatgcattagtctgccctttcagctcttgatccagaacagtcttttctccatctgttggcagaatgatccttttaaaatggaaaacatgggcaggcatagtggctcacgcctgtaatcccagcactttgggaggccgaggtgggtggatcacttgaagccaggagttcaagaccagcctggccaacatggtgaaaccccgtctctactaaaaatacaaaattagccaggcatggtggcaagcgcctgtaatccctgctactttggaggctgaggcaggagaattgcttgaacctgggaggcggaggtcgcagtgagccaagatcgcgccactgcactctagcctgggtgacagagtgagactccacctcaaaaaaaaaaaaaagggaaaatatccaattactcccttactctagtctcctggcatgactccttattactcaagaaaatggaaaaccttgactgcccatgaaggactccatgattaattttattgttacttctgcaacttcactttctactacattttacctcactattccactttagcctttctttctgactgactttcttgctcttttttgaacactgcaggccctcttctctctcaaggtctttgtcctcctcttccttatattcaggtagtttatcttgtcactacttgaggtctctttgccctgtcaaatttcaaacatatgaaacaatggaaaacaaagaagctagtaaaacctgtaagctggttaaatctaaatcattattgaccttaacgattgcagtattagaaatgggggtaatgggttggttggaagagttgagtttcctttttgctttggtggaacaatatggggtatgagaaactctagatattgattcaaaatataatattaaatatatatttgaaatatttaaagatggccataagaataaaaatatttaatttgtaaagaatatgatggaaaaaagaaataaagaaagctccatcaatctaacacaagccgggaaataaaaaagaggggagagagggaatgaacagggaaagaaggaagggagggagggagggaacaataagaaaaatagtaaataaagaagataggggccgggcacagtggctcacgtctgtaatcctagcacttcgggaggccgaggtgggtggatcacgaggtcaggagatcaagaccatcctggctaacatggtgaaactccgtctctactataactacaaaaaaattagctgggcatggtggtgggcacctgtagtcccagctacttgggaggctgaggcaagagaatggcgtgaacccgggaggtggagcttgcagtgagccaagatcgcgccactgcactccagcctgggtgacagagcaagactctctctcaaaaaaaaaaaaaaaaaagaagataggatgtagctgttccttaaatacagacatacctcattttattgtgtttgctttattgcttttctcagatgctgtgttttttacaaattgaagatttgtggcagctttacctcaagcaaatctgccagctctatttttttttccaacagtgtgtgctcactttgtgtctctgtgtcacattttggtaactattgcagtatttcaaacttgttcattattattctatctgttatggtgttctgtgatcattaatctttgatgttattattttaattgttttgaggtgccatgagctgaacccatattaattaggcagtgaaattgatagataaatattatgtgtgttctgactgttccgcccaactgtcttttcccccatctcactccctctccctgagcctcctacttcctgagactcaacaatattgcagttaggccaactaataattctgtagtgacctctaagtgttcaaatgaagggaagaatcacatatctttcacttttaatcaaaagctagaaatcagaagctagaaaaacttagtgaggaaggcatgtcaaaagctgagataggctgaaactaggccttttgcaccaaacagccaagtcatgaatgcaaaggaaaagctactgaaggaagtaaaaaaatgctacttcatgaatacacaaatgataagaaagtgaaacagccttattgctgatacacagaaagttttagtggtctggataaaagattaaaccagtcacaacagtttcttaagccaaagcttaatccagagcagggccctgtcttcagttcttcaaaggatgagggaggtgaggaagcagcagaaaactttgaagctacctgaggtttaaggaaggaagccacctacataacctaagaatacaaggtaaagcagcaagtgctgatgtagaagctgcagcaagttatccaaaagatctaggtaagataactgatgaaaatgactacatattttctatgtagacaaaacagccttctattggaagaagatggcatctaagagaaagctacaaaggagaagtcaatgcctggcttcaaagcttcaaagaacgggctgagtctcttgttaggggctaatgcagctggggactttaagttgaagccgatgctcatttcacattccaaaaatcctaggacccttaagaattatgctaaatctactgtgcctatgctccataaatggaacaacaaagcctaaatgacaacacatgtatttacagcatggtttactgaatattttaggcccaatattgagacctattgcttagaaaaaaagattcctttcaaaatattgctgctcattgacaatgcacctagtcacccaagagctttgatggagatgtacattgagattaatgctgttttcatgcctgctaatatagtatccattcttcagctcatgtttcaaggagtaatttcaactttaaagttgaagactttaaagtcttattatttaagaaatacatttcacaaggcatagcttctgtagatagtgattcctctgatggagctggccaaagtaaatgggaaaccttctggaaaggattcaccattctagatgccatttaagaatattaatgattcatgggaggaggtcaaaatagcagcgttagcaggagtttggagaagtttgttccaactttcatggataactttgaggagttcaagacattagtggaggaagaaactgcagatgtggtagaaatagccagtgaactaaaattagaaatggagcccaatatgtgactgaattgctgcaatctcaaaataaaatctgaatggatgaggagttgcctcttagggacgagtagagaaagcggtttcctgagacgaaatctcctcctggtgaaaacgctgtgaacattgtagaaatgacaacaaaagttttagaatattccataaacttagttgataaagcagtggcagggtttgagaggattgactccagttttgaaagaagttgtgctgtggtaaaatgctactgaacagcatcacatgctatagagaaatctttcatgaaaggaagaatcaattaatatggcaagtttcactgttgtcttaaagaaattgccacagccagcccagctgtcagcaaccatcaccctaatttgtcagcagttatcaaccttgaggcaagactctccactagcaaagtttttacaatgtgctgaaggctcagatgatcattagcatttttaataataaagtatttttaattaagatatgtacatttcttagacataatgctattgaatgcttataaacataacttttacattcactgggaaaccaaaaacattgtatgactcactttattgtgatatttgctttattgtggtggtctgaaatggaacccatgatatgtctcaagtatgcctgtattttggctattaacctctatcagatatgtgatttgaaaatatttgtcttccattgtgtaggttgcctgttcactgttgtttgctgtgcagaagccttttagtttgatgtagtcctacttatttatttttgattacgttgtctttgcttttgatgtcatttctaaaaaaatcattgtccagaccagtgtcatagagattttttaaaatgttttcttgtaggagttttttctttttttttttaagagatggcgtctcactctgtttcccacgctggactcccgactcctggactcaagcgtcttctagaaattttatgctttcaggtctgatacttaagtcttttatccatcttgagctgatttttgtctgtggtgtaagagaggagtctaatttcaatttttttgcctttggatatccagttatccagcatcatttactggagagactgtcctttcaccgttatatatcaccctgtcgactatatttatggatttattactgggttctctattctgttccattggtctatgtctgtctttttgccagtatcatactcttttaattattgtaggcttgttgtatgttaaaaaataggttaaggactttaatacagacttctccaaaacacacaaatgaccaacagaaacaaactcaatgtcacttatcagggaaatgcgaatcaatgccacagtgagataacacatcacacttgtcaggatggcagctatttaaaaaaagataataagtgtgagtgaggatgtggtgtaattggaccctttgtacactgttggtgggaatgcaaagtggtgcagctgctatggaaaacagtgtggagattcctcaaaatgttaaaaagagaaccaccattggacttagtaatcccacttctgggtatttatccaaaagaagtgaaatcatgatcttgaatggatgttaggactcctgtgttcattgcaggactagtcacaacagccaagatgtagaaacaatctaaatgtccatcaagagatgaatgaataaagaaaatgttgtataaacaacaattgattacccttaaacaaagaaggaaattctgcagtatgcaacaacatggataaactccgacggcattatgctcagtgaaaaaaagccagttacagaaagacaagtgctgcacggttccacttctatgagtgtttatgatagtcaaatttatagaatcaaagagtggaatggtgtttggaagggattggggagactgagaaatggggaatttttaattaataggcgtaaagtttcaagcaagatgaataagctctagagatttgtgtacaacattgtacatatagtcaacaatgatgtacacttaaaattttgttaagagagtaggtctcatgctaagtattcttaccacaataaaattagaagaaaagaaaaattcatgaaggaaatagttgactctagagagagaaaaagaagatagaataacatgactggtataaatccaaatataccaataactataatataaataatagagctgaaatgtatcttttgaacaaagaggaaagaagacagactatgatagaaaaaaagatgcacttaaaatatagttatccaaaagctttaaaagatttaaaaaatatggtatcctgggactagcttgtaccacaagagccagttttgggtgtctctttccaaccccttattcatgttggttgcttgaaatcaatcatggtgcatatatttatttcacagaaattgaccggtcatggtgggctcatgcttgtaatcccaacacttttcaaggccaagacaggatgatcacttgagcctaggagttcaaggctatagtgagctatgattacaccactgcatttcagcccgggtgacagagcaagaccccatctctaaaaaacaaaaaaacatatccgtaccaaaaaatcaacaaacattacaagtcatgctcttcccccaacatccaaagaactgatttaccagcacacaactaaatatacatcagataaatgctaagaaaaagaagatatagcaatattattccaagacaaaattaatggcaaaaaaaaaaaaacacattaggaatgacaagaatggatagtttgtgaagaaaatgtagaaattatgaaatgtttatgtatctgaaaacatgttaagcaaaatttgatggaaattgatgaatccttaggtgtatttactgtcctgcagtatatttagtatgtactatactcagaaatcaataattcaagtagagaaaacataaggctactttgttttcaaagccatgtggaacattcacagaaactactgacatcttaagccacaaaatttaacaaattcaaaaacagaaaaattgttttagctatctgcctcgaatatggtgtaatataactgtgatttaacaaaataagtggccaaaatttatctatccacttaaaaattgtaaacccttctatctgatttagggttaaggaagaaataaaaagtaagttcatgaactgtttcaaattaaaaagcagtaagaatattaaaacctttgtaattcagccaaaatgtaactttgaattttagatattagaaaaataatacaaatgaagtgtaatcaaggagaagtacataggaatcttaagctatgtgtgtaatacacaaaaacaaatttgtcaagtccttgcctagacagggagccaagctgacaatcttgccagagcacagcctctggccctgcccaccttgagacctggaacagcaaccttgccagccccagatcccagcttacgtacccacccaggcagggagccgcaccacagtccctacccaactgtggggcacagtctggaccccgccgaccaaggagcctagttagcaaccccacctggctatagagctcagcccacagccctgcccatttgctaagcacagcctatggccatgcctgggcagagagccaacccattgaccctgccagaccccagaatacagtcagttacctcaattgatcatggagtgcagcctttagccccaacaactatggggcacagctgacagccccatccaaccagggagctcaagcgcagagcacatcaacagcctcacctggtcaaggaacccagcctgtagccccacttaatcatggaacccagcttgcagccagcctgacctgggagtcctgtaacaacactgaccaaccacacagcaaagccagtagtcctgtccagagagagaaccaagccaatgaccccacccaactgcagcgtacatcttgcagccctgcttcatcatgcagcccaatgtgcagccctgcctgagcaaggagtccaaccagcagcaatatttgaccagagagcctatcctggatgccccccaactgtggatgattatgaagcctacctgcagcccaactgcaaagcctaacacatggcagcacatggccaatgagcatagcctgtgatcctgcccaacaggaagcaattctagagcctagccagcagccctgtctgactgcagagcccaaccagtggccccacctgaccttagcagtatgggcagcagccctgcccagctagagaacctgacagcaagtactgcctgcctacccatggatgttgtctgctggcctgttcagatccaaaggttggactgactggtgaaggactattcctgctgaagaaaacctgtaaaggctggaagaagtggctgcttccttaaatgtacagacaccagtgcaaagatacagggatatgaagaatcatggaaaaatgacataatcaaaggaaaataataaagcgcaaataattaaccctaagtaaatgaatatatagaaactgacaacaaattcagattagccctcttaaagttcagtcaactatgagaaaacatgatggacaactaaaccaaattaggaagacaacacatgatcaaactgagaggtattatatataagaaaggaaaagtaaattagaggtataaagatttaaaaaaggagataaagttatcagtctttgcagttagttatttgaattcctagaaaaagtaatcaactgaaaaactcctataaaaataagaaaatatatgtaaaataaaataaaatgcccagaaataaactagatctataaagagaaaactttaaaacaatcctttgaaacacagataaagacctaaacaaatggaaaggaataccatgttctttgattaggaagactcagcattccaaaatgtcaacgtgctccaaataaaatgtaacatgattgaaataaaattaccacagtaagatatttttaaggggcagagaatctacacaagctgaatgtgaaattcatatggaaaaccaaacaagcaagaacagcaagaaaaatctgataaagaagggtagtgagagagattgctttacccaatgttaaaatgtgttgtaaagcctcattagttaaaatatactcaaatataaaacttaactaataaaaagagatggaacagaatagaaagttcagacactgacaaacatttatgaaaccacttggagaaagatggactgctaagtggtgatgggacaagtgagtatgattttatttaataatcttctaaatgattacaaatggataaaaaaattttaactgaaaaataaaaaagtagcaaaaaaattgtggtttgaaagtatttttatatacctcattgtggagaatgctttttaaagtatcccgctaaattcaaaagcgagaaaggaaaagattcattaatttgaatacatacaaaattaaaaatatttttctgtgacatcaaacagtactgtcaaaagaaaaagaacaaataatgaaataattgaaatatatacaataggcaaatataatttcccgaatacgtgaagaactcctataaatccctaagaaaaaacaaaaaatgacaaagaaaatataattatttcttaaggctgatgctcaactttgtttataatgagagaaatgaaactttaaaatacagcaaaaacacaagctactctgaaatagcatattggtattttgctagttgtgtggagaaacagatactttttatacattctttgtggagatatatattagtgctatcttggatggagaacagggatagaattaagtaacagctgtcaaaattatagttatacacaccctttgatccagcagtttcaattctagccatatatcctggagatgcaaaagtaatatctgagcaccattatttattctaacattgcttgtgctaacaaaagattggaaacagcccaaacatctaactaacctgctctcagctcacaaagccatgtattgaagcactctgtccaaccaaattaaggagtaactttttgttacccacacgtaggtgtggtatgggctagcttttactgatttctcaaagaggcaacttaaaggcttgtgaagtagttcttgattttttaatgatttttcttcaatccttcattgttgtcttgcccactcataatttaccacatgtaattgaactttgacccaatttgtccttctcaacttcttccaaagcatttgtaatctactattgataaaatagaaacagttctttctgcagtaatctttcattggtttatgtaaccattaaatgaattatgcagctaacctgttacaaataatatatgcacattgtggaataatgagaacctgactcttagtgttaggtcaactagtagaagttgttgtgctgattaaaaatagcctgcctgctgtaagcattcaccaagcaagataccagttggtgtatctgaaagagggatgggggagctttgcttaatccagcaagttggttaagtattcattgaagagaacttttattgcgtgctgacaataggtaaagagcaatccactatattccagagtaattaaaaccagagtaatcctagtaaaaaaatgatttgttagtatcttcatatttttatgttattactgctttgtcttcattatgactttaatataagctcaatttctttccaatatgttacaggctttggccaaagagttgcaaaatgatgtccatgtggtaaggcgacaaataagagagcttaaaaaaatgaagaaaaacagggacgcctgtaaaacctcaacccataaagcccagaccttggcagcttctatcctgaacatttcacggtcagatttagaggaaatattagacacagaagatcaagtggtaagatcatttaaatatttattattaaagggtttattatacactggacttaagtagatatttttatttgttttatacctcttagaatttcatctttaagagagtgttaatgatggtaagatggttaaagtgccaatgaaagatacacatcaagtattaactaactcaaaaagcctttaaagaaatttaactttataatatagaaataagctagtacttataacctttcaaattacttgttattcatttattctttcctatctcctccattttctttaatttaatcatattatatatcatgtaaaccagtatacttaattaagctagcttaaatggatttagttaagctgatctccattgatttgaagtttttttctctttgtgatattttttaaaaagtgccaaatctattggctttcatagctaaattcaaaattattattcaccagtatacgctttgaaaatatattgttgaaaaatatttattgcttaaaattggttaaaatacttctgtctgagtgaatttatatgcatacaggcatagtctttaatagcatttcagcacctcttgggaaagacactgcattttttacatagccactgcctcataacagcagaatctcataccacgcagtcttttgcgaaacatgtgtaggatgctcattcctatcctactatggctctgagctttaattcatgaatattagatttttatcctttggaatgctaaaagatggtggcactagcagcttctcaacaaatatttgttcaatgatagacttgggtgtctgtatgagatcatcctctggccccctcttcagcttctgaaagatcttctggaatagagcaaatctacaatatgtaaagatttttgaactaccaagaatcctcagataatagttaaaaggaatcctacaggtattattttcatccagtgggtgaattcccagtttctgttttcagcagctatgccaaaacgtctgcgactttctatcaaattctaaactttgaagtataagaacaatatcacatatagtaccaaatgtaagacacatgggagtaatattacttctggcaagggtgttaactaagccttattataggcatttaattaaaatatgtcgattgatgagaaacctaaccaaaatttaagggtaaggcctctactgttgcctagaaattttaaaacacacagatttagcacagtgtctcatgtgagtatgcctgtgtgcatgtatgtgtttacatgtacatgatgctaacacatgtacatattctggaacacagagccaccatgttttttgagaccaagtaatctctaaaatgatgcactctctgggctaacaaattagcaaaaaaagccctctttgaatgagcaaatcagaaaggttgtcctctttgaatatgtgaattagaaaaggatctctcttgatagccccaaagactagatggtgcatgtctgtgaataagtgacacctctgcctctgggcaggtggaatctgaagacaagagtacacagcactgtaatatgcatgtcacacaatcttaaatcaagtccctcctgaaagaataagagatataaacacactgttctaagagggataggtacattttgatatatttactagatttcattatagaccagagcttatttagactgatcctgtcatcttccagaggtccaaggatttgcccaagcagagcccagatcacctgatttatgttctttacactatatcgaactgtagtaaattcacatcagaaactgtgatagcctatctgaagtgcctagcatgatgcctgccatacagtaaatttcaacaaataatagtttctcacgcccttcccttcttggaaagtcagttttttttttcgtaaactgaaattacaatttcaagtgaatcatcaactgtacgtgtgaatacatttcaattccagaaatattctgtcatgataattgatgggttgaaaatactttgtgacctatagcactttaagttggagtgtccctggcctatcagtagattattggatagtttgaatcaacaagcatttaaatataccggagtcatgccatgttctattctgtttgtaatgaacaattactccttagttatctgctgacaagtcagattttggaatattaggttttgtattatctcatgagagtcacctgtaaatgattcttttatataactccatctgatttttcactttaattgctttcacccccatattagcccctactttgagctccactgtgaaggtagaaattaaatatttctgaattactgtgaagtatataaatatagctatatcttccgtagtacgtatcgataaattaaattttaaagagcatggacttaaatatttctactttgagatgacagactgttctttgttgaatctaattctactgatattactccagatttattcagtatctaatagtataaacaagttcatataaatttcgttaacaccagtgtttttattttttttcttcaggaaattgaaaaaacaaaaattgatgctgaaaatgacaaggaatggatgttgtacattcagaaacttcttgaaggacaggtatttcatttttctgtttcatatattaagcttccaaataagaattccaagccttacattttcaccagatgtctaactttttgtaaacacttccccattgtttacttctgttaggtaaagaagtattccaataggtagaaaggaaagttaaccctctatttgtactttgggacttaacaaatgaaacaaataccttgggatagagccaacatgggtcttagcaaatgcattaattaaattattgagtcaacctctgtgcttgctagactgaaaaggatccattctcccagacctcttaggaaaagagattctttattatgtgtctttaaagttagtatttgatatggacacctgaggagttcatgggtttcagtgaccttttactatggacctgtttccagtcaattcatgttttcctcacagccagacagctgtttattactgtgtcttcccgcattctctacaatattttctactgagacctcgagcagcttgttagtgggaagtaaatattgatttggcatcctgtcaatgcagaaagaatgaaaaaatttccaccagaggcccctcaaacattttcctatcgacattttctgggccgagtggaaagctgcatagaggatgacaaggccaagacgagttgaaatccctgaggggtctgttgagactgctgctgtgacctgtgtgatactttttcttccctttcaagtatttttttaatacacatatagtctgctgggatgcgcccctcttgtaagtgatcaagggcagtttattggcaggtgagagccctgcttttctagtcatagccagcttttgttttgacatcactgacagcatgtaatgtattctaaaactttttcattatagttctttcggcttaacctaattttttattttttaaatggactggaataaataaaagccaaaacatatttgtcaaaataccccaaaaattgtcctgtgatttttggaaagtcattgtaaatgtttctgtgtaaagattaaaaatagaaactgatattaaatgcaattattttacatttatattaacaagtatcagtttccgtgcttttagtaaagtcgagaataaataaatagtatatcaacaattcatgttagtatcagtttgatatatttttgaaacattgtctggaatcactttaataacaataggtgattaaaaatcatttgctgaaagttgtttaagtgtagatgtgcaggtgctagacaaagccttttacactgactacttgcttttgagaacagaggccatttcttaatcatgtggtactcccagaacctagctcagtggctgacacatcaaagaattcaataatgattgtaatgaggtttttcttttcaacttgaaaatgataaaaataaactttttaatgaatttttaaaatgttcactttgtaaatatggcctgtatttatttgaattagaaattttatcataattatgactataaaaataataaatctgtacgtgtaaagctttgttaaattttactaaaactgtactgacactggacctgagtttttttggttaacacgtggagaggtatatacatacattctgcattagctgaatgtatgcttattctgtccagtgagtataaaaaaattctgttgaaaatggcatcagactgcttaatactgcagcttgatatagtgcctttttgtgccactgagcctggactctggaatataattgccaggcagtattgatttaattgcccaggtttatttgtggactcctaattattgactggaggtaaatttaatggagcagcctttatgaacactgggaaaccgctgctgttgctgttatacgtaatgaactgcatcatgtgcctttagatcatttttcaagctaattttattccactgtgacagtatgataacatttaaaaagtcaaagactttttatttttattactgacataggtggttttgctgatgtctttgaattttgtgagagaacaaataggtacttcattggttgcacttgaatgtcactttataattacacccaagagaaaaatctataaaatagaaaacaccttttttttttagcctacttttcttctctctcaatccaagcaattatatttgtcctgaattttagaaaaggttttctttgcccaccagcctttttttagagtctgagttacactcacaggattgtatgggcaaaagtgtaaatatgttcattcatacattttgtttagtttatggcttattgctcattgggtatgagcttacatcatcttcacattgtggaataactgaagacattttctaaaaattactaattagtccaatgttgatttttttattcaaatattttgataaaattattggaaaacctctcttttatgtcctctctgtgtgttgggtgctgtatgtgatcaaatcctgagattatcagggtgaatctggccctgtgattttgtcttttgtttgattgggccacagaattgctttctgttaaaaaaaatatttttttttctgcttttgtttgatagaatgtcatattgataaaatattcaccacaaaataaaaagctgttcttccatgtggtaatgtggaactaataataatatgatacctactgctgttgttagctacaagtgcatgagaactaaaaggtctaaaattttaacttatgtatatttgatacagaactcagatatatgccattatttcaagtagttgtgatgctattggtaattttttatatttgacatttatctgcagcttgtctttgtccccagagatttctagtaataagaaccacactgaaaaaatcttactaagtctactttcatctttctatggcatagctgcctttaatttctttgaacatttttaatctgtataaatctctcttttcacattgatatattttttaaaacttgtaatttatggcagagacaaagaagcaaattgataattaaagcaggatgggagaaaccaccaaaattactttgtctatagtttagggagtgggagaaaagatagaaataggaaaagtaggctgggaccaaattataaaagcttttgagcagggtcgggatgtaatcagagttgtgctttagaaagatgctgaaggccaacattgtaggatggttggagagaggagactgggagcaaaaaggttctaggtaaggggcagtgagagtctggatgtggcctggccatggtattagaaaggctggagacagattgtgatctacattctaatgagtgaatagatagcagtaatgagattagatgaaaggggtctgggtggaaaccaaaagatgggtgagtttaatatactacatgaggagagaaagataatgatatctttggaggtttagggaacaaaagaggtaaggcagttttagttaaacaaaagaagtaaagccaggcataaaatgttacatactttatgattccattcatacaaaatataaaaataggcaaatttatagacagtatgtttgtggttgccagaggctggggggatatagagagtgactgcttacggatagaatttctctgaggatgatgaaaatgctctggaattactagtgatggctgcacaattttgcgaatgtactaaaaaccaatgatttatatactttaaaatggtgagttttgctatgtgaattttatctccacttaaaacagttaactccttgataatggaaaatattacaaaaagaaaaaaaagaatacatttaaaagtaaatttaataaattgcttatttcacgtgtgttgtgccccccaccaatagcagagatttctttaaatgcaattgaacttgaattctgtctagtggctgtaaatatgagtaaatgatataaatatttttatttcaaactcaatagtttcttttcagttggcacataaggagatgtactacctttatattctaattggtcttacctgttcacatatccaaacaaggagtcagttttttaaactttgcccactaaaagacagtgtttatctgttctgcccattctgatcccccaaattaaaattataataaaggtcatttttaggcctttatgatacccaaaacagtcctttgcacttgtgactttataaaggcaatgaaaataattagtggaaattaagctgagcctgtgctcgggaatcattaaaaaatatatatatgagtaccttctacatgccaggtattatttcaggtttggagaatatggcagtgaataaaagagataaaaattcactactgtaatagaatttacacttctggggacggaggacaataaatagttaaaatgtataaactatgaaatttactaggtagttaacttgagtagaattatgggtgggtagatacattaaaatatgtatatatgtataaaacaaatattacatagttataaccagagtgtgggtctttactaagatttctataaatacccttagacaggaatggctagaaaatgtgttcttgatttatggtgtgttgctttattctttgttatttgctaatccttttttaggtttcattttgtccattttagtccactttgtatagatcattttcttctattggaactatataaaaaattctgtctgtttgccttcagtttttgagaatttaaagtaaagactttgatcagtggcttttctttacctttaaatatctctgttcctattagttgcttcagatcttgcaaatgctgaaatttaaaatggctaactttccccagtgtcctctctgcaaaatatgcttaccttctgtagaatgccttgcagtgtggcagtgggaagggttttataaatctccctggcttttgtaaatagaatatactactagcctgaaggttaactgaaagtttctccttgcatctctgaagccatttactctgtggttatttcctgtgttgcacttataacaaatgcattcagaaactgacatactcactcactcactctgtctcatccatgtaagcctacacactcagtaacccatacagaattaatcctcacatttagatgaagtagcaagagtttaaaattctctactcacagccttgctgttttttttcaatttaacaaagtaagcctactttcgtatcactagaatgtgattacagttaaaaggatccttttaataaaataattaaatttatttgaatctacaatatcagttttttcttgtaattcctttttctttctttctttctttcttattttattgttttcttcgtgtagttttacctcctctaatatatattcttgtgctataagaaaacaaagaagtttgtaaccagtattctaaaattaagtctcaaccaaatataaagagatttctgcctggaagttctttattaacagctaattcaattgctgtatctatttgaagttagcagtactatttattcaacaaacttttatcgagtgctgatagtatgtaaaagtgctagtcagcatgggaaacaaatgggacaattcatgtctttaaaaagcttaaactctaaagtaggaaattaataagtgttaggaggcagagaaaattgtacacttgtatgttgctaatgataatgtaaaagggtgctgttattgtggaaaacgctatggcagttcctccacacattaagcatagagttaccatattatccagtaattctgccttggggtatatctccaaaagaattggaagcaggaactcaaacagatatttgtacaccaatgctcacaacagcgttgttgacaatagccaaatgatggaaatgatccaaatgcccaccgatgaatgaatggataaacaaaatgtggtttatgcatacagtttattattcagccttaaaaaggcatgaagtactgaaacatgctacaatatggatgaaccttcaagacattatgctaagtgaaataagtcaaacacaaaaggacaaataccctgattccacttatttgagattagttaagttcatagagacagaaagtagaatggtggttgtcaagggctggtggaacgaggggaatggggagttactgtttaatatacgtggaatttcagtttggaaagatgaaaaatcctagagatagaggtggtgatggttacacaacaacatgaatgtaattaatgccactgagtaagtgacttaaaaatgattcaaatgataaaatgtttatcatttctataacataaaacaatttttaaaaaatctaaagtaggatttatagtcaatatatgtggggacacaggtaatattcatttccattatgatttccaaaatattgggaggctcttattaatataagagccaaaatagtatagtcaaatatagtatggaacagttttgccttctagatagacaagttccttgagagcacagtgagtaatcttttacctcctataccgtgctaagggaaaacaaaaagtcagtaaattgtgccctaaaaatatggattacccagagaagcattaaaatgactcctattcttgcaccttgaaaagcccatcctatgtcacctcattctgtttttttaactttcgagggatattagcaagaacatttttcatctagatttagagctagatttttccttggctgcagaaaatagaacaagatacgtgaagcacaatgggtaataaaatcaaaactccatacttaaaatgtttgcattgtaaaatatctaagccaaccactcttccagagcatgagctctgccttgtggaataataggaaactcagtaactgctgaagaaatccatgttcagcacgtgagtgcctgagattcattcggtttctccttatattgaccagaactctctccacacagtaaacttacaatggcttatagtcagaagacctggggttgcgttctgtctcacgttagcatgagaagaagttagctcaaggcaagtaactaaagcctctttaattcaatatcttcaactataagatagaaagaataccacctgacagatttggaatgataaaataatgcatgccaaaatgcattgtcccttgtaaaagtgttttgtcacccttaaaaaggataaccgtttgaggcctggggaaaatacatggaaaataactcaaacttagtatgctagtgatttctcatgtttaattatttttaatttattttaaaagcatatctgtttgctagatttgctactagtctccccagaagatgcctaacccattgcctactatagagtaaatacagtcatcactgcatgaggacattttggccaatgacagaccacactatacaatggtgtccccataagatgataatgaagctgaaaatttttttttaattaacttttattttaggtttaggactacatgtgcaggttgttatataggtaaactcatgtcgtgggggtttgttgtatagattatttcatcaaccaggtactaagcctagtagccaatagttatttttttctgatcctgtccctcctcccaccctctaccgtcaaataggccccagggtctgctgttccccttctctgtgtccatatgttctcatcatttagctcccacttataagtgagaataggcaatatttggttttctgttcctgcattagtttgctaagggtataatggagctgaaaaattcttatccacaagtgacactgtaaccatcctaaggttgtagcacaacacattactctcgtttgtggtaatgctggtgtaaacaaacctgctgtgctgccacccatagaaaagtatagcgtatacaattatgtactgcacataatactcaataatgataataaatgtctgttactagtttatgtatttactataccatacttttttttttttttttttttttggtcacagagtcttgctctgtctcccaggctgaagtgcaatggcgcaatcgtggctcaccaaaacctccgcctgccagactcgagcagttctgcctcagcctcctgagtagctgggactacaggtgcgtgccaccatgcccagctaattttttttatcttttgcagagattgggttttgccatgttgcccaggctggtctccaactcctgagctcaggtgatctgcctgcctcagcctctcaaagtgctgggattacagatgtgagccgctgtgcccagtctactatgctacgcattttatcattattttagagtgtactcttatacttattaaaaaaaaaaacttaactgtaaaacagcctaaggcaggtccttcaggaggtattccagaagaaggcattgttaacataggaggtgacagctccgtttgtgttattgtccctgaagaccttccagtgggacaagatgtggaggtggaagacagggatagtgatgaccctgaccctatgtaggcccagggtaatgtgtgtgtttgtgtcttattctttaattaaaacgtttaaaaataaaaaaatacaaaattatttatatccttacagaataaggatataaaaatgtttttatacagctgtacagtatgtttatgttttaagctaagtgttcttacatgagtcaaaaattaaagcttacaaagtaaagttacagtaagctaaagttaatttattattgaagaaagaaaaaggttttttaatacatttaatgaagcttaagtatacagtgtttataaaatctacagtagtgtacagtaatgtcctaagtcttcacatttactcaccgctcactcactgactcgcccagagcaacttccagtcccacaggctccattcatggtaagtgtcctattcacgggtaccattttataaagtcttctataccatatttttactacgcctttcctatgtttaggtatactaatacttatgattgtattacatttgcctacaatatgtagtacagtaacatgcagtaacaggtttctagcctaggagcaataggccatagcatattgcctaggtgtgtaacaggctatatcatctaggtttggacaacgccaaaattgcctaacaatgtatttctcaaaatgcatccctattgctaagtgatgcataactgtatttgtagagtgctttcattgaggaggtataattcactatccacattcatccagattctggagcaacatatttaaatcaacactgagtgacacagtgatgaacaagagactgaataattcagttctcttttggatccttccccatccctttatttttcctacctgtactattaagtgttctcttagtcatatcaggctgttatcacagaataccatagactgggaaacatttatttttcacattcctggggtctgagaagtccaagatcaggcattagccataggagccttcttcctgttttgtagatcttggtcttctcattgtattctcacatagcagagtgagcaagggagcgagtaagctctcctatctctttttataaggctactaatcccattcaggatgcttccatcctcatgacctaattacctcccgaagcccttatctcttaataccatcacattgcagtttaggatttcaacatacaaattttgggggaacacaagcatttagttaataacaagggtctacctgctaaatactttttatatcagttaagctttcttttcctgaactcggagtttgtatccatgtgataaacattggtattcacacctagtcctattgagcccccaaattctttctttaatgtctacattaaaagggactccttgttaacagtggactgtagactcttaaagcattatctctagcgtgtatatctcacctagtcatgaaggagcatacaaggaatggacatatccccttcaagtatatatactacacagttcctggcatttgagaacgaagtcagtcatattaggatagtctgaataccagtattaagatgtatttgtcattatgtgtgctggctttgtgagaagacaactgggacttcaaaaatgtcttgcagggggttggagaaggtggggtaaagtaatgtgtcaggctttgtgtaagaccaatgtccaaacaattcataggggtccaaactgatgtccaagggagctcagggaattcaattcctttttgtgctggtatcattgcccaaagcattatcttaaaggtgaaggcacagcagtagtctctgatctatgagaatattggtcatcagttagggaaaagtgacttgataggagtggaaaatgagggaggggaagaaactcccagctgctgaggagccagtgacaagggtttagctctatctaggcaagttttggggacgagaattatagtgtcacacaggaaccagacaagaagcctaatcacagcctagagatgcttctggatttgaaggaaagtctatggctaacttaaatttctcttctatcttacataacttaccatagccctaaagaacttgctggcagttcattttactaaatcctgaagtaagttaccaagcatctccccaaccccaaggactttataaatagaatagatcacccatttgctttaagtgttacggaagcactccttgaagcttttttcttcattctgtcttacaacttctagagtaattcaaaattaaagagaaaaaagctatagccttcaacagagtttgaaagcagcaggcacagccttctctgtccatttttagcagaactccaagaattctttttttctattatgatatgcagcagaaatagaaacaaccatttaggagatgtgactcaaaattcagtgccaaatttaaattataaatacattgttctttctgatagcattcttgattattttaacaagttcagtctttaactacaagataacagagtggatgctaacgacgcagatttgtgtgtgtgcttgtatgtatatatatgtatgtaaataaatgcatataccaaatgttgcacctttaattttataataaactacattatcgtatcttactaaggtctcattaagtcatattttaagagcagatataattcataaaattttatattcttcactttcaatataactctagataaaagtcacattttatcttacaagaagtatctttttggtcatagtcttcaaacagaaaacaagaattaaaatggccaaattgttaattttgtcctttatacttaaaagttatccttatttccattttttctttcaatgcaaaagaatttcaattttatattgagtatattcccattaatgctgatgtaataagttatttttatgttttgcaatcatttaagctctgctatttttctaagatagttctcaagcatctgcagtcatcatttatatcatttatatgtcacctctaaaggaagccacaatttgtaagtgtgagtaataaatttaagattgtgatagttgcataccagttcctaaaggtaaacttctgtaggtatttatatgtcagagaagctaaaaatctgtgtgaaatcaggggagatccctccagtaatggaaatcactctttgcagcaggaacagccagaatgactaggaagatctgccttaagactacctatagaccgaggcaaactttgtcagatatccccgttaaatttctatgccaagaaatttcactcagtatgaaatcttcacctgtccatttttctctttatgctaaagagttcaagcatgtctaactctgtgctgatatgcccaggaatatcatttctccttctttatccaagagagaaaaagaaatcatgcaggctctctggactttgtaatccctggcaaataccatctgagatgaaacccacagcagcataatgttggtttgttgtttcagatgtatttgatagggtgcaagatctttgctgtggtcagtcagattgccacttctatccaactctaaaatcctattagtaaaagggcagctatgcctgtctgtatgtctccctcagagatttctaagggagacgtagccccttccagaatgcatataaagataatataattaactataaactccttgtatgaaataaatatgcatttaatctggacttcaaagtagaaggtttggctctcttgttcttagtgtttttaaaacattttgcactcaaaaaaatatggcaaacaaataagcagaccatgtgaatttttaaagtgctttccaaggcatgttgtattttaagtacagtgtcagtcctaactctaaccaacctagagctacatgctgagaattgatgttcatgtggtactataagattttgaagagctttcttgaatcactgaagattaaattatgttccatctgactttcaggttaactataatttatgatgtttaagagttagcgtgttataagtaataactctcaattaaccaaaatagccagttaacttgaaaattccactcttagccatttttataaacaaaatcttttggtaatacattctagactaagcagaattgttttgtgtacaatctatgaaaaatgtttgctaaataaatgaatagtataaacttggtaagagaggttatttttaaaaccaaagttgttagtgcattcattatttgaatacatattgaatctgttccataaaccaagaactatttgtaaagcaggaaggcacagctacttaaatttttttaaattgacagttactttaaattgttgcatttatttgaaaacataagtagattttacaaaatattgttttgtagttctgactttttcttagtcttcctctaaatttgtttcaattattaactattttgtcatattttctgttataaaattaccttaattatgactgagccttatgtatttaaaaaataatttttggaagacctctttgaaagctgaatttacagttagcaataaaccataaggtataaacagcaagtagagtgagcactgggtttagaggaaaatattgtcaattggttcatagaaagggaaaatagaaaaattgaattaaaataaaaattttaaatctcacactagtaagatatatgaaattttgtctaaagttatgtaatgacaaataatatgattcttctgaacgattatagacaaataggttcctgcaagggcagtagatgtacacatactctgcattttgatttaaggattgactcctttttgaaatccaaaatgtgttatcctctataaaaagcttaaaggaagcttataatctaataaaacagggttggcatacagttgtgtttaactctgaggctttgagttttattgggagccagggcaagagaataaagggagttggtaataaattcgtaaatggacttcccattccacattggaggctttctggaagagttatttgagcttgactttttaaaggtaatgtccatgttgaaaattgttcagattacaagataataagagtagatttagatttaaatttgaaaatgaaatttgcaaacaatatgattaatgccaacacattgtggactggtgaaaggtctgtgacattattacacaggaaatgatacaaccagcatgttccccaagctgtgtttcatgggccactatttccgcctgataaatagaccatgagaacaggatggacaagtgaatttagaaataggatattatattgccctcttggagagatcagtgcctgttagccttttaaagactcttaagaggtagaagtttggtttgtttcccaaatgtatttgattagagaacaattttagaaaatgaaacacttctgccttgtttccaccagtaagggacgggaaattactcccttcttgtattttccttttagataggaatgcgtgtagtactgcgtgacatcatttaaatgaaagttgccctgtagtcttgtcatttttttgtgcatttctttcacacctaaaattaatgctctcaaggtttaaatttttatttgtaaaactggcatctttgtccaaggtaactcttttttacatccaagaaaagcaatttgtcaaaattaaagcgtactgcttttatcattatcctccataagagaactgatcatattctttttgcttatctctaagatatgcttttcccacttcttcacattcctgaaattgggatgcatgtgcaatatgagtgtgtttgatgtggtaggtttttccccctagaaaagctattttaaagtcaatgtatatgtcttctattcatctgtatcttaaaactgaagaaatgtgctcttttggtatcttatactttctttagtggtaagtttcaagtaagacaaatatgtgaagctcctgggtttctagggaacagacacagactcaggctaccttaaggagaaggcagattactgtaaacataagaagggacttaaactagaatgctctttgggtctgaggcagttttctggatcagatgtggtctctatttctctttcatggctaatgtggtctatttgtttttgcctgcctgctctttagttctactaccacagctagtcttttctcttttctccagtccaaatttagcaaagagccattctgattggtttaattatagacaccttagcggagcatagctgaggacccagacaaaggccgttaggccatcttgggtcagatgccgacagtgatgctgtcagtcgtccatcctagcacaaaaatgggcctgatgctactgccctgcagggaagggggctgggcatgctaagcattcccattaatatattcagagaaacagaagtagtctatccctggttgatctaaaggacaagtccaagaaatgacttaacaaacttcttaattatgacagacctcttatgtgaggctatgtagctgagaataaggataagagaaatttctaggattcagaagtaactggggctgcatttcagattgtcttttacttaccacctataactgtataactgtattggatgagttggagttctacaggcaactcagtgaagcagagggaacaataaaacttgaccagaaaagttatataaattatgaaatttaaaaatgtagtctacatttcataaactcagcagtttgcaacatgtgtattacactttgatatgccaaacaacttttctataacaacttaatcaatgggtatacttttgcgattttttcctctgaagttttcactctacaattcttgagattttcggctctaacgcagacatgtggattgatggttctctctcattcttttatgagtgatgaacacacagtactacttctgtgggcccgtgtgccctagagatgactgtaacctactattgatcagctgattgaagataaatggcttagctgcttgtattgcagattacatcattaacatggtcagtaaaccatgaattgttcaataaggcgtttatcttttttcattttacttttgctcttttgtcatttttattagaaaagacaaaattacccacactaaccagcaagatcagtagaaaagagatccagtagggtaccattatggctgcaaagttgcagacatctaacttctaatggtttaataatatttagtatgtttttgaactgaagaaaatatagagttttaataatcttttttgtgtttcttttacagcttccttttgcctcatatttactagaagcagtactggaaaaaataaatgaaaaaaagaaactagttgaaggatatttcacaattatgaaagatattagatgatattaaaatggagagctttattgcaaatgtgaaaactttttatgtggtgtgattggaatacatgcattgcaatcctgacacggtatctgctccaactatcaatagtcaggttcaataccaaaataagaagtctctgaaaataattaattgctgaacaagtgaaactaattaagtacatagccatttaaaaggaaatagtgtagcatctgatggtcgaatacaaatattgccacaaatcagtgcaaacttaaaaatgattttccttctagtgcattaaaagaaactgagcaggcttggtacacacaaattggcctgagcataagaagaaaaagtatcaactaaggatttaatgttttacgtttcatgaagaaactagactttttacataaaactgctatagatggccataagtggtccagggagcaacagatttgtagtatgagcaaatataaaatgaagcatcataacttgagcatttattgaaataaattgtgtggtccaattgaatctgttctcattgatgtgctggtttatgtaggagatactgtgtatttctacaactctttggcaaaaacaaaaacattttcttcttctctctcttaacttcacaatactatacgttgtgtagtcatataaatttgcagggaaccacaaacccaatgtataaaattaggctctatttaacagaactactactgtggtcagctaatttaagttacattcttaaccatgatgtcatccttatttagattcctggacattcccacctcatttcacctcttcaccgtgttcctgccataccctttttggttcctctaattcaccatactggtgcctgcctcccacatttgcccttggtcttctctctttctagaatactctgcactcaactttcctcatggctggctccttgtcatcattcagctccaccttccccggtccctcagagacacattctctgaccagcttactattttatttcctcatagcacaaaattatctatctgttcatgtatttgttttcttgtttattttcttcttttccctctttagtatgtaggtcccatgagattaaggcaagggttggcagattatagcctgcagggcgaatctggcctgccacctgttttgtatggcccacaagctaagaatggtttttgccttattaaatggtttttaaaaaatcaaaaggagaataatattttgtagcatgtgaaaattatataaaattcaaattttggtgtctgttaataaagttttattggaa

SEQ ID NO: 1756 - DNA, 42705 bp, Homo sapiens
gttgtagtgaaaaaataatttattaaatgaacataatactgggagtaaaatgcattataaaagtaaaaaaaagtaaattataaatataaataatagtggtttacctaattaacagatttttttcttcatccttgaagaactttaaatacaatcttccaaaaagccagattgaaaaagtggctggttcgctttagaacagacaggcaacactataatatctagaatttggcaaagatctgttatataagatacagaatggtactgattaaatgattgttctttttaagccttttgtaagtctagaataataattttaataaataagcagatcaatttattatattcatttctgtctctaaggatagcaaacatatttctgatacacattgtgaaaaatgttctgagaacatacctgtgcactttgacagactaaaaatttttggttatttggtaaaaagtgatctcctttttacttcaaaggttaacaacagccattgaatgtgttgatatatgtcattagaattttaaacagccacaccttaatatatatatacatcaagataccgataaacttttagatagtaaagaaaaaaatggagattgttattctatttccccagtaagtttccctcagtttttagaaagcataccgactgggattgcaaaatgccagcatgattacaatgcttattaacagcaatatgcaaaacagtgaaaatagaaaataaataacttcatcctataaaaatgaaacaaggcacttttaatgactgtacacaaagctgaaataaacaaacattttttcataaagctgactcaaagaccctaggagacttttgtagaaagtgaaatagtaaaggcactacataattctttctcctaactctacttactaaaaaaatccaccaattaaacttggcacaaaagagtttaattatcataaagtgcatcacttggctaaatatattaaaaagaaaatcagccataatacagtataacaacatcttcacacaaatagaaataaaaatgcaatgtcaggagtcaagccagttaggaactttgcagtatatatggctttttattttcttttttgtataagcccctatttatttagaatctatattttcgaaagaatatgccttaacaaaaggaggtagtattctgaaagaggcaaactcactaaatctaggtagagataaagattacgtggaaactaaacaaatgtaacatattaataactgtgacacttattaaagtattttgatattaatgaatcagcttttaaaatcaaggctatcttatcactttagctatatgattacagctctttcaagtagttttcctttggtactagaaagtcatttttctaaagagcattaacatttcaaataagcaaattttatttagagatgtaaacatgtaaacattaaaaactcaactaaattttatctttattatgatggtcactgatttaaactattaatgaaaatatgtcatgtcagagatataaagaagaatatatcacccagatagtaacatgcaattaatttccatttgattaatataattggtgatttaacacacatacatatatacacagtagtttggagcaatatataggcaaaacaccataataatttatgcacagtatttaagaatgtgggccttgataacagaattccaacaagattttttttagtgtattaaatgtaattggataaaatacaattaaaagcagcagtgaatatatttcctatctcaataacttaaaaaaacttctttatgtaaactttatacatgtgcattcttgctcttttctatatgttttacagttcttggttcttcttttaaaatagtatttgccactcttctaaatttttgaatagtctaaatggagggaactgcttgtgatacattagtcttcttcagcatcatatgccacttctgctacttctatctctgatacagcattttcaggttcactaaaacttaagcatggtttattatcagctctgcaaaaaaaaaaaaaaaaggaacatatcaatgatgggactggatgcatgctattatttcattttcactattacctttaaaaatcttctaccttatagaaaatttacatacttagtgtaaaagtatttaatgtaagagtatttaaacattcaatcagaaatttgatatatttaagttgtcattgccaagtaagacctttggagataggtttttaaactcagctctccaaactaccatttaccaataaaaatctacttggtaattacctttatcaacataaaatttttctcagaattatagttgaccattaccactaaactattaacaattaccttggatttgtatgcaataaaaattctatgtgcttttaaattcattaccttttcatcattcctattaggtaagaagggtggtttgctattatattatagtagcctactttttcaatggaaaaagggtgatattgagggagattaaggtaatctgtcaatatttaaaaaattagttaattacctgagtcagaggccagttaatgcagacacagctctaaagtaagtaatgagaaaacttacatcctgatgtcaaagacactttttatttttaaagtgtttttatttttaaatattttaggaaaagcctaaaatatttccaattcattctctgtttgcttagcagattcgtgatacagtaacactgagttcataaaaaaatactctatagagtattagaatcactttcctccaattattcaagaattaagctatcataaatgaaatattatatacctagattcttcatccaggacatcttgatcaacctcaagtgcagaggactccacctttaggatctgttcaccttctgtttctgacacatccagtgattcttcaggttctaaagacaatgttctaaaagtatgttatagcaacaagttattttctatgaacaaaacaggcatatgtttaatgttgtgaatacaggtagctatagcagtctttagctgttaagccttaatgtagttacatagctaataaatagctcactttggaagtcaacagagaaaatcagtagctatgattaatttaaaatgactttagtatcaattcaagatatgctgatgagatggcaaaccagagctttcatatgtgaaaagctggcataaatgcctagaaactaagatgtcacttaaataaaataatggtattccatttaataatgattatttatttaataatgatttaacaatgattaaaatgaataatgtttaccttgttgaacagttagtggcttattttcctgatgtttcccatccttcaatgttcaaaatttatttagcaaaattatgctaaataaagcataattttcccaatgaagtatgccaaaagcctacaactttcagaatcagaaaattcctaaatcatattaaaatataaagggcagttagcccagagtattaagggttgaattagtcagagtagaaatgcaagtatcacaacacacctgattctgttctctaaagtgtctatatgaagttgcttctcactgagcagtttctttagtgattccatctccttttgtttttcaagtagttctttctgtaagcggtagtttgtctcttctaaagtttcacagaatgccttaaaaaaaacaacaaacaaaactaaacacatgcagaaaaagaatacaattaattacaaatgcagtatctttctcaagagcattattgaagagtcaaagaacacagataatcaaaataatagtatgaaactccaaatgatttgttctctaccctcatctttttaggtcactggtatcttaactttagttcccatccaccagggggacataactacaagttctttttcttaagacttacagtagtaagctagtgtgcctgaagtgagtatgtgatatccctctagtgtagaactgggataaaaaataattggcaactactgctttagtttttactctctttaatctacttttgcctagtcatacatgattacacttaaaaaatatcaactgtggttgatgccatttgtattagctcagtagacatactactgtaacagcattttggtaatcttgacacttgggttgcagtaccaggatggtacaagaaatgaggagtcaggtacattttgggaagtaagtgacaaaaagtgatagattcaggaataaagcaaagaccctaaagagcctattaataaaagtcactcaacaacacagaaaaacatcaagaaagattgtttgtctcaatctggtttctaggtgggcgaggtaaagtctcacctgaagaatctaatctaaaaagcctcatatggattttgggaaaaacaatgtatcataaggaagacaaataaaaacaaatatatatatataaatacaagatactgaagttgcaaatatcaaaatcaaatagatctctaaaacaccaggaagacaaatcagtttactataaaattgtaagacagtaggggactgggagtagatgtcataaaacagtctatgtcaaaggcagtggaaaacactttaaagcactgagaaaaataactatcaaggtagaattctacactcagttaaatcatacttcaagaatgaaacaaaattaaaagacatttgaacatcaaagatctaagcattaccaatacacattcactgaaagaactattaaattatgtactttaagaagtagttaactgaatcccaaaagaaagagtaggatgaaagtaggaatggagaggaatgaaagtgacaaagacttaggtaaatcaaaagaaacattgactgtgtgaaataataatgatggccaactttgaggagggctgtaaacaatcggtttccaatatatgagaacatatgaccattaaataaaagacaatgactacagaagttaaaaaccaagagcagagaacaaagagaaaaactcattaaataacatgaaaagaaagaaaggagtaaaaaagcattttataaagcagaatcaaaagcacaaaataaaataatagaaataaatacaaatatattggtcattaccatatataaaataaactcaaaacttaacagatttttcagactgtattaaaaagaactatgatgtttaaaacagccatatttaaaatacaaaagtagaaacatacttaaaggcaacagacaaatgttagccttttctcccctaccaaaagttgtagttttcttaatatctgacagaatgcagttcaaggtgataaacattattaggcacaaagagtctctacctaataataaaagtaataattcaccaggaatattttaaatgcataattacaagaagaaattgaacaaatccacaccataaggggtaaatttgacataactcttggcaattaacggattaaacaaaaaaatgagttaagattaaaaaaattttaacaatacaaattagtaagtttgatatgatgaacatatattgaactgtgagtctaacaattaagaaatacatattcttttcaagcacacatggaaaatttagaaaatttatcacatatgtgcagatcccaaagactgcagaacactgtcaacaataaccaagaattggtgtcagacagaacataatctctgaaaaaaatgcaaatagactaaaaaacagtcaataatattagaaaaaagtgcttgaaaaattaaagagaattctaaatttatggagcaaacaagataataggaacaatataaaatatgaacgagaatgaaaatattaagacttgtgagatgcaatttgactgttatataaaagaactgtataatactagaaacaactgagaaagcatccaattaaagaagtcaaagaacatactaaaaccaagtataagaaaggaattaagagacaggaaaagaatttaatcaagagaatcaaaaaggcaaaaagtggttctttgagaagactattaaaatacaccaaatccaaggagaaaagactagtggaaaaaacagtgagattcaaagtggatatataactaaagatatgttaagagattttcaaaagtcatgtgatactactaagaacaacagttttgcggtggctcacgcctataatcccagcactttgggaggctgaggcgggcagatcacgaggtcaggagaccaagaccatcctggctagcacagtgaaaccccgtctctactaaaaaatacaaaaaaattagctgggcgtggtggcgagggcctgtagtcccagatactcgggaggctgaggcaggagaatggcgtgaacctgggaggcggagcttgcagcaagccgaaatagcgccactgcactccagcctgggccacagagcaagactcttatctcaaaaaaaagaaaaaaaaatgtattttaaaatctatacaaaatggtcaagttctagaaaaatacagattctcaaaactgaaacctccccaaataatctgaataaactacagacatcaaagaaacagaatcagttgttaaaaatctactataagacaagctaaagaaaatatcaaatccagattgttttacaggtgaattctaacaaacatttagggaacaaccaatatgcatttattcaaatggttctggataacagaaaaagagggactattccttattttataaaactggtataattttgatgccagacccaacaaagggcagtaacagaaacaaatgttacatatgccaaaattctaaataaaatcattacaattcaaatccagtaattaaaaaaatacgctgaatttgcgttaatctcataatcaatgttttatcaactgaaaatctatgaatgtaatttaccacaccaatagattaaaaaaaacccatatgatcatctatacagatgcaagtgaaagcattcacacacacacacatccctacaacctcttagcaaactagaaatagaacttctttaatctaaaaacaacaacgaaaacaataaacaaatcaacataactcacaactaccaccagcctatagaaaactccatatccaacagcaaaatacaggatcattttcattaaagttaggatgaaaggaaaaggatgcccaccataatggcttcaattaacctccaaagaatctatctagcaaaataatacagaaaaatgaaatgaaagatattacgtattaggaaaaaacacattgttaatattgcaggggatatgattaccgatatggaaaatccaaacagatctataaactaacaagagaatgtgacatacaaaatagatatataaaaatcaataataaaactagtaacttagaatgtaataaaaataccaattatttcatcaacaaaaatgatgaggaatcctatggctttccctagatgaaaaaaatgtaaacttttattgaagaacttaaaaaaaaaccctccatatgcaaagatctattaataggaagattcaatactataaagatactcttcaaaattaataaataaatgtattaaaattccaaacaaaatggcaataggattttttcatggaactcacaaagttgttctaaaattcatatggaaaagtgaatagccaacttggaagaataagggcacccttgttctgccagttaataagattatttaattatagtaattaacacaatatagtaccagcagagggatgagactactaaaaatgaactgagtggccaggcatggtggctcatgcctgtaatcccagcactttgggaggctgaggtgggcagatcacctgaggtcaggagttcaagaccagtctggccaacatgaagaaactccgtctctactaaaaatacaaaaattagctggatgtggtggtgcgtgcctgtaatcccagctactcaggaggctgaggcaggagaattgctggaatcccggaggcagacgttgcagtgagccaagatggcgccactgcactccagcctgggtgacagtttgagactctgtctcaaaaaaaaaaaaaaaaaaaaaaaaaaaaagaactgaatgaccataaacagacccgttcacactcaactatttagcatagaagaattactaattagtgcagtagggatgaacttttaaataaatgaggttgggatcactggtcatccatacagaaaaagttaaatcaattaaaagatctgaggtcagcttgctcctttctgcccgtggatgccgccgaagaagcattgttaaagtctctcttctccctgctgtcatgtctaagtcagagtctcctaaagagcccaaacagctgaggaagcttttcactggaaggttgagttttgaaacaattgatgagagcctgaggagccattttgagcaatggggaaccctcacgaactgtgcggtaatgagaaatccaaacaccaggtgctccaggggctttgggtttgtcacatatgccactgtgggggaggtggatgcagccgtgaatgcaaggccacagaaggtggatggaagagttgtggaaccaaagagagctgtctcaagggaagattctcaaagaccagttgcctacttaactgtgaaaaagatatttattggtggcattaaagaagacactgaagaacatcacctaagagattattttgaacagtgtggaaaaatggaagtgattgaaatcatgactgaccaaggcagtggcaagaaaaggggctttgcctttgtaacctttcacgaccatgactccatggataagacggtcattcagaaacactataccatgaatggccacaactgtgaagttaggaagacctgtcaaagcaagagatggctagtgcttcatccaggcaaagaggtcgaagtggttctggaaactttggtggtggttgtggaggtgttttcggtgggaatgacaactttggttgtggaggaaacttcaggggtcatggtggctttgctgacagctgtggtggtgggggatatggtggcagtggggatggctataagggatttggtaatgatggaagcaactttggaggtggtggaagctacaatgattttggcagttacaacaatcagtcttcaaattttggacccatgaagatgggaaactttggaggcagaagctctggcccccatggtggtggaggccaatactttgccaaaccacgaaaccaaggtggctatggcggttccaggagcagccgtagctatggcagtggcagaagattttaattaggaaacaaagctcagcaggagaggagagccagagaagtaacagggaagctacaggtaacaacagatttgtgaagtcagccaagcacagtggtggcagggcctagctgctacaaagaagacatgttttagacaaatactcatgtgcataggcaaaaaactcgaggactgtatttctgactaattgtataacaggttattttagtttctgttctgtggcaaatgtaaagcattccaacgaagggttttaatgtagtttttttttttttgcacccaggctgttgattgctaaatgtaatagtctgattgtgatactgaataaatgtcttttttttaatgtgctgtgtaaagttagtctactctgaagccatcttggtaaatttccccaacagtgtgaagttagaattccttcagagtgatgccaggtactatttggaatttacatacaacctgcttgggtggggaagtcattgtcttcagaaaccttggtgtagttgaactgatagttactgttgtgacctgaagttcaccattaaaagggattacccaagcaaaatcatggaattattggttataaaaatgattgttggcacatcttatgcaatatatttaaattgagtaatggtaccagataaaattatagatgggaatgaagcttgtgtatcatccattattaggtgtaatcaataaacaatttaattctcttaaaaaaaaaaagacctgagtgtgaaaagcaaaagtttacacttattagaaggaaatttaggagaaatatttttatgtgctggtgtgtagggaagaacaagagccatagaaaatgtgacaaagaatgtgcagctactatggaagatgccagacctggctggtaatcaagaaaattaggctaaaataacagtaagatattattttatacccatcagactgacaaaaattaaaagattgacaatacttgtattagtggtgatatagagcaaaaggaaaacatattgttggtaaaagtacaaactgatataacaaatttggggtgtaattttagcatatgcagtgaagttgaagaggagaatatctaacaatgaaacaattgtattcctaggaaagtacctttaaaaccttgggtttcttccaagattaacatccaccccagtgagggaggtaccttaggaaaaatgtatataggaatggagactgtccttagaatagtcattggaaggctatattgatataaatttccttctgggatagagatcaaacagttccatcaggacaggaaaatctgctagcaagtgattctaagaaaacagcttcattacatattacaatttaggtagagaatagatggcttaagaattctgctttaattgtttgtacttataattcatataaaatattaaaaattataatttatttctaataagctattcattaatgttaatacagtaagacctcatttcttccaattatattatctccatacaagtaatagatttgaattttcccaaaaaaaggtagactaatttatatccctaatcttaattccctcttttagtacaagtatatgaggggtagaaatgactaccttaaatagggaacagagaaaagtaggttaaagatttgccgaactgagtatcctttgaataagtttaattttacactccaagaaatgtgggttaataagtcattttgggatttttcttaaaatgagaggctgcttaagtaagtctgcagacaaaagagatatatatctcattaggttactgtagattttaccttgaaggagaggagcaaacacagaatttcttcattcactgttcaaataaacatatattttcaaatacaactgtaggaaaatgcatttattttagagaaagagtctaggagatacattccatattactctgttgagtgtataaacttaatattgccttggtgacttatttaaatcagtggttctacatcaggagcgattttaaactcagaagacacttggtaatgtctggagacatttttacttgtcatgagtgggtatgctattggtgtctaatatgtagaggcctaggatgctgctaaatattttcaatgcacacgtcaggctgtgctctagcctcggccaccaaaaagttatccagccctaaatgccgatagagtgtatgagaaatcctaactcaaatcagcttccactcttcccctgccaagttatgatacttgacaatactaactagcatatattttgaactaagaacactaaaaagatattcaaattattatttttttgtaaaagggctaatttaaaaattaaaaaatgaactaaaggctgtcttgcaagaagaaagaatactatactttaaaggaataaaaatcctggaatccttgagctggaaaaggagtgataaacacttagcttctttagcccaatgttcacttaaaatagaacttaattttctaaacagattctaaatcaaagagacaaaatggtagccgaaaggctgaatgaaacccagaagcaatgatctagccaggatttaatagggagttctgggaaacgatatatctatggggccttgataagctttccacatatcctgggacccaagccacacaggacaacagagcccatatgcgtgtatagaataggagatgggaaaggattcagcagaaactaaaatctacagcatacttgaaaatgaccttaactttaaatacactccttagactatatacagatccattaccagagtgtaaaaatcttactagtttgaggtatataagcaaaatttatgaccaactgttgactgaacattaagctatgcagaaatacaagaaagccaggcttaaaaataaaatgaggaaaaaaacactgagaaaagacatcagtgaccacacattgctgaggagacaaacttcacagatttagtccaggcaagttactaaacagacagacaaaataataataaccactataggagacagagattaagaatcaagagttgctacagtgtatcacctaaaatatcttgtattcaaataaatgtacaaaacactcaaagaaacaaggtcaatctaagcatactcaggaaaaaaggcagtcaattgaagctatctctaaacggccccaaatgttaggcatatcaggcagtgatttttaatgcaaccattacgtacatgaaataaactagaaaaaattgaattaatgataaggataatgataatgagtcaacaaatagaaaaatctcaataaagagaaagaacagttaaaaaataagcaattgagaattttggagttgaaaagcacagtaactgaaaaattaacaagaggggctcaacaggagatttaatatgaccgaaatataaatctgtgaatctgaagatcaatagaaattttcaatctgaagatcagagaaaaaagcaattgaagaaaaatgaacagcacttcagagacattttgcacaacacagggtatacaaatatacaagtaatgacagtccaagaaggagaagggagagaaaaagggagtgaaaaagtatttgaagaaataatggctaacaaattccaaagtttgatataaaacattaatctgtcaagtcaacaaagctcaatgaagccaaagcatgagaaacagaaagagatctacaccccaatacatcataatcaaactgctgaaagtcaaacaaacagaatatcttgaaagcagcaagggcaaaatggctcatcatgcacatggaaacaatataaaggttgattttttttttatcagaaataataggggccagaaggcagtggaatgacacattcagagtgctggaagaaaaaaatctgtcagtaaaactatctttcaaaaatgaccatttccagctaaacaaagactgtgagaatttgttgctagcagacccgtcttacaagaaaaactaaacgaagattatgagactgaaaggaagtgataccagatgatcacatcaacctccaggaagaaatgaagagggccagaaatagtaaacacgtggattaaataaaataatctatgaaatatattttcccatttcttaagttctttagagcacaaaagactgtataaagaaataattattgcactgtattgttaggtttataagatatatgtaaaatagataacaatagcaacacaaagaaagagggaggaaacggagagatattggagccaagtttatatttcactgaaatataatacctttagcagtcactgaaaaataagaaaaagtaaaaaattctacagaagaatcaaaatggcatactaaaaattattttacacaagataaaaggaggaatgggatggagacagatgagagaaacagaaaacaaattgcaaaatggcagatgtaaaagacagatgtcggaaagaataacagatcaagacccaattacacgctatgtagaagggatggatcttgggttgaaagatacaaacagattgaaagtaaaaggatgggaaaagatatgctatgcaaacagtaatgataatagagctgcagtaaacaagacagtatcatactggcacaaggacaggaaaatagatcaacagactagaattaagagtccagaaacaaacccttcttttcatggtcatttgatttctgacagaagtgtcaacataattaaacaaaacgaactaaaaaaaaattaagataggtataggaacttaagacccttacctaataccttaaaaaaaattaacccaaaatagaccataaacctaactgtaagagctaaaatataaaattaaaaatatatatatgagaaaatatttgtaatgttgggttaggcaaagagtttttataatacaatagtaaaagcataagccattaaaaaagtgataaaataaattcattaaaattaaaaacttttgcacttcaaagaatgccattaagaggatgaaaagacacctacagactgcaagaaaatatctacaaattgtatctctgataaaggattaatatctaaagtaaagattttataactgaataagataaacagcccaggttttttaaaaaatgggcaagacgtgaacagacatttcattgaagaaaacatgaatggctaaaaagcatgtggcatgatatcaatatcaaaaaatcattagaaacatgaaaattaaagctataatgaaatatcactacctatccaagagaatggctataatccaaaagagagataatatcaaatgtttgtgaggacatagagaaactaaaactctcgtacagtacaagtgagaatagaatacagcaactttcaaaaactttattggtttctttaaaaagttaaacttgttacatgatcaaacacttctactcttagggaagtagaatttctcagtccatgagaaataaagccatatgttcacacaaaacattatatgaaattgttcatagcattactcataatatcacaaaactggaaacaatccaagtatccctcaatgggtgactggataaacaaaatgtggtatatgcaaacaatgaaaaaccatttagtaatgaaataattatagaggataacatggaataccctcaaaagcatgctaagtgaaataaatcaggtgtaaaagattataatactgtatattatatattaggcagactgtatatataaaagttatgtatatggtaaactaatacacacaaacacacactgtatgattttatttatatgaaatatccagaaagggcaaatgtgtagagaatgagagcagatcagtggttgccttgggctggaagtgcagactgactgcaaaatggcttataggaattctttttgaggtgatgaaaatattctaaaattgggttacagtgatgatggtaactgctctataaatttccaaaaaagtattaaattgtacattttcagtagaatagcaaacaacaaattggtgaatattatggatgaaaatattactccaataaagctgttttaaaaaggccagggcattcaatctaacacaaagaactgactcagcttgaatgaaaacattacaaacctaccaattaaatctgttccatttaaatgccattaaacatttggggaaaaaacttgcataaaatcctagctaatctactattaccaaatctgttttgtgaatctaggctattgcttcaagaaacaggacactttaacacgtcaattaatgtaatttgagaagcatcaggcacaagctaaaccgataacaagataatcactcctacccctgaagttttaaatttgattttagctgtacattccttattttgacactcaaatggaagaaaactcagtttacacatagtattattaaatataaaaaggtcccccaaatcattttttttgaaacagtaaaaataatgcaggatttaattttagagctttattgactataagacatatatgaatttttactttttcactgagctaagtctatgtatttcactgaaagcaacctttgactcaaacatgaaagctttctgtgcaaaactaccatagcctgaaattataatattttgctgtttgctattccatccaagaaacaatgtagttattgtactgcattaattgttcctcttttcatgtgctatataatacagcacttaccctgctttcttctaggctatcaaatggacccggtggatcatccaaacaaagaaattctctcactgcaaggcttttcaaaggaaaaaaaaaatgatctgaagtacaaataagtttgcaaaagatagcaaaaagcaaaagttactttgaagctgtacagtgttttaaacaagttggttatgtgttttcatacaagtaactaaatataaatataaaactatagaagatgcaaagatcttaaggtgttttctaagatcttagaacataaatatcacaaatttattgttacatacaaactatggggcataaaacatacttcacaataatggttcaagagaccaacatagtgaatagcctctttatgattttcaaagaaatattagtctgaactagtctaacagtcattatccttttatgaataaatgcaatttctaatttatacctcacttgtttttgtttcagtagattcttctaaagtgaccgaaaagcatttactctcaaacaagttaaagactgaccttgcaatcatgtttattatattaatttacttaaatattttccctagatagttcgagagaaaaaattctaaccatcctatctctaaatgaccacaaattttaaaatagttattaaaaaatgatattgttatgcttatactttgctattatcagagaaacaggttaaggaggtagataaccaaacttccttataataaaaatgcctccctgcctttctaaaaagcaagtttggactgttgaactgagagacaactctatgtacacatcaaaatataaatgtggatccttattttagatttgcaaaataaaatctttacaaatttccttttacaaaggattttctttttttttttttttaagacgagtctcgctcttgttaacagcccaggctgaagtctggagtgcagtgatgtgatctcggctcactgcaacctccgcctcctgggttccagcgattctcctgcgtcagcctcccgagtagcagggattagaggcttccaccaccacacccagctaatttttgtatttttagtagagatagtgtttctccatgttggccaggctggtctcccactcctgacctcaggtgatccgcccgcctcagccttccaaagtgctgggattacaggcacgaaccaccgcgaccgcacccagccaggatttcttgatacactacaaaaaggggatgtcaacttatgctaaaagggaatggggcttttggtttcagattaggccagacaggttgatgatgtcaggaggtgtccatgaagagttaaatggaattttacatatcttattgtatttaatatgctcacatattctattgtatttaattttcacgacaatcaggtaagattaggataagtattggatcttcattcacaaatgataccgaatttcagagaggtgaaattacttgcctattgtcagaaagtgcaggtggtagagctgtactttcaatctgttccctgagtgtgaatatgtgtccttttctacctttaaattcttctgtcttatgctttggttcatttggattctccttgctggacacttctctctgaaaacatctgatttatctgcaaccctctctagtcatggcctctagtagaaaactgcagttggctgatagcacagaatagaacaaggtcttctgatgtagatattatgcttctatccacccattatttatactggggcacctgctattacatacaaatgactcctaggaaatcaattgatctgggattgagaggtcaagtttgtatgaaaccctgaggaaatagcacttaagactgaaagcaaactgctaagaaacatatggaagggtcctgtttaatactttcagtatatgacaaatgtgagacattattttcttacagttttatattcaaatttcctcatactttaatgttgcttttatgtttacaaattactctactggactgctactgctaggaaagaaaaaggggtaaaggagtacacatatatccctttttatatctttggtttacagtagaaatttagccaagatggacagtgaatgttgacagtgtatccagctggaggaatcattttggagtggttattctgtttcattcaccttccctaaaaatctttatgatctatggctcactagagttctacttacatgaaatccaatggattctttaagtttttatccatatagttccaaggttatactctatgctttactttctttaatcagtagcagaataaaatttgaaactggctttacaatgttaatttacataaaaccttttcagtggctcattacatttcctctgcttcaacaagactcagtcagtaaagaaagcagtcaataccctcaaactctattttctttctaaggagaggacacacaagaatctctggaagatggtagtaattgagaaaacaattcctttcttagaaattctgatacatttttccccctaggaaaggaaaccctcacccttgcttgagaatcactgactacataactttatttagatccagtgaatatttattgactgtctatgtgtgccattattccttttattatctggaatacatttttactgtgtttgggaaacctattttaaaattggggtcaggtgttgacttaatttactaaaggcagataaggaaatcacctatggtatccctcagcattgttttaattatcagagcaaatctgtactataaattcacctgtttctttgattctcttgaattttgtttaaagagttttaccgtattttcaaactatgctcttaagaacaacatatttgactttattgcaaattttataactatctgtaatttaatttctaccaaaataacattttgtagcaaaaaccatccaaccaaccttagtaatgtgttgattctcatgagatagcattatatgaactactgtgtaaataactgaattcttctttcattttatataaatactaagattaacttctctgaatatcttaaattttcttttttaaattaaaaaaataaaaacaacttagagacattaatgatcacatttcctgtgaaaagatagttcaggttgcaaatgtacaaaagttatctttaagtattcttgttcaagtagagaattattgaattttttttaactagaagaaacctaacttgtcatctaatcaaacatatcccatttaataattccctctttgataccactgatagttatctactctcttcaaatagttaagatgaagagaaatctactttttcaaaaggcagaacatttttatattggacagcttgaaatgacaagtaactttttaaaatctgagctgatagtaccttcctctaacttcttgttgttattcctattttatatgttagccttgctattcaaaatgaggttattagaccagccagtatcagcatcacctagaaacctgttagaaatgcaaaatcttcccctcacgcttgctgaatcagggtcagcattaacaaatcccaggtgattcacagacacattacagttggagaagcactactcttaaatatacatgatcaatccttccttccaaaaacaatctttcaaatctttcaagtatgtaaagatggctatcatatctcccaagtagttttttaaaagaatattctcatttatttcaattgttctgtcatattaatgtttggatactattttcttttctttaaagccatgaactgctattaatccagatccatcctgaactttaaaaaaatagatgtagaattaaaaatactgaattttcgtactgaatcccttacagataaatgatagtgtgaagacaaatacataactttaacttttgaatttcgaaaaattaaaaagaaaaaaatggcatgtaagatacatgtgaagtacttctaaaaatggagaatggtaaagtatttgctgtgctgattaatgacataataatttaaaagtagttcaagacactgtaaaacaaatagctatattttaactaagactgtgcaatgtaagactatattcaccttgataaactgacttgcatgttgttcctggtacaagacctgtaccttcttgcttctgcatttcgattatgatatttcctatcatttgcaaagtccttcttcatctttccttgctgggccaatgatcactaattctttaaagtgcagttcaactatcaccctctgcgaaaccttttctaattttcctagtcaaaagttctcttttccacctttaaaagagatctaactatccattatgatttctgggggtatgtcttctttctattcagtttttttaaataggatgagtatctaactcatttttatatagtcaaagcatcttttaaatagtaagctctaaataaatatttattgaacagataaaatctctaataaatctgtttattatgtaaatattaatgtttttatctgcatccttactttgaactttctaaataaatctgaaaacaacattcttttaaaatattcaaatcaatagtccttaacatccattcaattcgtattttcttccatttctgctttgttaagagttggagaatatgtagcattaagggctgcccattgtgtaatggtaagggcttagccaagaggaaggttaagaactagccttgttgtaaggtgctaaggatacaaaaagtgaaagaacaattaataaacaattaatatgaatgtataaacaatatcaaataattatttggccagctaaagatactaagctttttctatgttgccattccaactgtaccagaatgctaacaggcatcccagcaggtaatatgcaactaattgatgtttttatgtagtgattcttacaagcagttttatgttttcataaagaaatgttgagattttgtcttttttccttttctcccttaggagggatttcccccccttcctttttaattgtaaaaaatgagacaatcttctttccctcttctcctactttgttggatacaatcaagcttttgtctgatgaactaccttatgctccaactactatttgaatttagattgcagagatagttaaaatcttggctgtgcagtacaacagtagtactgatggcagaatcagtgcaataatttagtctgtgatacatttagaattaggtatgtatttcatagaaggaacagtactgagggatgacaagatataatctcaaaaaatgtaggaaagtactgtgctagttttttaatggatcaaccatcaattcataaatatttggcaacctcagactttctatatactttctaattatttgtttctgacttatatccattttcctacccataatcttaagcattccaggctccccaaatcccattctcagtactgcttgaccattgcaaacagcactgatctccccgcttctttgagttcttgttacttttataaaatgtatcataccaagtagcaattcacaaatgtcattattttgtttaaacaggagcctaatttctctaaatgaattttaaaaccagtgagtatatatcccctcttttataccctttaacacagggcaaatgcataagatttgctctgtatgaataacccttcctcctcttctctgactcacattttaagcaatatgttattaagaagtctcttacattgtgaaacaaaaaatgccacccatcacctataaaaaagatagtgagtaccaaggcacaagtaccctgcttttaattgaattgaggttatcttcctgcattccctaaatgcctgataatatatgacaaaggcaggtaggcaaacaaacgcaaggcatactagattctttcatgcaagatttcttagaacctttaatcctttagggatatcaaatgaaacctttccccaacttatttagctaagaaacctttctttgcctaaaatgcctatttatgaattgagcaagaccattaccactgttctgagctatgcagctttagaaatgacaggatctcaaatggccctagtaatctctactttagcaactaagatctattatcagtattttaaaaatagagaattcatttatagaatacatttgattttaattcaccataatattttaaatacagagacataaaggtttaccgaacaagggacaagagaaaaggggagaggatatgtcgacttcttggtggtagtacaagtcctcttttatggtatgctattaaacatattttcttccaaggctttctctataattttggtgtttactggtttttattcctgctttgtgtgtctgaattaacactaatcttttctcttttttcttttgagatgtaatatatatatataaagtggggagcactaatgttttcaccacctagaccacataatcgctaactctgtcacattggcttcaattttttttttctaatacacagtatatcagtgaatatcaatagttatatcattcactcaagaagtacttattgagaaccaactatgttagtgctgtgctaaacattagattggatggtgaataaaatagccacatgacctgttgttaaacatcttacaatcaatctggtgggagaaagacaaatattgacagaaataattataagctgaaatgctatgaaagtgaagtaccaattagcctttctcaactgagattccaagagagaactgacccctactgataatgatttaagtgattgtctcaattctattgagactggcacatagctagtatcatcttagaatataggaaataagttaattcattacctgtgggtgatgaacggtgtcttaaagcatcagagccagttgagaagggatggtacagactctgtgatagagaactgacctagtgtttggtggtggtggtagtggtggtgagtggtcagtcaggaggccagttacctaacgaagtgcagtttgtgttgaaaactgaaggatgggtaaggtacgaggtcagggttggatggggtagtagtgtgaaaggctgccttttcaggaaatagcatatttgaaggctctgagaaacaaggagcaagctgattttggagaattaaaagaagaccaatatggcaaatgtacagagaaggggaggtgggcaggaataacaaaacctaagattgaaaagaaggcaggcaggcagggaccagaaagaataagtcaaactgcatcacaaagatcactgtggctctactgggctatagtagtaagaggggaggaggaagaccagtgagaaagcatctacagtaattaaggtgagagatacgtgcttggactagggtagtgatggcagggatggagagaagtagacagacttgagtggtacttgcaagggaaatgttaagggtagtgaaggatgtgttaaagatgactcacaggttctgggtagatgatgctgctacaaattggaggaaaaaagtctgcatactaaactttcaaatatgttttaggtttgacgtaattttgagatatctgaagatgtcgaggagacaactgcatatatcaatctggagtagaaagaatgggtttggcttgtagttccttcattaagagaaaaataagggaggatgggcagagaccttgagaagccatcaggcttatgtggcacacactgaaaagcaagatgtgtatatatatatatacatatacatatatatatatatatatatatatatatacacatatgtgtgtgtatatctatatatatatatcgcacgtgtgtcatgcaggaaaaaaattgatacatgcaaaggttgagaaaaagaggtagaaaaaattagatagaatggttttcttaatttgttttccatcctcatgtgaaaaactgcccaagacagttacaggcccaagttatctataagctattgctacactgtaaatgctttctactttttttttcaaagtagttttaatttatctgataacataagttccaaaattagatactcagctgatattgaaccactaagcaattttcttgtaaatatattctgaagcaaaaaacccacatagatctgttcttttccttttttaatgctgtttggtattttcactctaccttctatgtaaattaagccaatttcacaattttaatatttttgcattactttggagaaatataaagaatattacccttacaattacatagtatcatattaaccaaaattttactaatatgtaagtggttttgtttaagtcattgctaaaatacaaaatactaaaagtttacctttgggtggtttagtacatggtacactggatttttcactttactgactatttaaaataagctttgataaaaatgaaatgtcaaataaagtccttattgaaagaaagcaagaaaatctcttgtagtactttgttaaagaagacaagtaattatactccaaccctgtatttttgtgcttaaataactatgatcatagatttattctttaatttacgccagttattggaatgcttttataatctcttatttcaattcgttacataccagttagcaatgtccttgtgagctactaaattttgaagaaacgcttgtaatcctaattgtctgtcttctaaaaagtcagcattgtaattatctttaaaccagcgttttggaggaagtgctagtcgaaaacctggaaacatctcttttaactgaaaaagaagaaaagagcaaatacaatgtttaactcaagcactatcaattctacaaaatctatcctgttgactacatgaaattattcatgaaataagtttaaaataaaagaattaaattcagttaagctttttatgccttgttttatttcttgttttctaccagctgtgtatacagaagagttccagtctttccacatccttgccagaacttggcattgtccatcttttgaatgttaaccattttagtgggggtgtagaaccatttcattctggctataatttgcatttctttgctgacaaatgaagttgaatatcttctcatctgcttatttgcatttgagtatcttcaatggtgaattatgtattaaattttttagcaccttccctttaaaaaaattaggttgcctaagttataagagttctttatatatttcagatacaagtcctttgtcagatacatgcattacaaatattttctcccaacttggcctgacttttcaatttgtcttaacagagcagattttttttaattttaatgttatttaattcatccattgtttcttttatggtttatgcttttttttagatcataaaaaaagtctgcttactccaaggctgtaaagattttcttctatgtgtctttcctaaaagtttagttttaacttttatattctggttatgacctattttatacatttggcttaaattttactttcttagggaagactttcccaaccctgtaaactaagtgaagtcttcccttttacattctgttcaagttaccacaactgtgtaacaaattacctaaaatctcagtgatacaagataaccatttcttaatattaagctcacagattttttaggtcaataattcatatgaggtacagtaaggatgatatatctctattatgcaatgaattcaggcctcagctgaaagacttgaaggctgggtgctggaactgtctgaagttcactcacttacatctatagtggatgatgctggctgctggctgagaactttgccaaggttgtcagccataagcctaatactggcctctccaggtgtcttggacttttcttgcagcatggaggctggcttcaaaagggagcattccaagaaagcaagccagaatgaaactgtgcacttcttgtaatctaggcttaaaactcacacagcattatttccactgacctctattgggttgagtagtcgcaagaccatccaggttcaaggggaggggaaatgtattctatctcttgatgggcagtggcaagattcaggaagagcatatgggactaaacatactgctgtggccacttttagaaaagacaaactgacacacattgtcaaatcatgaatttatttctttaatgacatcattcacaatgtaaacagcacatttaatttaggctgtcttagtagaccagtgattctaaactctggctgcacattagaatcacccaggagttttaaaagatattaatgattgtttcccatctctgatagattaggatttaattagttgaaatgaggcctgggcattgtaattttaaaaagctttccagtggaatccaaagtgtaattaagattgagaaccattttactacactacaattattatgcatgccttagtcatagttgcatctttaatgtctagcatagtgcctgctacataacaagcagtcaacaatatatgttcaataaatgaatgactgaaatgaatccgtgtatgtttgcatttctatacttaaatataaaatgaatatcacaactacaaaggaaaaatgcactgcataaaatagtggaaaaatggtaaattataacattctgtctatatttctataaacgtgaagataaaataaataaggcaaaaactagagaataacttagataactaaaaccttaatttgatttcaagatgtaattagatatttatggccttggagctttgatatttaatgtatctggacagaaaattaaataacaaaagacatgagggaaatgaaaataggctttttattaattttaagctttataatttaaattataaaaaccatttacaatttaaatggttagattttttttttccccttaaaaaattgtccacagaaaagaaggagttgtcccacaattgggtaattcaagaagaggaagataagggatagagaaaataagatccaacaaaggagagaaatgaaaaaaaattgccagaaagacagtgaaaggcaatctcaggatgccacttacaaagctcatatggagggcagatcagtttaggagagagcagcgtgactcaagagacagacatgtggaagaatataactgaacttctttttaatgtgaggactgaatgcctggttgcatctgccacagattttttatatgaacctggaatgtcttgacaatgagttggtaaggtcctgctctctctctccctatgctctgctgcctggaagcaactgagaacagtaattttacctcacagaaatgttcagctttgtcctactgctgtaacctggaagtagaaatattgagcttcaattttaaatagaatttagaaaaaaactcacttctcatggccatatttctacaatcaatgcatctcccagtccaccctaaaaccccgcctggttgccccaactctgataagccctgtgcattccagaatttgctcatgactttgtcctctgacttcctcagcagaggctcttatcactcccagagaagttgaagtcagaccataacccaggaaataaaaataaaacaaaaagaaaatattaatgttctatataaatgttctctttctaagcagtgttattttagcacattcaataatttttgtattgccaattagctatttgtacttcacaactatataactgggaaatgtaaattccttaaagttagaatcacatctatatagtttctacataagagtaactccaaattcctagcacaatgctgaactctatctactcatttcataaatacttcatgattgattttgtaaaatgaaaaatcctaagcttttattttttacaattatatcaatgataactacaatttaaactgtgtgtttcttagtgtttgacatactttttaaaaatattgccagtaaaagcaactgatgggtagagctctttctggtacctataacaccaacataaacacttattaattttaaatgcccatcttggaggatcaaggagatatttactaaatttaaattaaactcctatcatcttttttctaaaagatttatctaaatttcagcttgcctaagaaaatacttcagcaataaagatgaaatctaaagagataataggaagtaaacactaaataacagtatagtctgaaaagaaaaataatggattttttttcataaaggattaaataggtctacaatgaaactgtttgaaattagtctgcatgatcaaaattgtaataatttcattaaaaactaagtattccacttaactatcaggtaacttcatgaattgcttttatctttcggcttgtttagtcatttaaaaaaattaacagaagtacagaattatagatttcaaattcatcagtataatatatgaagctcaggaacagtaaataaaattcatatataactgtaggtatacattaaaaataacactttattttggcatattacaagaaagcatcttaaccaaatcttaaaatggataaaataatttagcattccatattttaccttttcatttaaactgaggtttttacagtggcagaaaaatttggcagctaaataactacaaagttacatgggtttcccatcaccaaacactataaaaatatactaactttaaagcttcaaggagtccaaagaaggaggaaaggacaagtcacaaatgggagagaacaggaccagtacagctttcttattaaacacctgtcaaaattggagagtaatttctgcatgttctaagatcatcttacttggcctctcagaagcataatgaactgcttgcttcttttagataaatgatttttctcttggcttccaaaatatcacaccctctgcctcctgccccatctaaatttcctctagctctggggacaaggcagctcttcttttgctattatattctaataataatttacttaattcttcacttttagaaatttaggttgcttccaacttttaactactaaaagcaaagtaaaacacagataaacaaaacaatatacaaaacactgtggtaagtgcccttaaagctaaatatttcccatgtttatgactacttatatatgataaatcctagaaatgtgattattatgttaaattatgcaaaacttttgggtatcccctaggaagattcatacttccaacgctgggtattatcatttaaatatctgtcagcttgacaggtgaaaaagagtgtcttagtttccttttcttggagtatctgtgatattaagtgttttccaggtttattgatcatttatgtttcttctgtgaattatcctgctcatactgtttgttgcattttttactttggggttcactttcctaatttagttttaagggttcttaatacactgaggtttattattcttctgttttgtatgcacagtagacagaattctagatggtccatgatctttgcctctggtgttacttctgtgattttattatgttacatagaaaaaggattttgcagctgtaattaaggttactaatcaattgaccttaagctaagattatctgggtgagccttatcttaccacctgatccctttagactgttttctctagctggtggcagaggagaaagtcaaagagcttcaaagtacaggaagaacttggctcactgttgctggctttgaagatggaggggctatgtacaaggactggagagtagtctctatgaagtatgaatgatttctggctgacaatcagccaggaaacagaaaatttggccctacaacttcaagaaactaaattctgccaacaacctgaataagcttggaaggtaattctcctccagagcctccagataagtgcccagcccagctaacagcttgattttgactttgcttgatgctaagcaaggaacccagctgaacccacccacaccactaaataataaacaggtgttaatttaagcaacaaagtttgtggtaatttattatgcagtaataggaaactaatacaatatgttaaatatgtttttgttcattatcttatagacatatataattttataataattcaaaagatcttatacacatctttttcagactcacaagataattatttatatttctgttggcaattttaaagtttcacatttttatgctaaaaatttttattttaaaaatttatttaaaaaattaattttcttatgaactagaatgaatttgactcattaacaaagaaaaaatataacagaagtataggaaacagaaaagaattcaaaactgaaatgttagtttggatttattatagtacttactttgtcattaagcctagagaagtcagtgtatcttctgaaaactacccagctttcttctggggttttctttactagtattttatatacctatgcacaggaagaaaaacagacggagagaaaaatataaaagtaaagatatttaaaaactcaagccaaatattttaaaaaattttacttgataacccagactataacaattattatgtaaaaaatatcaaaaatcatttaaattatcaaaagtacaaataatcaatgcaggcaccaaaagccagattttttccttaggaaatataacagatttgagacaaaacgctttttctgtgcacactaacaataaactcatcagcttccaaaacatgatttatgtcaatatattctaaaattgattaaaaaattatacttgaagaagctatgaaaaatagccacttttgttctacacaatttttaaacttaataactatcaagcaaagttttcaaataagttcaatgtttttattgccaagaataaaatatggaagtcctagccaaagcaatcaggcaagatataaataaaaagcatccaaataggaaaagaagaagtcaaactatgtgattctatgcctagaaaaccctaaaaactctgcgaaaaggctctgggaactgataaaggacttcagtaaaatttcaggatataaaatcaatgtttaaaaatgaatagtatttccatacaccaataacattcaagctgagagccaaatcaagaatgcaatcccatttacagtagttacacacaaaaaaaccacctaggcatacatctaatcatggagaggaaagatctctacagggagaactacaaaacactgctgaaagaaatcacagggccgggtgtggtggctcacacctgtaatcccagcattttgggaggccgaggtgggcggatcatgggggtcaggagatcgagaccatcctggctaacacagtgcaaccccatctctactaaaatacaaaaaaaattagccgggcacggtggcaggcgcctgtagtcccagttacttgggaggctgaggcaggagaatggcatgaacccaggaggcggagcttgcagtgagctgacattgcaccactgcactccagcctgggtgacgacagagcaagactccgtctagggggtaaaaaaaaaaaaaaaaaaaaaagagaaatcacagataacacaaagaaacagaagaacattccatgctcatggattggaagaatcaatatcattaaaatggccacactgcccaaagcagtctatagattcaatggtattcctatcgaactaccaacatcattctccacagaattagaaaaaaactactctaaaatccacatggcaccaaaaaagagctgaaatagccaaagcaatcctaagtgaaatgaacaaagccagaggcatcacactacctgacttcaaattatattacaagcctacaataaccaaaacagcatggtactggtacaaatacagacatataaaccaatggaagataatagagaacccagaaataaaactgcacacctacagccatctgttctctgacaaagttgacaaaaataagcatagggaagcgatcccctgttcaataagcagggcttggataactggctagctatatgcagaaaaatgaaactggagctctatctttcactatatacaaaaattaactcaagatggattaaagatttaaaggtaaggccacaaactataagagtcccagaagaaaacctatgaaacaccattctggacatcggccttgggaaagaatttatgactaagttctcaaaagcaactgcaacaaaaacaaaacttgatgtgagacctaattaaaataaagtttctgcacagcaaaagaaactatcaatggaataaagagacaacctacagaatgggagaaaatatttgtaaactatgcatctggcaaaggtctaatatccagaatccataaggaacataaacaattcaaggctgggtgcagtggctcatgcctgtatctcagctctttgggaggctgaggtgggcagatcacttgaggtcaggggtttgagaccagcctggtcaacatggtatggtgaaaccccgcctctactaaaaatacaaaaattagccagatgtggtggtgggtgcctgtaatcccagctactcgggaggctgagatgggagaattgcttgaacctgggaggcagaggttgcagtgagccaagatcacaccactgcactctagcgagtgacagagtgagactccgtcaaaaaaaaaaaaaaaaaaaggaacttaaacaattcaacaaataacctcattaaaagtaggcaaaagacatgaacagatacttcttaaaagaagacatacaagcagctaagaaacataaaaaaaatgctcaacaacactactcatcagaaaaatgtaaatcaaaaccacaatgagataccatctcacagaagtcagaatggctatcagtcattatcatgacagatgctggtgatgttatggagaaaagagagcacttatatattgctggtagaactgtaacttaattcagcaactgtggaaagcagtttggagatttctcaaagaacttaaaacagaactcccatttgacacagcaatcccattcctgggtatatatccaaaagaaaacaaattgttctaccaaaaagacatatacacttacatgttcattgcacaaactactcacaatggcaaagacatggaatcatcctagctgtccatcaaggatagatttgataaggaaaatgtggtacagatacaccatggaatactatatagccataaaaaagaatcaaatcatgtcctttgcagcaacatgtatagaggtacaggccattatcctaagtgaattaatgcaggaacagaaaaccaaatacctaatgttctcacttataagtgggaggtaaacattgggaactcatggacataaagatagcaacaatagacactggggactcctagtggagaaggatgaaggggggaaggagttgaaaaactgttgggtactatgctcactacttgggtgatgggttcattagtatcccgcaatatacctatgtaacaaacctgcacatgtatcctttgaatctaaaatgaaagttgaaattattgtaaaatagggcaaaatataagcttgaaataccaaaaaaccccaactgaataaaatttacatttttgtaattatgtacaattatgtaggctactgagtagaaaaacttggttgaagcaagtcaatgtatttttaaaagcacctaaggaaaaagtggattctattttttataagtatgcttttagaatgtattaagagaaagtgttatttatgatagaatctcagagaagcatctagtagttttgatacggtattttgcactaagctacatataggcacatacgagatactcaataaatatttgctgaataagaaactctctttaaaaaagtaacttcttttctggacatttgctgtgcaacaattttcaactgcagctctagagctgcacttttggtcacacatggcaattgagcactcaatgtgtgactagtcaaaattgagatgtgcgtagtgtgcaacatatacactgaatttcaaagatttaatgtgaaaaaagatgtaaacagcttttattaaaatggtctaatactaactacatgttaaaatgataatattttggacatattaggttgaataagatatattaataaaataatttcacctatttctttttttttttaatgtggctcctaagaaatttaaaattacagatgtgattcacaattactgctcacattatacttctattggacagtgctgccctaaagaccattcattagttagggactatagattatccttaccctttgatttttctcccatacaaacttctctttcagcttttaagggagagaataaggaggagttaaggataaatcctttagctttgaagtttaaaaaaataaagcaatttatctttgtaacatctaagggtgggaaacaaggttactcggatactctttaaagtcagcagaaggtcctgatctaaaaaagttgcaatgggaatacaaaagaaattctttttaggagtcactcattaaaagaagagagaagtcgactttaaaacttttgagtatgaatgactgatacaggataaaagtgcacttcatataataattaggaatatctacaaataatacatactgactttattttcttgtcttagaaaatgaactcccccttctaaataagctactctccactgtggccactgaatacccctgtttctctagcaagataaaatacgacttttgtgttctatctcttctagaaagtgctttctacttgtttaagtagtgctttcaatgaaaactttatgaacagtactgatcattcccttctctatattccaataactgttgttgtttctactctttatttgaagtttcatatgtatttccttgtactgtttttattttaatgtagttgtttttgaattataaaatatatacaaaaagtgtgcaattcataagcgtacaacttgacaaatttcacaaaatgaacacacctaaagtactatgagtgtattagtccatttcatgctgctgagagacatacctgagactgggcaatttacaaaagaaagaggtttactggacttacagttccatgtggctagggaggccttataatcatggtggaaagtgaaggcacatctcacatggcagcagacaaaagaagagagcttgtgcaaggacattcccatttttaaaaccatcagatatcatgagacttacccactatcacaagaacagcatgggaaagacctgcccccattgttcaattacctcccactgggtccctcccacaacatgtgggaattcaagatgagatttgggtggggacacattcaaaccatatcattccacccctggcccctcccaaatctcatgtcctcacatttcaaaactaatagtgccttccagacagtcccccaaagacttaactcatttcagcattaactcaaaagtccacagtccaaattcttatacgagacaagaagtcccttccgtctatgagcctataaaatcaaaagcaagctagttacttactagatacaatgagggtacaggcattgggtaaatacaagcatcccaaatgggagaaattggctaaaacaaaggggctacaggcccaatgcaagtctgaaatccagcagggtagtcaaatcttaaagctccaaaatactttcctttgactccatgtctagttcatgtctgggtcctgctcatgcaagaggtgggctcccatggccttgggcagctccacccctggggctttgcaggatatagccctcctccttcctggctgcttttatgagccgtggcttttccaggtgcatggtgcaagctgttggtggatctacctttctaggacctggaggatgatggccctcctctcacagctccactagacagtgccccagtagggactctgtatggggctctgaccccacatttcccttccacacagccctagcagcagttttccatgagggccctgcccctacagcaaacttctgcctgggcatccaggcatttccatacatcatctgaaatctaggcagaggttcccaaacctcaattcttgacttctgtgcactcacaggctcaacactatgtggcagctgccaaggcttggggattacaccctctgaagtcacggcctgagctctatgttggcccctgtcagccatggctggagcggctgggacgcagggcaccaagcctctaggctgcacatagcacagggaccctgggcccagtccacaaaaccacgttttcctcctacgcctttgggcttgtgatgggaggggctgccatgaagacctctcatatgccctggagacatcttccccattgtcttggggattaacattgggttccttattacttatgcaaatttctacagccagcttgaatttctcctcagaaaatgggattttactttctattgcactgtcaggctgcaaattttccaaacttttatgctgtgcttccgttataaaactgaatgcctttagtagcacccaagtcacctcttgaatgctttgctgcttagaaatttcttccgccagataccctaaatcatccctctcaagttcaaagttccagaaatctctagggcaggggcaaaatgccgccaatctctttgctaaacctaacaagaattaccttttctccatttcccaacaagttcctcatctccaactaagactacctcagcctggactgtagaaagaggtttatttgacttacagttccacatggctgggaggcctcacaatcatgatggaaggtgaaaggcaagtctcacatgctggcagacaagagaggacagcttgtgcagggagactcccgcttttaaaaccatcagatcttgtgagacttattcactatcacaagaacagtatgggaaagacctgccccaatgattgccccttgtccctcatctgagacaaggcaagtcccttttgcctatcagcttgtaaaatcaaaagcaagttagctatacttcctaattacctcccaccaggtctctcccacaacacatgggaattaaatgagatttaggtggggacacagccaaaccatatcagtgagcaagaaatgaaacattaccaatcaaagaggtccatagcatgcttccttcccaattctactcactacacatcctagtcaatttttgtctttaaacaacctttttaaagactagacaccttatatattatcagatcaagagtgagtcctaatacttttttcagttatgagagcaattcaaaagaatatatctagaaaaaattattttacaaacctaagattctcaagtttgtatctccagcttatacctctcccttaaactcagcttatatgtatacacacacattacatatgtatgtgtacacattaacacatgtaacatctccatttcaatgttgaacagacatatcaaatctagcatgtctaaaaacaaattttgatcatccctcaaaacctgtcatttaattaaatggcagccatatcttcccattgtttaggccaaaacttttgaagtcacctttgacctctctttctcccacactccacttccaaatcattaggaaatattgccggttctacttttaaaacaaatccagaacctgatcacttctcaggacttcctccaccaccccagtccacactaccatcatgtttcccttggattactaaaagaacctactaactgcttcctgctttgactgtcccccatctcgaccaaaccagtctcaattcagtagccagaatgaactttttaaaacattgtcagatcacatgactcttcttttaaaaaccttttaaaagattctcatctcatgcagagtaaaatccaaagtcttcacagtgcctccttccctatgtgatctgtgtgccacacttccctgcctgtcatctcattccctacacctcccacagcttactctgctgtcagccacaaggatctttgtagttgtcccatctgtgttgaaaacacattctcatggctcattccctgttagcactaacatctttttgtgaggccatgactgatagtgctatttaaatcccaaccccagatttggggaaactccctgtcttccttctctgttttatttctctctatagtgcttatcaccatgtgacatatcaggcgtcttattatttacttacttatcatgctttcattcaaattgctgtaccactattacccagaacagtgcctgaggcataataggtaattaaaaaaatgttgagttaataaataaatgaatatgactaatttcatatctgtcatttacttcctcctctccagtctcttgaaatgctttacataacaccaccttgtatttggccaaatacttgcatcttcacacatatcatctgtcttagtctgttaggtctgttataacaaaataccataaatttggtagcttgtaaacaaagaaatttatttctcaaagttctaaagtctgagaagtccaagatcaagacagtaacagatttggtatctggagagggcctactttctggtttatagatggtgccttatagctatgtcctcagatgtgtaaaggacaaaaagctctctggggcctctttttaagggtcctaatcctatttatgggggctctgctcccatgacctactggcttccaaaagctccatctcttaataccatcaccttgaaggttaggtttcaacatatgaattttgaaggaacgcacattcagaccatagtatcaactcaataaatgcctatttcttaattcaggaaattggccatcagtttatattttctaaaaattttctaaaaagagagagagagacagagttccctgaagatttcctatatcacagtcttatgataattttaaagactgcctcttcataaattatctcaacaatttttccttggaggtcctcccatcctgtcataaatttacagcatgaaacattgaagtaaacattaaactttactaaaagaacaaagtcttaccaaaaaagtaaaccttttgagttaataagagagttgagcaaggttgctggatatgtaaacataaaaggacaaattatataaaatagcagtaaatagaaaacaaaaatagatgtctctcacaagaacatcaaacaacatccatatcctgaaataaatctaaccaacagatgtaagaaccctgcaccaaaaacaacaaaacattactagaaaaaaatgacttaagtaaatggattaggttcatagatttgaaaactcagtaaagatgtcagttctccccagattaatctatagatctaacaaaatctcaatgcaaagggtgaagaatagccaaggccatcctgaagaaaaaagctaaagtacatacactgctacatatcaagacctattataagactttattaattaagacagtgtgaaattagtaaaggatgaaaaaatagaacacagaagcagacccatgcatttatggtcacatgatttatgacacagacaacactgaaaatgaagaggagagagagtggtctttcaaataaaagcctgattaattggtcccatctggaaaaaaaaaaaaaaaaagacttgaccctcacctcacaccatggacaaaaatcaattctggtggtttacgaatctaaatgtgaaaggtccaacaataaagattttagaagaaaacataggacagtatctttgtagccttggagtaggcaaagatttcaaaaagtgctagccattaaaaaaagtaataaatcaagccaaattaaaattaagaacttttgtttatcaaatgtattattaaggaattgaaaaggcaaaccacagagtgagaggatagtcataatacatgtatctgaaaaaaaaattatatccaaagtgcacagaaaactacaaatcaaaagggagacttcccaaaagaaaaatgaacaaaaatcatgcacagatatttcacaagagaatatccaaacagcccaaaaaaattttaaattcaattagtcattaagaaaattcaaattaaaaccacaaccaatgtgatattactctgtacccatgagaacagctgaaatgataaaaatgttaaaatatcacatgttaggaagctatggatcaactggaactcttatatgctgcttttaggagtataaatcagtacaaccattctgaaacactgttcaccaatatcttttaaagctgggcatgtaatttggcaaggctaaagaaaagagaccagatgcaaaaagagtatataattccatttagataaagtacaaaaataggcaaaattaatctaggctatacaaaagtattgggtgaatgggtcctgactggcagagaacctagagcatttaagattctagtaacgttcttttccttgatttatgtgctattaatagttacataggtgtgtctggtttgtgaaaatttattaaggtaaagcaaaagtttactacaacatgatagaattcagtggtgtaaaaaccattagaatttcatattcaagaaattataagtacaagtttacattaatttaacactggtttgaacacagagattagccaatctttcactttgtagtgttatacagcagaagtcaatacttacagtaaatttagctctttcttccatcacttcataacccagtatagtaggtgtagatggtctatcttcccaattcactgtttccggattttgttcttcagtgtctcttggtctagtagaatactcaatggaagaagctgtacctgtaaatttagtcctaatgaggggactgctacagacagatgaagtattatccatttgatcaggaacacttgtctgtttaaaattacccatatttgagtcttctaactggcccttagaagaatttgagcttgttgagacactgccaaaagaagaacttctttgatttctgtttgttgtaaaactggaagcagagtttcctatgggcataggaactgggacataaggagttgccatcttcttttggcttttccaacaagcttgcacactgttgagtccacttagagaacaactaatatgcaatccattattttcttcttaggaattcactatctaaaaatgaaaaggacatattaaaaggttagtctttaatgtgcagcaggattcaaaagaaaagtattcttttcaattttatgacactattattttatttggaatgaaaacatacctcaaaccccttctcccagttgtctttaaggactcctatttgcaagatagagagagcaaaactacttcacactctttttccttgactccatgttacatgttatccctttttcctctactttattcccttgtgaagtatttctgtaaagttcattttaacctgatttcatgtatgtaaaagttggtaggagaaagattggtaaagacccttctgaagctttattccatgcttatcatcttgacagtactacattcagtacaagagagaaaaaagaaaaggaagaaaactatttacattacctctggatttaatcagaaagggaggaaatctattcacattacctttcaatttaattagtgaaactataaagatttacacagagtagtaacaatgaaccagatgctttgatgctacatagtataattctatagaacccaggattaaaaatacacacttggtcaagttactcaaataaaacccagtgaacactgaacttatatgcaacaaaattaaatagtgaaaattgtaaccgttcttcacagcttacaggtcatcactaattctgctctacgataaactgagggtatttaaatctttataacttacactcaagaatctgttatcaaacggaccagtatatcttgtgtcagaatagtatcataacacaaagaagaaatggtttactattactttgttaaataataaactcataagaaactgtaacaactacagaccaacaaaatgacaagactacacacaacaataactgcccaacttttcatacgaaactctactggtgggaaaggtaagaaatgagtcacctggacttggaaagatgctgaaataagatttttaactctgggctgggcgctgtggctcacgcctgtaatcccagcactttgggaggatgaagcgggtggatcgcctgaggtcaggagttcgaggctagcctggccaacatggtgaaaccccgtctctactaaaaatacaaaaattagccgggcatggtggcgcaggcctataatcccagctacttgggaggctgaggcaggagaatcgcttgaacccgggaggcggaggttgcagtttgccgagatcgtgccattgcactccagcctgggctacaagaggaaaactccgtctcaaaaaaaaaaaaaaaaaagatttttaactcaagtggctctcggcaacatttccccattatcaaagattcatgaaactttagctgctgattcaccgctcctcggttccgcctgacggcctccccaaaaacaagtaagtctgaaatctcaaccttctcaaggtccgagggatctacctggcctttgccactctactacctgaggccgcctggctggggggaggtcgcatatcaatacatatcaacacaaccactgacgtccgaagatgtgagcgctacccaagcgttaaaaaaacaaaacaagcaaacaaacaaacaaaaaaacgtgctgtgctcattaggagcgtcttcgcctctaccctgatgcggagttgctcccaggacgctcagttcattctcactctggaaaacctcaggtgaggtggcccgactctgagcaaccccgtgggcgggaggaaagaggcaaataccaggcacagttcgaccctcggaaggtaaggccggggtctgcgccggtcacgggtcttccgcactgcaggcggcgagacccgcagctccctgggatcacagactctcccgcctccgctgaccggtgcgcgcccagcgcctcccagacgcacagtggggtcggcggtggcctgaaggtggctgggcttcctgcggcgcctctccactctcccgcggagccccttgccgcccgccagacatcaaggttgcaggtgtcacccgtacgagaacccgggacagcgaccgcctgtcctgaggtaatgacccagtctttacctcagccccctcggcgatcccgaacgagcgcgcttcccggtgacggttaaaccggactctccttaaccgcagcttttcgcctcctccctcagcagcgagaagcctcacgtgacacccccgccccaaaagcagctgctccccgcctcagccagtctctgcccgggc

SEQ ID NO: 1757 - DNA, 42705 bp, Homo sapiens; identical to SEQ ID NO: 1756

SEQ ID NO: 1758 - DNA, 42705 bp, Homo sapiens; identical to SEQ ID NO: 1756

SEQ ID NO: 1759 - DNA, 64967 bp, Homo sapiens
caataggatgctcagccggaggtggccctgcgcgtgacgcagcggtgctcggaggcagggggcgtaggggccgggctgtccggcgctttagcttagcaggcgacgttgcgggccctgggcgccaggagagcttcccggagtcgaccttcctgctggctgctctgtgaccgcttcccggctctgccctcttggccgaagtgcccgctgccgggcgcgggcctcaggtaacggtggtgctcccgcgcctctcctcgcttcccgcttgggtccaccggcctcagcccgcggggaagggagaagcggtggcggcagcagctccggcccggccttgtcctgggctgtgctgcggagaaggcgaggctcggcgactgcaggggagttggggaggggagggcgggaaagttaccgtcaggcgcccgggtcacgggcagccttttaaaccctgcacgctggtttggtgttccgcaaatctcgtggcatctctcaagtcagtagtaaagaaagttaggaattagaagacgttttattctttaaaaagcgaaaccaaaaatgcactcaggaagtcagctttttaatgatttagagaaaatgtgtgaagggaaggatggtattagcaagacatgaaaatctgtaggggcaccagaacctttaatcaagctcatgttttattgtaaaatattaggatgtaggtaagtttctgttttccctaagtgttaatggtcatgtaatttaaataatatgtatattgaaaggttatttctaagtgagaaacaactatataaactttattctccgtatatatatttaggttaagttcgttggtcacttttgtttgtttgagacggagtctcgctgtgtcgcaaggctggagtgcagtggcgcaatctcggctcactgcaacctctgcctcccgggttcaagcgattcttgtgcctcagcctcctgagtagctgggattacaggcgtgcgccaccacgcccaggtaatttttgtagttttagtagagacggggtttcaccatgttggaccaggttggtctcaaactcctgacctcaagtgatccgcccgcttcggcctcccaaagtgctgggattacaggcgtgagccaccgcgcctggcctgttggtcactttttaatatttaagtggctgccacctgtttaaaccacttttttctttttttcagcctgcttgatttcctcttccttgaagtagaattcaatttgaagctttttttttttctttttaaaagttgggcggtgtcagtgaatgacttgttaaggaagtctgtgcgttgtctgggtgtgagaatgggttttggaaggagctctgtggcactgaattatcgtttagaaatgcacgtgttttagtgaatcacatgcttagaatgcatctgaggtttcgcagtcttttaggataaagacctactgagtgagcacactctatctctggttcatttggcccactttccttctggctttccaggttcatgccacactggctttatttttgttactggaaagcttcattttctttcctctcttggcttttaggagtttcctccacctctaatgctgtattctctccctccctccaactcttatacctgcctcagatatcagcccacatatcacttcctctggaaatcaccccatccccattaagccctccatgaactctttattctccttagcagaagttgatcattaattgtaatgaattagttgctttgtttcctctgctagtgcatttcatgaaggctggtttagcctgttgtaattttcagggtctggtccagcacttggcccagagaaagaatgaataagttggtggacagaggaaggaacttttgaatgagaaatacagtgatccccacttaactgctttctgtagtttcagctacctgaggtgcgaaacagagtacaataagacatttcgagagataccatgttcaagtgaattttaatacagtatattgttaatctcttactgtgcctaactttttgaaactttgcctcccaggttcaagggatattcatgccccagcctcccaagtagctgggattacaggcgtgtcccagtacgcccggctaatttttttttttttttttgagatggagtttggcgcttgttgcccaggctggaatggcacgatctcggctccccgcaacctccgcctcccgggttcaagcgattctccgcctcagcctcccaagtagctgggattacgggcatgtgctaccacgcccggctaatttttttttttttttttttttttttttttttttttagtaaagactgatcagatcttactggtcaggctggtctcgaacttccaacctcaggtgatccacccgcctcagcctcccaaagtgctgggattacaggcgtgagccaccgcgcccagctcacccggctaatttttgtatttttagtagagacagggagggtttcactgtgttggccagactggtctcaaactcctgatctcagatgatcggtctgcctcggcctcccaaagaggtgggattacaggcgtgagccactgtgcccagcctgtaaatgaaactttataataggtatgtataggaaaaaacaacgtgtattgggttcactgttattcacagttctaggcatccactgggagtcttggaccgtatcccccatggatatgggagaactactgtattaaccagggaagagtccctttttcctatgggaaaaagtttttaacaaagaccagccaagttctatttttctaagaggatggctttgttttgcattttttttgccacattggttaataagagattatactaaccatacagatgtaaatgagaatttgttcttgttctttagttttgctaattacttaaagacctagttctgtgatatgtaaaagttgtagcgttgtgttagggccaacctttgggtgccagagggaaattttttttgctctggattgtaaattctatccacagttgtgtcccctttccaccactgaatctaagggtgatgtggcaaagttctttacctggagtaggcactcagtatttgtgatacagatttatgggctcttttgaaagctgtattaatgggaacacggaggcaggctaaagttgacatgtctttccaagttcatttgtttctcaaatcatttctttttgttttgctttcttaagataagttagatgcttatcacactgaacattatgtaattgcgtgcacagattagattcttaagaaattctttttcaatcagtgtgttgtataaatagctgtctacttagctttgttacctgggggggaatagctttatgttacctgtgactttgaacaagtttgttagcatttctgaatctcctgcatctttaaaaatggacatgttaaatgagatatgtgctacacctactgcactcagcactttgttacctgcttcctaaacgctagagattccttcactgctagacctcttgagagactagtcttatgatcactgttttcacttcctcaacttactggcggtgtactccaatatatttatttgtccttcctcctaaaactgtgcatgtaatcaaatcatagctattaatgtcccccaattgtgaaatatcccatgtcctgtccttttcttttcttttttgagacggagtccagctctgtcacccaggctggagtgcagtggcgcgatctcggctcactgcaacctccgcctcctgggttcaagcaattctctgcttcggcctcccgagtagctgggattacaggcacctgccatcacccctggctaattttttgtatttttagtagagacggggtttcatcatcttggccaggccagtctagaattcctgaccttgtgatccacccgcctcagcctcccaaagtgctgggattacaggcgtgagccggtgcgcttgtttaagaaacagtggaaggccaaagtaatgagtagagaaaatgagacagccaagatcatgccactgcacttcaacctgggcgacatggcatgactccgtctcaaaaaaaaaaaaaaaatgccgggcgcggtggctcacacctgtaatcccagcactttgggaggccgaggcaggcggatcacctgaggttgggagttcgacaccccatctctactaaaaatacaaaattagctgggtgtggtggcctgtaaccccagctgctccagaggctgaggcaggagaatcgcttgaatccaggaggcggaggttgcggtgagctgagatcgtgccattgcactccagtctgaccaacaagagtgaaactctgtctcaaaaaaaaaaaaagattgatggtgtttaagggggtggtggtgagtggcaggcaatgcagaagttactagatcatggtaaggacttaggatgtttgaaggggtttaagttgtgaagtgacttgatctaacttgagtgcaatggtgtgattgaggttcactgcaacctccacctccgggttcaagcgattcttctgcctcagcctcctgagtagctgggactacaggtgcctgccaccacacctggctaattttttgtatttttagtagagacgaggtttcaccgtgctaggctagccaggatggtctcgatctcctgacctggtgatctgcccacctcggcctcccaaagtgctgggattacagatgtattccaccatgcccggccctgttttagcttttgatgtaaggtttcctctagagtagcttgatggttgaggaaccatcttattaccaaggactccctttttatatttcttcttttggagacagggtttcactctgttgtctgggctggagtgcagaggtgcgacctgtgctcactgcaaccttcgcctcctgggttcaagtgattttcctgcctcagcctcctgagtagatgggattacaggtgcttgccaccacgccgggctaaatgttttttgggtagttttagcctagtgtaccttaaatatgctccaaacacttaatattagcctacagttgggcaaaattattgaacacagactattttacaataaagtgttcattatctcatgtaatttattgaatactatactgaaagtgaaaaacagaatagttgtatgagtactcaaaatatgatttccacagaatgcatgttgcttttgcaccatcataaagttgaaaaattttaaattgaaccatcataagttggggactgtcttgtgcttagaataattggttacatattaactgatacatttgctttctttcttaatgcctgcctgttgtactccaggtactccacactagatttgggggagtcttacagaaaatactatgtaatccctatctttgagaacttaagcctaatgtaagagacagagagtattgctctctgattataggacaatgtaacatgtgacaggatgctcagtgtagtgggaccgcagagaggatgagatgagaggtggtggtaaaggaaacttcagagggtgagttggaggcggtttagcgattagagggcaggttgtagaatctgatagtctttgttttgaattctagttctgctgttggagaattatttgatttgggacaagttaaatcacttccctaaactcatctgtaaaatgaggataatacttatctaaggttgtaaagattaaatgtaatgtaaaaagtttagcagcacagtgcctagaggtacataataggtgctcattaaatcagaactgttggtattaattctattactgctgtagctgtgattctttgaaggcttgagtaggagttagctacataaaaaaagggcagaggagaaatagctttctatagacagggaagagtatatgggacactatggtggccaaagaatatttggaaaataacaatagtatctgtcttgattctgttgagatgaaaataatacatgtaaaacacataagcactaaaaaaaatcagctgttattattctactttgagaaatattgcattgtgctatactgtttcatatggcttgggtaataaactttaatctggcatttattttttaatcattttgctatcttttttttttttttttttttttttttgagacggagtcttgctctgttgcccaggctggagtacagtggtgtgatctcagctcactgcaagctccgcctcctgggttcatgccattctcctgcctcagcctcccgagtagctgggactacaggcgcctgcccccatgcccagctaattttttttttttttgtatttttcgtagagatggggtttcactgtattagccaggatggtcttgatctcctgacttcatgatctgcccacctcagcctcccaaagtgctgggattacaggcatgagccaccgcacccggcttcattttgctgtcttttatgctttaaacttttgctatatgctctttaaaagagtatctactttaaattccccatcatctggccagaaaaaaaaagtctctgttcatctggccagaaaaaaaaaaattcccattattccttgtaaaattcctctcttactgaaacatcttggttccttttgtgtctttctttttcttccctgatttcctctactttgaggctgtccctcaaagtttagttttcagttcttacttctctcatcatttctgatgaagagatagatgctcttgtggcttcctctgtcacttttacacagaattggaccattgtaagttgggcatcgtcttgtgatttattagccctgacttttcccttaagttcctcttaattagatcttatgatatcataacatttctacttgatatattcatctgctgttccacaattgtttcatttgtttgatttcagaaataattagaagaaagccgatctagatttgtcagatttttactttgccaagctgtgatagttgaaaaacaaccaaacccaccatgtactatatttcatccttttatacagaaaaggatattttagtacaaaaattaagaaaaactgtagtctcagaatttaaatatatatagctttaaaataatgtaatgagtatttcacagttgttttcttcttgctttagactcttgaaaactttatcacatagtgaaacactgctttactttttatttaaaattgtttttttggccgggtgcggtggctcatgcctgtaatcccagcactttgggaggctgaggcgggcggataacttgaggtcagaagttcgagaccagcgtgaccaacatggtgaaaccctgtctctactaaaatacaaaaattagccacgtgtggtggcagtcacctgtaatctcagccactcgggaggctgaggcaggagaattgcctgaacccaggaggcggaggttgcagtgagccgagattgcaccattgcactcccacctgggcaaagcgatactccttctcaataaataaataaataaataattttgagatgtggtcttgctatgtttcccatgccagactcaaactcctgggttcaagtcatcctcccgcctgagcctcccaagtagctgggactacagctgtgtgccaccatgcccaactagggaaacacatggctttagagtaaaccttgtactatcttgatattgatctttgatcatgttttttagtgcttaaagtgtctcaccactgccttcctgaaaaacttctaatttcttaggcctttatagtttgactcctgtcctcctttctagtcttttccctcatcacatttctccattaccaactattttcccccagtagttagtggtctttgtagtttggatccaactaatgccagttccaatcgggctctgtcgttagctgtgtggtcttgggcaagttactgtaatgagaagaaaagcagactctagtacctggggctgtggtgtgcattcctataaattcagcttgttcaactgcaggtgtattcctggtacatgggtggaggacactgatagtaactactttaaatcattgttttctcatgtgaaaactgagggtaatttttttcagaattgttatgaagattaaatgagaaaacttaaagcatctggcagggtccttgcacttagtagatacttaacaaaaacttgtttttgtcgtagttcaattccttcatggttccctgaacggggcttataaggtccttgttttaatcctttcttgcacatggaatgcacagttctcatccttcaagactgtgtctaaaataccttcttttctgtgaaacctttacatcttctgctaatctctgctgtctctgaacttaaggtattgtttttaccattgactttgttattaaatcatactccaccctgtggcatctttgtagttacctgttactatttaatccttttttttttttttttacatacttaatgctttgttcaactaaattgttctttaagagtggggtctatgtttaaaaaggggcttcaaaaccattccaattattttataggacctgatttcttcagatttgttatcttgagtatcttgtacccagaaaatgctttgaaatgattaatgcaaaaggaagagaatgtatcatcacatttcacctctcctaaatatagtggtattgtgaaattcacgtaagccagatgcttagttcaaagctgatatattggtttgcttctgtgtccccacacaaatctcatctctaactgtaatcaccacgtgtctagggagggaactggtgggaggtgattggatcatgggggcagtttcccccatgctgttctcgtgatagtgagggagttctcatgagagctgatggttttaaatgtggcacttccttgctctgtctctcctgccgccacgtaagacatgccttgcctccccttggtcttctgccatgattgtaagtttcctgaggcctttccagccatgcggaactgtgagacagttaaacctctttcctttataaattacccagtctcaggtagtgtatagcagtgtgaaaacggactaatacgaaagctttttacaccttctttcctagacaatacaatggtgggtgaagagaagatgtctctaagaaaccggctgtcaaagtccagggaaaatcctgaggaagatgaagaccagagaaaccctgcaaaggagtccctagagacacctagtaatggtgaggcttaattttttttttttaggtgaattagtgaaatagagaacaaatacagtgttatagaataagtattgccatctctttaattctttattgtaaatgggtattgatagagttttatatgtctagtaacaaagcaattagacaataagtcctttctcgttaattaatttggtggtcatctattggtatctgctgtgttttagagaccattcattcagtcacgtaacctaccaataattgctgaggtcccccgctggatgctggggctatagcagtgatcagtacggatttgtttgccattatggagctccaagttaagtgaatgacaaaacctccaaaatcatacacataactagatttatcacagtgtaatattcttgtaattaactactttcataatagatgtaatgagtaaaatgtgagtaattagcagggtgcctaacccagttcaatactgagctataaatcttgggagaggagtagttagggagttttattagttcttgtatccacgtttgcttaatgcctgactacaaagaggaatacgatagtcctttgttgttaaggtcaaggtttatgattatgaatgatagacttgtaaacacaactctaattgatgtcatctattgcatcagggtattaatttttgcagtgacatttgtaaaggtttgatttcaacaaggatttgaaaattgaggattgtttagttaacaaataggtgcggaaccttctgagacaggttgtctttggcatttcatctcttttcataaagaaacagttttgtttttcctacctaaatttaattaaacttaaatatcaacagctggatcccaccaggaatgtaaacattgctgcttgagttggcataatgaggtttattgataggctcttagttagctatatatgacatatttatatggcatatgggctagttttagtgtgatataaaatgtgaaatttatgcaaaggaggatgagccaatactggggagaattctccttccgtgatttagggacttagtgataacccagtttgtttcccttgcctgcattctcacgcattagaaacttcatgcttgtttgttccttccagttcttgggacagaaaagttattttaattgaaactttctgtcactgtatatgatcattctctttatgtcccaagtttttaaaaagattctaaattcttctgatttctgtgtattttcagtgttctttattgtcctagttcattaagttttagtcagtccaggttttagtgcaggtgttaaaaattgaattggttagcttaaatcaagaagtgtaacaacctctttggtttaatgtaaataatgctaatttgaaaatgtttcttcacatattgtaacatttattcaccttggggagtaagtgctttgggagtaatcccaaagttctgggattacgggcgtgagccaccgtgcccagcctggtctaggtgccctttctttctctccttttttttttttttttgagacagttttgcttttgttgcctagagtggagtgcaatggtgcgatattggcttactgcaacctctgccttctgggttcaagccattctcctgcttcagcctcccaagtagctaggattacaagcatgcgtcaccacgtgcagataattttgttatttttagtagagatgggattttactatgttggtcaggctggtctcgaacttttgacctcaggtaatccaccaaccttagcctcccaaagtgctgggattacaggtgtgagccaccatgcccagccctttttctcctttttcttcccctcttcctccttctttgtttcttcccttttcccccatccccttctcttcctttttccttccattcctcctaattggagatagtctcgctttgtcacctaggctggagtggtgcaatcttggcttactgcaacctccacctcccaggctcaagtgatcctcctgcctcaccctcccgagtagctgggattacaggcatgtgctaccacgcctggctaatttttgtattttaatagagttggggcttcaacatgttggccaggctggtcttgaactctggcaagtgatttggttgccccgacctcccaaagtgctggttttataggcatgagccaccatgtcaggcctccattccttttaattttttagtaatatatttgcataccattaaagtcaccattttaaagtttacaattcagtggttgctaatatatttacaaggttgtggaaccatcactgctgtttaatttcaaaacatttttatcaccctggaaaggagtcccattcctctcctcttagcctctagcaaccactaatatacttcctgtcactttggatttgcttgatctgggcatttcttataaggggattcgtagaacatgtggcctttgtgtgtggctgcttgcacttagcataatgttttccatgtttgtttggttttttgatttgaggtggactcttgctctgctgtccaggctggagtgcaggggctattcacaggcatgattatagcacatgcagcctcgatctcctggcctcaagtgatcttcctgcctcagcctcctgagcagtatgttttaatatgtatcagtacttcattttttttttttgtggctgaataatatttcattgtataggtatgatacagtttgcttatctgtcagttgatatttattttgggggggttatttacaatgattggctattatgaatgatgctgctatgaacatttgtgtagaagcttatggaatatatgttttcagttctcttgggtatatacgtaagagttgagttgctgagtcatggtaaatgtatgtttaactttttgaggagctgctgtacttttccaaaatagctactccttcttatgttcccaccagcaatgtatgagggttccaatttctccatatcctcaccaagacttattatctgtcttttgatgatagccttccagccaacagattaataatctggtgtcagttaagcacctttgatctaaatgtaagatagggtaccaggtttgttaatagggagcttgaagttggtgtgcataagatacccaaatagaaaaaatcctttgttataaataggagctaagtgagttatagtaaccaaatagagaccgatggggttgggggagcccttgctttagaatggaggaaagtctcactgaagtagattttgagtttggcctttgagataagaagactgggagagggctttcaatccacagaggtatgcatttgcaaagactttttaagacagtatagtgttgtgtgtgtggtgttttgtttgcttttagagagggtgacgggtaggtagtacagatggatttgtggttggttttcatggataggagtatagagcaaattggaaaggccagaagtaagtaagaagataaggctccaacagcctctcagtgcccagccaactgccctggcagctagtgggtagtggcccttgctggggaccctccagtgggcccaggaggacaaaagtggctctaaatttgacacatgcacattgaagcaagtcaaaggacttgatatgaagcatagaagcacataatgccaaatagcaagcagtaattggtatacatttggtgattgggcagtatttccttcttttactgctgctaaggtggtggaaattagttaaattcattgtgaaatggcacacactgaaggtatttgttaatgagggttccagaagcgttaaaagtagcaccaccaaaagccaggtgtggtggctcacgcctgtaatcccagcattttgggaggccgaggtgggcagatcacgaggtcaggagatcaagaccatcctggctaacacggtgaaaccccgtctctactaaaaatacaaaaaattagccgggtgcggtggtgggcaccagtagtcccagctactgggaggctgaggcaggagaatggcgtgaacccaggaggcgaagcttgcagtgagctgagatcatgccactgcactccagcctgggcaacagtgtgagactccatctcaaaaaaaaaaaaaaaaaaaagcagcaccaccatatgctgtcacaaatgctagtgtgacaaggcagagaggattgttgtagtaggaaataataaagacatttccttttcaaaaccagcacatctcaaactttttcagtcagctccctttaaacttctggcactaaaaatagtgccttgcatacttaatgttaaatgaaagacgactatgttttctggatttagaaagaccacctttaatacctcaaaatgaagacatctgtgcagttggcagttgtgagtgaaaacactgtttgccaaaacagacggctggtcagaaatgattgtatacctgggttgcgtgggatatctgctgctgccacttgtaatcctcatcatgacaatgttgggtaagacatttcaaacatagatacagttacagtagttgaaggaatgtcagatgacatgactgttgtagatgcaacttcatcaagatggtaaactaaatagacatctacagcttctagaagaggagagcaaaacacatgcaagaagaaatggtcagtgtttgattactgtagcattctggatgcttaataggggctctggttttgttgtaaaggtgatgtccgttctcagaaatactgtatcaacatcttctatgtggtggcttgcatctatagtctgagctgcttgggaggatcatttgagcctaggagttggaatccagcctgggcaacatagtgagaccccatctcttaaaaaaaaatggtcttaactactggaagatttgcagacttcaaaaaaaaataggacttgaagtcttactgtatgtattgtcattgactgatgacctacctgtgtgaatgattttggacaaatcttacagcttgtcagtgcttaggttaccttttatgcaaagccaaggatagcaaatatgaaagcactttctgcgtatgtagcactgtgttcatcaaggtattatcttttttttttttttttgagatggagttttgctcttgttgcccaggctggagtgcaatggcacaatctcggctcaccacaacctccacctcccaggttcaagcgattctcctccctcagcctcccaagtagctgggattacaggcatgcgccaccctcctggcttattttgtgtttttagtagaaacggggtttctccatgttggtcaggctggtctcaaactcccgacctcaggtgatccacccacctcggcctcccaaagtgctgatattacaggcgtgagccactgcgcctggcctcattaaggtattatcttattggcagtgctgtccactcttctgtcccagttcctgaggtagcttttataatctcctgttgtatatcaactgagaattataatctacatgaaatcctctaatattcctaccagaaattatctcttgatttaaaacaagataatatgatgttgtaacaatttagtggtaataaggcagattatcttcttgcatatacaggcagcctacacagttgatacagatgtggtgataaaagaaaaagaagccaaagttactctagttgagtaatatagttcccagatggccgggcacggtggctcactcctgtaatcccagcactttgggaggccgaggcaggcagattgcttgaggtcaggagttcaagactagcctgaccaacatgataaaaccctgtctctactaaaaatacaaaaatcagctgggcgtggtggtgggtgcctgtaatctaagctactcaggaagctgaggcagtagaatcgcttgaacctgggagacggaggtttcagtgagccgagaccgcgccactgcactctagcctgggtgacagagtaagactccgtccaaaaaaaaaaaaaaaaagatttggttttattaaaccaattgctcaaatatgcatataaatttttttacatttaaagtaatatatactcattgaaaaaattcaaacactatagaaagttattaagtaatacttcctcaagtaacatttttttttacatgtgggatcatatttgagatctcttctgcaatttgtttcttctatactttgtaagtctcagatatcttttcatttagtatatgtaattctttaaaatacctgtgtagtatttctgctgtacggatgcttggcggtttatttaacttgctccttattgatggaaacttaggctgtttccaaagttgcagtattacaagcagtgctacagagagcatcattgaaacagcatcattgcttacttgtactggtatacctataggatacattctttttttgagacggagtctcactctgtcgcccaagttggagtgcagtggtgcgatcttggctcactacaacctccgcctccctggttcaagcgattcttctgtctctgcttcctgagtagctaggattacaggtgtgcgccaccatgccttgctaatttttgtatttttagtagagatggggtttcaccatgttggtcaggctggtctcgaactcctgacctagtgcgccgcctgcctcagcctcccaaagtgctgggattacaggcgtgagccactgcacctggccaggatacattcttaaaagtgaaattgctaggtcaaagggcttttgcatttaaaatttagacattatcaaatttcctttaaaaaatgttatgccaatttatattcctaactatactgtttcaccacactcttggcaataatcttaccagtcttttaaaattcctgatttgatgggtgaaaaacagtatacatatagcataaatttgttctcatgaattttaagtgaggtggggaaattgtttcatatttattgaccatgtattttttttctttaaaagccctgttcatatcctttgctcacttttattccttatctggtggttattatttttaagagctttttctatattaaataaattaatcctctgattatgtactttgaatattttcttaatcaaactagtgatttgtcttttgactttgcttatgtatgtgtgctttgccatgttttgtttttatatatcaaatattcttttaattgttataattttttttttgtttgtttttgtttttatttttgtttttgttttttgagatggagtctcgctctgttgcccaggctggagtggagtgcaatggcgtgatcttggctcactgcagcctctgcctcccgggttcaagcaattctcctgcctcagcctcctgagtagctgggattacaggcatgtaccaccatgtcctgctaatttttgtatttttagtagagacagggtttcaccatatcagccaggctggtctcgaactgctgacctcaagtgatccacccacctcagcctcccaaagtgctgggattacaggcatgagccaccacgcctggctgcttatagatattttttttgtcatgcttagaaatcatccaagattatgacaaaaagaaaacatgacttttttttttttttacttttgtggtgttttatattgaaatatttgatccatatgaaatttatttttgagtgatgcattcatcattggggatctaattttttagttttccaaaatggctagttagttgtttcaacattatctattaagtctctgtttctgtatgaacatgcactaatccacgtttctggctcagattccatttttctgaagtagtgcagacttgtgagtagttgagaactttgtaaagtttttgtggtcagtggagcaatagacgattacagatggattttactatcttatcttcccttttattgttaagattgaaaagtgattgactctttcaagaaatactcctaaacctaaccatactatggacataaaggtgacttttcaagtgacttttgtatcgctttgtggagaacaaagtgaagctgaaatgtaggtattataagacacggtcaatgagagttttttagaaaacaatcaggatttaaaaatgagtttgaatttctaggcaataaactagtcagtgcctacacgttagctaattctgttcttgccacaagtagatgaagaaaacatttattaaaagaactgcaacttgaaaattggttattagtcactgcttagtattccttagtcatctttatgagtgtaatcacataggttggctgtcctttttttttcttcaatgctgcatgactaggggtcaggagacaaggatttcttcaggctcagttacttattggccatgtgacagtgtacaagatgttcaatttctttgaatctcagtttctttattttaaaaatagaaatgaggccagatgtggtggctcacgcttataatccatgcactttgagtagctgaggtggaaggattgcttgagaccgggaattcaagaccagtctgggcaacatatcaagaccccatctttacaaaagtaaaaaaagttaggtgggcatggtaacatgtgcctgtagccgaagctactcaggaggctgaggtgggaggattgcttgagcccaggagttagaggtcgcagtgagctaggattgcaccactgcactccaacctgggtgacagagcaagactatatgttaaaatttgtaacaagtttaacaaggatgcggatttagaaatttggaggccataatgtcttcagggaaaagaagagttgcagaaatgggtggaaactattggctagcaagaaaacaaagataagaagtgtaaaattctttctcagaacattttatattagaaggaaaagtacagcatgtcatgagggttaagtgatcttcaaaaggactgtttttaaaaaaaaaatcgtttctaaatttcagttattttgccattatattactattactatgtaactttaaaaaattcacttgaaaatttattctcaacctaagtaataaattgttaaatcataggtttgatgttcaattacttatttttaaaaaacaaattaaatatataataacttgataagtgttagtagaactacagattttattttcagtatcactgatgacatccatatcataatttctgaaacatgatttttaaagaacaaattgtctctgaatttaaatgtggacaatataattgactcagtgggttgaactttttgaatagggaatgattaagacaataatagtttgaagggttagtcttgaaaaagagatgggctactctttcctctgacacagaaatgttggagaagaggttgaaagacagcaaaaattaagaaacatagaagacatttaaggatttggtaccaaaactgaacaactaaaagttacttggtggggctgggacttgaaagtggaaaaggtttccaactacttttgtgaggaatgtcacagaaattcatcaagaggcagagacaaagattgcatattttcattgctggcctgcctaaggcttgactgcagcagtttagaatgggcctattttcctaactttttctgtagcgcatggcaatttggaatcagaaggcagatagcgggtaatttctggagtcggcgtgtggcatggtgggtccaggaaattggtggtggtgataagggacagatagaaataatgacagagggttagtaagtccgtgctggttaagaaaactggaaaaccaaaatgatgacttctatcagaagagaaactgtctctttccctgtctttctctttagcgatgaaaccttcgctagaaattcccctacagacttctcgtgtctcattggccagagttagattacaagttatgctggctatctaccttttgcctctccagtcttttctacgctactttgtttcctgggagactgacgttaagaactgcaacaatagtctccagtgccctgtgtgtttctggtaggcttggccagtgggagaacttcaggagatctaagagcagagagtaaggtgggtgtatttataactaaggttctctccctggtaggtaaccattgctcctttctaatatttctctctaaagagttctctctgggttccactaaccctttacccgctttgccctttctggcctcaggatggtaacagctttcctgatgtttattactagccctagaattccatatcatccttattaccatcctttgttgcttttcttaaactctgaccacacactagaaaaaggacctctttaaatttttcccagtcaataagcttgagtgggtcatctctttgctgtctgatactcaggtccatttttaaatcagtttctcgcaaaggcagtgacatgcatgtccttatttgggaagcaaccggcagtgttcaccatggctgtgttacattataaaaaataatgtgtgtgtacttgtctgttttatttgccaaccagatttacagtaaacttggccatctagaacaaagttggcaaacgtggccgtgttcattcttttgtgtttgtagtgctttctcctgttatcacagtagagttgagtagttgttacatagttgcagactatactgcccattacggaaaaagctttctgactcttgatctagaattacgttgttcaatatggttgccactagaagtacactgtttaatgtagtctggttgagcacttgaaatgtggctagtctggattgagaaacactatagttatgatatgtcagatttcagagacttactggcacccatttctttttactttttaatgtggctcctaaaaattttaaaattacacatggtgattcacattttatgtgtatgtctgtgtatatatgtgtatatatatatgtatatgtgtgtatatatgtgtatatatatatgtatatgtgtgtatatatatgtatatatatattttttttagacagagttttgcttttgttgcccaggctggagtgcaatggtgctatctctgctcaccgcaacctccgcctcccaggtccaagcgattctcttgcctcaccctcccaggtagctgggattataggcatgcgccaccacgcctggctaattttgtatttttagtagagacggggtttccccatgttggtcaggctggtctcgaactcctgacctccggtgatctgcctgcctcggcctcccaaagtactgggattacaggtgtgagccaccgtgcctggccacacattgtatgtttataggacgacactgatcaggaatgtaactggtggcctagaaagtaagtagataagcttcccttaggccaaagcctattaaatacaatattgtcaagaaaagagagcatggcattaagaggcatctgactgagcttcaggcctcagaaaaatccaacaagtcttcatgcttcattcctttgcctggaataatgtttctagcatttgttcaccataatttttctttattatttgagactcagttcaaatattgactcctgcaaaagcctcctacacccctcattctcccacagcgctcctctgtattgtccttttccctatttgtagttttctcctgagatcctgaagggagggtttgccctgcatgtattgggtcctcagtgggcttttacttaatgcatgagtatataaattgagtaaattagttaccaatttaacaagcctggttatttgtctcttttcttctgtgtagctttggcggtagattgactatagtaatagaagtgtacgattgttagggagaaccctgtggaagcagcctaggtagaaaggcacagctccccaggactgctgagtggggcctgattgcactccacatttccgtttttgctaaagatatcactataatagtatggtacaacaatggatctctcttacttgttccgaagattatgtagggtaaagtacatttttgttttatttttttgtagagaatgggggggtctcactttgttgctcaggctggtctcaaactcctggcttcaagtgaccctcctgtctcagcctcacaaagtgctgggatgataataggcgtgagccagcacgcctggagtctggtgttttttttagggtagcaaagcatgtcataattttacaaaaattttcatcaaaactggttaaaataagatttttgacatgtcaaggaataaattttaaacattcccattaagtatagcaggttttaaaagagatagcatttattcatgaagataagtattgcaagcctgatttttttagaaatcagaaatttaagggaaaaaatgttgaatagttttccttatggacttatgcggggttctattaagtttcagatagcaaataactgactcctagtgttagcagttagtgtgttactagagggaggcaaatgattccgaaattacatcaccctcagtcctggcttatcattgtttcagggtcagtgttttagaaattgagaagccttgagttgagtgcttgtaaatagttcttcaaatcattggatgtgggtggggatggtggctcatccttgtaatcccaacagtttcagaggccaaggcatgaggattgctggaggccaggagttcaagaccagcctgggcaacatagcgaggctctgcctttacaaaaaaattttttttaattaggtgggtgtggtggcatgtgagtgtggtggcatgtgcctgtagtcctaggtacttgggaggctgaggcgggaggatcccttgagcctaggagttccaggccacagtgagctatgatcatgccatagccactgccccctagcctgagcaacagagtgagaacctgtcttaaaaaaaaaaaagcagtggatattagcttttaggcattcttttgactttgacatctaatttttaaattttaaattgtagaaagttaagaatttctttgtaatattgtatgaagaggtattttgaaggtaaaggaaaatgaattagcattttaaaatatatttttcttccacttacttaactttgtcattttcagtggggtcttcagagactctgtgaacaaatcttttttctaactttccagtggctgcatctcaaagcctgtttgtaatgatggctgtcgtgttatttatggatagacagattctttttggaagggatgcacaagtagtgagaattaatcttttacagtctccttaccaatcctcctctcccatggtagctgaattagttgaaggaaagaagcttttgtcttcatttttttatgaaatagttcatttatgaaaccatggtctggtcatagaactaaattaaaaatatattctttaacttattgaaaaatcaaatggacatttgtcttacccttatatttcttaatcagttaccaatttgtaaatatcttaaattaatcctctgctctccattctccttgccatttacaacatcactttttgtccggatttattgcatttctctgttatgtggtcctttccatcttccaatatcagctcagtattttcctgcataaaattcttagtttcctcaaagcccttgttattatatgacctagccttcttcccagtcatcaattctgccattatcgataattgaagacattccactgtctcctggcttccattgatgttaagtcaggtatgcgttgtaattgcagtacttgcgtagttgatattctttctgggtgcttttagtttttttttttaacccctgcgtcagacagtttcactgtgatatatctaagtcgattattattattattttttcttttgagatggagtttcactcttgttgcccaggctggagtgcaatggtatgatctcggctcaccgcaacctccacctcccgggttcaagcgatactcctgccttagcctcttgagtagctgggattacaggcatgtgccaccacgccagctaattttgtatttttagtagacagggcttctccatgttggtcaggctggtctcaaactgccgacctcaggtgatccacctgccttggcttcccacagtgctgggattacaggcgtgagccaccacgcctggcactaagtagattatttatcctgcttggaattctttgactttatcctagaatttgtgtctctcaacagttctggccaattctcagctataatcacctcaaatattatctctctgtatagagctctgattagatgcattttgtaccttctcattcttcatgtctttcttccaagtgacatactgtgaaaagaaatgtccaatagaagattaaattatatttctaccataaaaacagagtaatagggcagtgaaaataatatacaagaatatgtaatgacagagaaaaatgtttacaatatattaagtgaaaaaaacaggttataaagcagtatgtgtatgagtttgtttttatgtttttatggtttgtttttaagggaaggggttattaagcttaaattaccccaaatatgcctccaaagttcattttggcaaagtaaatatttctgttcagtgtattttttctgggaaattacttttataaatttgaatggcttttaatcttcctttttaggcaaaatatacaatagcaattgtcaatgctgaaataaaaatacttaagctggcctggcgcggtggctcacgcctataatcctagcactttggaaggccgaggcgggcggatcacgaggtcaggagatcgagaccatcctggctaacacagtgaaaccctgtctctagtaaaaatacaaaaaattagccgggcgtggtggcgggcgcctgtagtcccagctacttgggatgctgaggcaggagaatggtgtgaacccaggaggcggagcttgcagtgagccgagatcgcgccactaccctccagcctgggtgacagagcgagactccgtctcaaaaaaaaaaaaaaaaatacttaagctattaccatgtagagtaaataagaaaatacaaattctcaattttaaaaattcatctgccaaagtgatagttcatcatcataggtttttttttttttttaacgaagatagcaaactagacgttgtggttttctgtttcacagttttcagtattcattccattctgtttcattcacttatctgtgtaggtctgtgcacataatgacgtctgatgtttctcggttcccataatataacagatgacttgacactttattaaaaggatagaataaagatatttagtatctcattattcacaaactcatttgtgaataatggcagatggcattcaaaattaactctaccctgggctaagcatggtgacacatgcctataatctcagcattttgggaggctgaggcaggaggattgtttgaggccaggagttaagtcaagcccagccagggcaacatagtgagaccttgtctctacaaaacacttaaaaaaaaattagctgggtgtggtggcacacatctatggtcccagctagcggggcggctgatgcaggaggatcacttgagatcaagtgttagaggctgcagtgagctgtgattgtgccactgcagtccaacctagatgacagagtgagatcctgtctcaaaaaaagcccccaaaactctacccatattttattaaaagggcagagatcaattaatcccactgcttttaaaattataatggtaccatgattcagtgtgaaaataagaaactgtctctaaatctgtgacaataataaagctcagtatgcaccatacatacacaggagttatacagagcagcacattctcataaaaaatactgtcatacctttcaaatccaatttttgttataaaattacgaaaaagattctcagtcagaataccgccgttagtcaggttaaacaccaggaaattacattactgtaacttaatatacagaaaagaatatttcagaacagagaaattagaatgaaatgaattttagaatatttttagcatcacctccccaaaaccctgtacccattagcagttattccctttttgccataaccccgcgcctcactctctaggcaaccaccagcgttttgtctgtctcagtagttgtctattctggacattgtcatgtaaataggatcatacgatatgtagtcttttgtgacttcctcttttcacttggcaaaatgtttacgtttcacccatattatagcatgtattaatatttcttttggtttattgttaatccattttatggatatactacattttattaatctgtttttcagtttatgggtatttgtttccactttctattattatgactaatgctgcccatgaatattcatatacaagtttttgagagggcatgtttttatttctcttgtgtatatacctagtcctaggtcttatgttggctctgtgtttaatctgtcgaggaacttccagactgtttttcaaagcactacaccatttaacattcccaccagcaatatcctggatagttgaagtttctttcttcacattcaagccaacacttgttgtttgtgtttttgattatagccatcctagtgggtgtgaaatgatacctcattgtacttttgatttgaattttcctgatggccagggatgttgagtgtctttttgtgtggttattgggcttttttttttaaaagaaatatctgttcagttactttgccttttttttttttttttttaaaagacagagtctcgctgtgtcacccaggctggagagcaatggcgcgatctcggctcactgcaacctccgcctcctgggttcaagctattcacctgcctcagcctcccaagtagctgggattataggcatgtgccacccatgcctggctaattttgtatttttagtagagacggggtttctccccatcggtcaggctggtctcgaactgccgacctcaggtgatctgcccgccttggcctcccaaaatgctgggattacagtcatgagccaccgcacctggcgtactttgcctatgttttaattggactatttgtctttttatttttttattttattttactttatttttgagacagtcttgctctgtagcccaggttggagtgcagtggcacattcttggcttactgcaacttctgcttcataggttcaagcgattctctcaccttagcctcccaagtagctgagactacaagtgcgcatcccacgcccagctaacttttgtattttcagtagagaaggggttttgccatattgtccaggctggtctcaaactcctgggcttaagtgatcctcccaccttggcctcccaaagtgctatggttacagatgtaagccaccatgcctggcctatttgtctttttaatgttgagttgtaagagttctttatgtattctggatacaagtccctaatcagatttgcaaatttttttttttcccattctatgggttgtcgttttactttcttgatggtgttctttgtagcacaaaagtgacttaaattttgatagaatctatcaatatagtttttctatattttctaatcttgattgttcttttggtgtttaagaagtcattgtctagtccaaggcctgttttcttctatatttttaggtatttgatcctttttgagttagtttctacatatggtgtgagttccaggtccatcttcatgctttttcatgtggctattcagttgtcccagctccatttgttgaaaagaagaatctttccgcatttttcttggcacccttttcgaaaatcaattattaataatcataaaggtgaatgtttatttctggactctcagttcttttacattgatcatctatgtgtctatctctaaaattgggaagtgtgagttttccagctttgttattttttttttcatgatttgtatggctattctgtgttcttgaatttctatatgaattttaggatcagcttgtcaatttttgcaaagaagccaggtgaaattttagtgagtattgctttaaatctatagaaaaattggggagcactgccatattaacaatattaaatcttctagtcaatgaatatgggatgtctttagacttatttagttcaatttttattccattttcttcatggcaccttttatttgcatcagatattataaagttgatgaactcacattcttttattttattttacttatttatttttttgagacagagtctcgctctgttgctcaagctggagtgcagtggcataatctcagctcactgcagcttccacctcccaggttcaagtgattgttctgccatcttcccaagtgtcagggactacaggcgcacgccaccacggcctgtcaaatttttgtattttttttttttttgagatggagtctcattctgtctcccaggctggaatgcagtggcgcgatcttgtcttactgcaacctctgcctcctgggttcaagcaattgtccctgccttggactcccaagtagctgggattataggtgtctgccaccatgcctggacaatttttatagttttagtagaggtggggttttgccatgttgaccaggctggtctcgaattcctgactcaggtgatccgcctgcctcggcctcccaaagtgctgggattacacacatgagccaccacgcccagccatgaactcacattcttggacataatctttgtcatcctttgcaatcatttctggttgaggaatggcatttttttttattcttggcacgttggcatagatcctctgagactttcttttgaaccattgtatttttaaaaacatttattgtagagatagggtcttgctacattgcccatgatggtttcaaacccctaggctcaactgatcctccccacttggcctcccaaagtgtggggattgcaggcatgaggcaccatgcatagcctgaaccattatatctttatcattcatgttcaccttaagactgtataacataatgatttcctccattatagtctgcagaaattccaagtcagaagtctttgttgtggaactatcctccatctctagcgcagctgtggttggctcccatctccaattggctgtttggttggacctcttctatgtcttttaacctattattctctgtcactatttctctgggctatcctctgtataatttcctttgatctatattcccatttactagtactctcttcagacatgtttaatctactgtttaatttatccattgaatttgaaacttcaatttttttttgttttgagaaatcttgtttgttttcaaatctgtttggttaaatggtttcttgttacttgcttatgttttccttctttttttctttcctttttttttttgagacagggtctcactgtgttgcccaggctggagtgcagtggtgcgatcacgctcactgcaggctcaaattcttgggttcaagtgatcctctcacctcagcctcccaggtagctgggactacaggcgtgcaccaccatgcctggctaattttaaaacttttttttgtagagatggggtcttgctatgttgtccaggctggtcttgaactcctggcaacaaataatcctccccaccagcctcctaaagtgctaggattacaagtgtgcacccccacgcccagccttccttttctatgttttcaagtttcacttttatttcccttaacatattgatcattctgatttttttgtcctaaaagtaacaattccattatctttagtttttcagatctgcatctcttggcttttgtttctgctgtttcccatttattctgcctagtttcctagtgtgttttatgaagtttgactattctccttttttttctttttttcttttttttgagacagagtctcactctgtcatccaggctggcgtgcagtggcgcaatctcggctcactgcaacctccgcctcccaggttcaagtgattctcctgcctcagcctcctgaatagctgggacaagcctcttctttttatggtaactttatctgttggaattctgtacggccttgattgatactgtaatcttccagggaggaattgcacttatgtctgccagtagcctggagacccgacttgggttagctttagaacatatttatctcatatttttcagaccacatagatagtgtgaatttagattgcaaacactagtgagggggttatgatttcttggggcaaattttccctctctgcacagcatcaagtagagacagacagatttccttctgttttggtttctttcttatacactgaggatgtagccttatgtgtggtccctagttttacgtggcagtatcctgttagacttcccattttgggcaggccctagactttgccattctgtaaagtattgtcctctgtgtactattctgcaaaaatactgtaccctgtgttgcttcaaggttgctaggatttgtcgagaatccttacgtttcttatatgtcccctaggattctagtttcattttcttttcttttctttcttttttttttttttttgcctctgaatttgtactagcttggcaataagttttaaaaggttttcgttttttaatattttacccagcatcttagtggtctcaactgtggaatctgttcagggaatctaatttcccatgctgtcagaatcagatctatagcattgcataattaacatcgttgtaattactgtgtgtacatttactagttttgttcttagtattttcatgtataaatttccttctagttattttgaccatgctgtcgtgttttatggttgcaccacagtttacgcagttacctttgtatttgtttgttttcaactttatgatttagacagtgctactaggtagctgtatccatcaacttaaaagtcatgtttttttcttcccgtaggtcgaattgacataaaacagttgatagcaaagaagataaagttgacagcagaggcagaggcaagtaactccctcttctagaaacaaaaatgtagagttttagatagaattttgtttggtaacatttttaatgctaaattgctcagataattatttaagccattcatcagttgctgttatcctgtggaacaagaaaataagatctgctgacttgtcatcctgcgtaaggatccagattgcctttttctctcccatctcatctatcactggcattttctgtctcttaccagcaaatcttggttttagtgacccacgttaacagttgatagcgttgaatgtctgtatgagtgctttgtgaaagtatctgtcatgattcatagtaaatagcagctctccaataaatgttgaatctgaatctagaagtagattccctgtcaaggaagtagaaataacaactcgaaaaaaaatcatgaaatcatttcaagtggggataaatagttctacaaaccagaattcttcagtaccctcaggaaattgtggagggcgaagaacacttttttaaaaaaacattataatccaatacctgggtgtaagttgacttaaaatccaaagcaaactcctgttttcccaaggagaagatcacttccaaaatttgttggccagtttgactatataaacatccggtgatgaagatgaagtagccctgttttatttatttagttacatgcatgtatgtatgtacatatgcatttatagaataatctagatttagaaatatttttgtaatcatatttcatgaaatgtatgccagattatttatactcactttgatgtcaatgtctttgttattatcagacctagtttttcagttatcatccaaggccaggggcatagtatttgtactttcatctaatgtgttggaaatcagtactgtttgagtccaaggaggatgctgtcacagaaaatttattaaagaacatatttgcttaacattaagagatctaccctgtcctccttccatcatcctgtaggcatatttgtgatgactgcaatgtaattccttatggtactgctttataaagtggtactcaaaagatgtatttactgcacttgaaattgtgggtatagactcctagttaatagggtgttaaactttatttttcctgattccattaagttacctttgtaagcctccagcactacagtgatgaagatcatttctgatgaatgtcttttccaattagtgctttgtttctccatcataagagattgtttaaggatttgttatgcaactttttatctgatgactaacttataattttggctaagaaaataacaatatttaacgtatagacacatgctagtttgtttgtttgtttgtttgtttttgagacagagtctctgtcgcccaggctagagtgcagtggcacgatctcggctcactgcaacctccgcctcctgggttcaaggaattctcctgcctcagcctcctgagtagctgagactacaggcacatgccaccacgcctggctaattttttgtaatttttagtagacatggggtttcactgcatgccaggatggtctcaatctcctgacctcgtgatcctcctgccttggcctcccaaagtgctgggattacaggctgggattaccacacccggctggcacgtgctagttttaaacatctattcttgcaagtttagtgactaattttttttttttttttttttgagacagagtctcgctctgttgcccaggctggagtgcagtggcgcgatctcggctcactgcaagctccacctcccgggttcacaccattctcctgcatcagcctcccgagtatttgggagtacaggtgcccaccaccatgcccggctaattttttttgtattttttggtagagacggggtttcaccgtgttagccaggatggtctcaatctcctgacctcgtgagctgcccgcctcggcctcccaaagttctgggattacaggcgtgagctaccacgctcggcctaaaataaattttgtttttgtggtttactagagtgtttctgaccctttttatttctctagtcaggcaggatacctacatttttgttattcctttttcaattcttcttttgtcctcttttgctcctcctcttcttatcaagaacacaaaaacatattatgttctatttgtgagggcaagtttcaaataggtgaaaagtaagtctgtctctgctatcattcctctatttaaaaacctaaagtgggaggagaacctttcccatacagaatcacaaacccaaaggcgaaagggagtttggggtggaaagtagaggttttgggggaaaggggtagaaagtggtggcaggatgaaggggggatgttccaaggatttaagttaaaactttttaaagaatattgtacttgtctgctttatatattaataaaattatgaaatcttttagcttggtcatttaggaggattagaaggagaaagtaatgaatgaaataagggaaaagctgaaagaatggtggaccctggtttagctagtattaatatgtgtattgtgcaggtgacataagggttgcagagttgtgcaagacttgttccctgatgttaagggaagtattggcctgaacaaaggtaatggtgttagaaaacttacaccgtacatattttagggcacttgatggacatctgtgtctctattggggcacaatggcaagaaaaagttgaaaacttgaggctagattataaagcattttttctcgacttttatgccctccttcatgtagctctttctatctgaaatttcctctttctccattcacaaatcaaaataatgtatatccttcaaattctaggtcaaatcttgctgcttctacagttttctgaacattgcagttgaaatgatgtcctcgctactctatattcctaactacttagtttatacccctactatatactctatatgtattagactgtgcattgttctgaatgagtcatcacatgccatttggtgaactttaggtgatttgacttagaagttttaaaattgtcaattatttgctgtctaatgagattgaatattttaccattgtttattaattgtaatttcttttctttttttttttttttttttttttttgagacagagtttcactgtgtcgcccaggctggagtgcagtagcacgatctctgatcactgcaacctctgcctcccgggttcaagtgattctcctgcctaaccctccccagcagctgagattacaggcatgtgccaccatgcccggctaatttttgtatttttagtagaggtggggtttcaccatgttggccagactggtcttggaactcctggcctcaaatgatccaccccacctcggcctcccaaagtgcagggattacaggcatgagccaccgcacccagccaattgcaatgtttctgaacaagatatagtaggactactgttctgatctgaaagttcaggatggcatatagagtttagagacagtgagaatagacagggagctattgtaatattttagtattctagaccgaggaaacagatgagccagtaggagaagggaactacatttagaagtcctcttacaggctaagcttttatactaggtgctttatatacacaatcttacttacttacatcatcccatttataagagatctctaattggtcacatttttttagttgttgcttagccttattggttgacatttactaacatggaaggacttgagatgataggtatgtgaacattgttcagagccatgaacttggcttgttttttcacatactaattcctcttgtgggtttttacaaataattttttttaaatgcaagttaggaatctttccggtcatttataatttgtgtcatgttcctcccagtcgtcacttcatctttccttgatctttaaagtgagagcattgcactagttgtctccaaggtcccttttagctctaaaggtttacgtcataattgtgtagctgacgaaaactttttcagaattcactgcttgttattgtataggtagtagataaatctcatccggcagctgtttcagctccacagagctagagttgtcaggtaaaatacagtacgtccagtcgaatttgaatttctgataaacaatgaatacttttttagtaatcatgcaatatttgagacagactaaaacgttatttatctgaaatttaaatttaaatatagtgtcctatattttttatttgccaaattgggcaaccaacaaagaactctgtgaaaagttagatgtgtagatagaggagctcttattaagtaaggaaaagtgtgaagaagttcgtcaagcattgagcaaaccttttagtctgaagggaagaggagtgagggaagtgataacatgagtgtgttgaaattagtggtttgaactgactgaatctcttaaggtcgcctcgaggtctaacatgcttgttaaaaaaggttttcagtatgtattttttatctaatgccagtggggtcatacaaacttgtgtaactctgagttatgaccttttgaaatccttagaattgtgttgtaacaagacttaaaagatcttagaacagtccaagggagattcatatgattaagtcccaaccaacttacattaacaattaaattacctttgcttttgttgttgttgtttttaacagaaacaaggtctcactatgttgcccaggctggtctcaaactcctcagctcaagtaataatcctcctgccttggcctcccaaagtgctgggattacaggagggatccaccatccctggcctagctttgctttaacattatgttaagctatttcttttggttgcaaataacagaagcctactttggtttatttaggcataaaagaaaatatattcaaatgatattaatatatctcacagaatcttaggagaagatgaacattcaagctctgtaaagagtaaggattttagtaggaagagtttagatactttagatatttcaatataataaagttcccactcactttctttcaaagctcagaacctcagatttattataagacagagaattgaattttggccggaaggacaaggtcatatagtacagccctggcctggacattacatgcctgtccttggctctgagaatagttttcagagaaaaatgaatatgttaagaagggcaaagggaatgtctttactaattggtatttgtcaaacttttattaatgtacacaactttatagagggaatgttaggtctcatgtgaatattaaaaggatgaaaaaaattactttctatttctccttcttaaaaatacatttttgggccaggcgcattggctcatacctgtaatcgcagcactttgggaggccaaggtaggcagatcagttgagttcatgaattcgagaccagcctggacaacatggcaaaaccctgtgtctacaaaaaatacaaaaaatttgctgggcatgattgtgcgtgcccgagtagtactgctactcgggaggctgaggtgggaagatcatttgagcccagcaggtggaggttgcaatgagctgagatggcgccactgcactccagcctgggtgatagagccagactttgtcttcaaaaaaaaaaaaaaaaattgttgcaacatattctgtttgcttcttatatagcatttcaaatattgttttttcacatcagtaccttatgctattgtccagccattaaatgatcaaactgatgagtaagagtcaggatacaaaaattagctgggtgtggtgacacatgcctataatcctagctactagggaggctgaggcaggagaatcgcttgaacccaggaggcagaggttgcagtgagccgagatcatggcattgcgctccagcctgggagacaagagtgaaactctgtctcaaaaaaataaattaaaaaaaagactcaagtgtcatgtctgaaaataagagtttctcaccatgttttttcagtcattcaagtaacgccttctaaataagtttttggtccggtcatggtagctcacgcctgtaatcccagcactttgagaggttgaggctggcggatcacatgagttcgagaccagcctgaccaacatggtgaaaccccatctttactaaaaatacaacaaaaattaggcgggtctggtggtatacacctgtagtcccaagtactctggaagcaggagaatcatttgaacccaggaggtggaggttgcagtgagctgagatcacaccactgcactccagcctgggtaacagagcaagacttcatctcaaaaaaaaaaaaaaagaagtttttggatagtgtttatctattgatttattggccgactgctggagagacaagtcttaagtattttctgcccagaaatcctgtgattattgtgtaagttaagattgggttttgctgtaatagtgaacaaaataataggggcttatacaagattagtaatttctttttctcatgtcaacagttcagaggtagcaggtccatagctgatactggctccatggtccttaaggaccctggtttggttccttccagttccctgcctcaccatttgtaattgcccgttgggttcttcttaccctctgcacagacaaaaccaatggactgagacagtggtaaagcagtagagaaggagtttaatgcaaagctagccaagtggaaggacaggagtttattatacacaccagctgctgagaactcagaggctagggtttttatggtaagttggcaggcaggggacctagggagtggatgctgctgattagttggggttgaaatcataagggtgtggaagacagttctcatgcgcagagtcagcctctgggtgggggtcacaggaccagtcatgggtttagggggcaagctggtcagtcgccagaattcaaagatcagaaaaacatctcagaagaccaatcttaggttctataatagtgatgttctccataggagcggttggggaagtcacaaatcttgtgactttgggtacagtaaactattatagaaaggcaagctgtgcctacgttttagcagaattcaggtccctcccataatcctaatcttgtggcctttctttagtcttacaaaggtggtttcagttcccaacaaggaagggggtcaattttggggagggactatttacatcaaagttgaactatgaatttctcccagagttagattggcctctgctcaggaatgagcaaggatggccagcctgtgaggctagaagcatgatggagtcagacatggtagacgtttctcactgtcgtagtctttgcaaaggcagtttcacattcataggctgtggtcctccttattgcccacatggctctagtcattttgtctgagttccaagtggccaaattgagggaaggaaaggagtgggggtaaggaacaggtatctgtgtctgttaaggaaattttctgtggactttgacaaatcatttccacctgtatctcattggctacctaggtgcaaagagagactgggaaacttatttactctaagcagtcatgtgcccagatagaaatcagggattctagtactaagaaagggggtaggcactgatagggttgacaaataacagtttctactatggctgtccatttttctttgctgtcccaatctactggtcaaatttcacctttttgctatgcaagtgtgactatacatttttctgatattttcctttctgccttttctcatttaaatgcacgagtgtaagaatctctagtctattttgaataattttgtgaaagtcagtttattgtgctttatgatttcatcacttacaaaaggtagacaggtacctgtcctgttgccctcgaatgtttagcagttcaatttaatgaatgcctgcttggtttctttgtctatcaggtactacattaagtgctgggattttaaagaagttgtgttttctgttctcatgctaactgagaacactatatgcaaaatgcatgagcaaggggaacagtgacttaattagataccttaaaaatgttctttggccaggcacagtggctcacgcctgtaaacccagcactttgggaggccaaggcaggcagatcatttgaggccaggagttcgagaccagcctgggcaacactgtgaaaccccgtctctactaaaaatacaaaattatcagttaacaaaaagatacatcgtttaaaatcagttgggtggggggcagacagtgagatgccaaagagcatatacacttgaatatatagaatttcaagtaagtgcaatgaaggaaaagaatgagattcagtaagagagaatagaaagaactttagagtgaattatcaggagacctttctgaggagtcaatttagtgtaagtcctaagcactgtattacctgttccattgtgttacttgttttgctcagaaaggtcaggtttctggtaccatgccaccaagattaaaagattctctgtgcaaagacaggcagcaaatcagaggaagaaataatttttagactagcaatatatgaccttgtggagttaatgttctttaaaaccatttatgaagaaattgtgatcaagggacctactttttttttgagacactgaaaatattattatttactgattggtttactttgtttttttctttcagcatactttaagattgttttatgtctctgtacctttgaaagagttatttacccataaatgaccctgaccttttttcattgtaatactcagtccaaagtaatctctgcctggaagcctttttaggtagaagagttatctttctaagatgcaaatctgaacatgtttacaaatcttgtgcttaaaatgtcattggcttccagatgtctttaggataaaaaattcttaaaatggcttaaaggtccatgatctagtccctacttgcttttccagccttatctctgatcattatcatctgttcctttaactatgtgttccaaccatagggtctttgtattatggttgatccctattcttggaatcttagaggttatctaattcagctgcttatttaatacaaaaggtttccttaagctctaaaaatgtagtttactagattacctaaaaaagcaccttttttagttcctagttaactgcctcctcccttctgccgcttctcccttccttccttctctccatccatctgtcatggtgctagggctgtcagagtccactggctgcatgaaattaatatcagtagatacgagattgaaaagataagcaaattagaaagactataacctcaacattattttcaggttactgataccagacattattcagatttattagtgatcacatactgagttctaattaacaagtttcatgtgatagaagtcagaaggcagaagtggactgtttcttgtactatatttcttaatattccctcttacaaagggagtaacaataataagcagttactcgttattgtcatcactgctaggatctgtgaaaggaggagattcaggaaatgtaagcgtccacagagcagagttctttcttccttgtgccccagtggcagcaccttctatcaactttaattcctcagagaaagaggagaagggcattaggaaatgaacattaggcatgtaattataatgccatgtaaaggaatgtggtaggtttagttaccttttaacaataaaaggactaaatgataggatttgcttaaattacaatttttattgtacattgttttattgttcctcataggttagctcagactgagggggagaggttggaacaatgaatacctggagagtgacaactgtgtcaggtgctatcctgtgtgttttcagttccagaccgttatccatgtgtaatagtttctatcctgccgagcttcatttatagaatcaaattgaaagggaaaacacctgtacaacctggccaatcagacagcctcacatatctttttcttcatagtatcttttaactaggatattcctcttctaaaaaaaaaaaaacaaagtcttggctgggcacagtggctcacacctgtaatcccagcactttgggaggctgaggtgggcggatcacttgaggccaggagttcaagaccagtctggccaacatagtgagaccacatctctatttaaaaaggtaaaagtttcaggcggggcacggtggctcacgtctgtaatcccagcactttgggaggccgaggcgggcgaatcacctgaggttcgagaccagcctgaccaccatggagaaaccccgtctctactaaaagtacaaaatgggctgggtgtggtggtgcatacctataatcctagctacttgggaggctaaggcaagagaattgcttgaacctgggaggtggaggttgcggtgagctagtatcatgccgttgccctctagcctgggcaataagagtgaaactccgtctcaaaaaaaaaaaaaaaagtttcaaggaagaactcattttttgtcaagtggtgaaagcagctagctgaataatattcaggactgtcaaccaaatgggaggtcagaagctcacccagtcggctgcaaccatggcggagccagaggggctcaaggggcctgtgctataccaaggctgcagttccttgcaatgctctagatgaccctgggcagtctattcttgagccccttcatagtcgctgtgattgtcaactaaagaaaagctttttaagaattaaagttattgtatttagaagtcttattgagaactgtagacagagcctgctgcctgggagtagtcttttagagaggttttgttagccttttctggcactgtattttagtctactgtttatgtataggtggtgggggtttcgcatatgtaaaattatgttacgtttgtttagaagttagaagttatattagagtagaatatgttaaggtttggtgtaagagtatatttggttatagattatagaagtgtaattactaactgtcatttataggaaaaggcaaggttattatcttcaaggaatatagtgacttaggcaagatatgtggggggagtgtgtgttttattttgtcttaaaagtatttggaaagctgtgtatcatcatagagtcaagaactttgtgaaattgtgttggcaagcagaaatgagtaaatatggctttttttgtggtttgttattttgtctcgcatatggatacctaaactactcacatatgaatgttacttcaagaaaagaaaatacatgaattgatcatattaaaatagttaccttataagtgacattctgtaccgtctgaggtgtcagaggttggggtcatagatgagggagattgtgaaagaaatttacaatactgggccaggtgcggtggcttgtgcctgtaatcccagcactttgggaggctgaggtgggcggatcacctgaggttgggagttggagaccagcctgaccaacatggagaaaccctgtctctacgaaaaatacaaaattagccaggtgtggtggcgcatgcctgtaatcccagctactcgggaatctgaggcaggagaatcacttgaacccaggaggcggaggttgcggtgagccgagatcgtgccattgcactccagcctaggcaacaagaggaaaactccatctcaaaaaaaaaaaaaaaaaaaaaagaaagaaaaaagagaacttagaatcatggtaattataacgtggggataaggcacagtgccgcctgcctgtaattctaacattttgggaagctgaggcgggaagattgcttgagccctagagttcagcttgggcaacatagggagaccctatctctacaaaaaataaaatatttgccggcagtggtggcgcacacctgtgatcctagctacttgggaggctgaggtattttgttttatgcttacaaggggtatacattttaaaagggtataaatcactatgttgccttttaggtagctgtttctgaaacttcaagtcagatacaggaattgattttttgcttttactcctgcgaactcactatgtctttcttttgatccagctctgtttaagggagccctttagagaaatgctaatgactcacaagcatgtattagttccccatctttttctttgttttaaaattctaggaattgaagccattttttatgaaggaagttggcagtcactttgatgattttgtgaccaatctcattgaaaagtcagcatcattagataatggtgggtgcgctctcacaaccttttctgttcttgaaggagagaaaaacaaccatagagcgaagtaagtatgtgctattttcttttaatgcaaacatctactcagtatagttcaatggtgaaaatggactgcggcaaatatgcttgagttcacaccctggtgtcactttctattggctgtgtgttacattgggaaagttacttaaccatttgaaggaggatggggatttctttgtctttacatataaattataacatacatgcatacctcttttaacactaatgccgggcacagtggctcacgcctgtaatcccagcactttggaaagctgaggcaggtggaacacctgaggtcaggagttcaagattagcctggccaacatggttatttaaccatttgtctctactaaaaatacaaaatttagccgggcgtggtggcgggcgtctgtaattgctgctactcaggaggctgaggcatgaggatcgcttgaacctaggaggcgggggttgcagtgagcagagatcatgccactgcactccagagagagactctgtctccaaaaaaaaaaaaaaagactgactaataaggtcaggtgtggtggctcatacctgtaatctcagcactttgggagggcgaggcgggtggatcacttgaggtcagttgtttgagaccagcctggccaacagggtgaaaccccatctctaccaaaaatacaacaattagctggacgtggtcgtgcacgcctgtcgtccgcctgtcgtcccagctgctcaggagactgaggcatgagaatcgcttgaacctgggaggcagaggttgtagtgagccaagatcatgccactgcactccagcctgggcaacagagaccctgtctccaaaaaaaaaaaaaaaaaaaaaaaatactgactaataaaacaacatagccaacacttgctgagtgctctacatgatgaattcatttaaaccaaacagtgatcctatgagacagataactgtagctatccgcatgttacagattaggaaactaaagcacagagtacttaattaaatgtccaaaattacatagcagggatttgaacctagagtctagctctagagtccttgctcttaatcatataatggctgggcatggtggctcacgcctgtaatcccagcactttgggagaccaaggcaggtggatcacgaggtcagaagttcaagaccagcctggccaagatggtgaaaccccgtctctactaaaaatacaaaaattagccgggtgccatggcaagtgcctataatcccagctactcgggaggctgaggcaggagaatcactcaaacccgggggaaggaggttgcagtgagctgagatcacgccactgcacttcagcctgggtgacagagtgagactgactcaaaaaaaaaaaaaaatcatatcattacgtgcctctctatttgctatacaattgttgtaataaagtacaatgcgattagtatatacttttctaattgatggttcatccagaataatcgagtgaaggctatcaaaggctaatatgtgttaacttgccattccatgctcttctcagttttatgcccctgtttggaggcatagactgatgttctggagaatagttttgaccaattatagttaagtgctggtagtagtacgaaaagccctaaagaagataagcaagatgttaaaatgggagtttttagtaacttgcagcaacctttaagatcaggaggctgttgggagttgctggaagtcccttgatatcaggaagggtatggtaaacatcagtgcagtttcagaggacagatcagtaacagtatatatgacctggagtagagtgtgcttagaggcctgtttatgaccttaggggatctctacaagaaggaaaagtgattgccaaagtccataggggctgagtgtggcgaccttgccattctctacaagaaggaaaagtgattgccaaagtccataggggctgggtgtggcgagctttcccttcttaagagttgtgtatgtacctgcctcacagagagggtaaatgaagtaacatacataaaactgtaacacaatatttggatctgttttagctgggcatggtggcgggcatctgtaatcctagtagtgaaaaggtcattggtcaattaatgttagatggtgttattggtatattctcttgtctgtgggattagatttcttataatacttgaagtacttatatcttgttttaatttttcctcttctcagggatttgagagcacctccagaacaaggaaagatttttattgcaaggcgctctctcttagagtgagtatttttagttgtttttaaatatgtttgatttttaaaaaactattctgatagaatcattgcttagtatatggacatgtaatgagttctgtatctgtataaatcattagtgggtttttttcttctatgctctctcttgctcctttctgatcttttggttctgtatctagtttcaaaagaggagttagggataagaatggttatctgggcttggcactgtgactcacacctgtaatcctagcactttgggaggctgagacaggcagatcgcttgagtccaggagttcaagaccagtttgggcaacacggcaagtctctctctacaaaaaatacaaaaaattagccaggcttggtggtgcatgcctgtaatcccagctactcaagagtctgagacaggaggatcgcttgagcccggaagggtggaggttgccatgggctgagattgtgcccctgcactccagcctgagcaccaggtgcaacacccagcaactccagcctgggtgacagagcaaggctgtctcaataaaaaaaagtgtacttttctttaaaaagacatcttatgcttatcaaaagttactttctgtgagtcaagttgatgtttactacttcccctagataagaaggccggttttctaagcatgtaatgtgctgttcagtgttttctaagcatgtaatgtatagtgttaagtgttctgttacactgtagtttgaaggaattaatcttttaaagtttacatctgggggaaaacgcaggcttttcacataaaagggaaaagaaaatttattttaaacattataattaggattttaatgatagaatttatacatgaaaaataaacaaaattacatattaaaaaaatttttaaccaaggaaacaaaacatgttttctatggcttagatgagtttttattagactgtgaagatccttggtccagagattgagtagtagtatattagattactcaaaatcatttaaaagattagcattatctttccaaaaacaagttaaaacaagtttaaaaacctgttttagtcagatataaaagattatttaggaaaagtcatctatattattgttatattctaaaagaaaattagaccagtcttaaatacaaaagtcaatgagaaggtaaaatctttgtaaatggttgagttttatagacgtgtagggtagtaattggttatcatcatcatcatgatcaacattatagaaactcatgtcaattttaacattttggaaataggtagtacttaatatatattaaatttagggagtagaatatgaataggattaaaaaattcttaacatttgaaatagtttgtttcctgtttttagtgactggcctttgtttacttagaaaacatccatttctggtaggttttaaagaatgtagaccattcttttttgagatgtttttggagagtggattaagcatcttctcaactgctttaagttaactgctttaagaaaagattttatggtgttttaaatttaaatatacattattaacttgttttgtttgaactacatttacagtgaactgcttgaagtggaccacatcagaacaatatatcacatgtttattgccctcctcattctctttatcctcagcacacttgtagtagattacattgatgaaggaaggtaagacaacaaaaaagatggctggctagttgatgcatgagaagttagaggttttcactaaattttggtaaagggtaaattgattaaattgcttcaggaaatcctaaagcagcagatttgagggtgatattcctttgccctgaaaagtttaactgatggagaaaattagaagtttcattacttttatttttaaaatggtttatttgaatagaccataatcagtaatttctaggtaattttcccaaatgggagaactttatacacagttgacctacgaacagcacgggtttgaactgtgcatgtctatttatacacagaattttttcaatcaatgtgtttagcactctgtatccatgggttctacatctgcaagcaaaggctgattgggatctagagtattccaggatgcaaaacacacatataagaatggcagatttttcatatctgtgggttccacggggccaactgtgggcctcgaatttgcataagttttggtgtctgcacagtttcctggaaccaaccccccatgtatagggagggataactgtatatgacttattaactttttgattgtctttatttaagatggttacttaaaacaagtagcttattggaattgaaggttgaaaaagttgatatttctttttaatgtgaaagtcaaattataggccaggcatggttgcttgtgcctgtaatctcagcactttgggaggccgaggcgggaggatcacttgagcttaggagttggagaccagcctgggcaacatctctacaaaaaatttaaaaattagctgggcgtggtggcagacacttgtagttccagctactcaggaggctgagataggaggatcgcttgagccagggaggttgaggctgcagtggagctgtgtttgtgccactgcactccagcctggatgcaaaggagaccagatctcaaaataaaattttaaaactcaaattgtagcttaaaaaatgacagcgtggtaatcatggattgaattatgtactttttttgaaaattaagtttggagataatggtatagtatattaacatatttttaaattgtacctatttcttctgaaaaatcatcttttgtacataagaacgattgctgtttgaatattttccatagaatattttacagttagaaaattaatgtgagaatctaatctttcagaagttcaaagtccaattatcttagatatcttaagtttgaagactgtatttatcttagggcttttagaaaatttgtttctaaagaacatatattgttgatatatatatatatatatatattgtaaagcagatggttagaagcagatctctaactagcagaactattacatccatgacttcagcgtattaacgttgtggtgtttcctaaggttgaaagtttggtgtttgaaacttttaaattctgtgaactcagtgtatattaaaaattcacctctatgttctttttctgtaccttttctccccaggctggtgcttgagttcagcctcctgtcttatgcttttggcaaatttcctaccgttgtttggacctggtggatcatgttcctgtctacattttcagttccctattttctgtttcaacattgggccactggctatagcaagagttctcatccgctgatccgttctctcttccatggctttcttttcatgatcttccagattggagttctaggttttggaccaacatatgttgtgttagcatatacactgccaccagcttcccggttcatcattatattcgagcaggtaaggttttaagtgttacccaaggcgatgctgtcctcggctaaaataataataatgatgatgacatactgatactattatttttagctgtattaacttggataaattttcatatattgttcttttgccattatctgtaaaattgttaaactagaatcatctcacctcttaagtttcattgtagcttccatgttctctgaattttgataaataaattacgttgaacttttttttttttttttgagacagagtctcgctctgtcacctaggctggagtgcagtggcaccatctcggctcactgcaacccctgcctcccaggttcaagtgattcttctgcctcagcctcccaagtggctgggactgcaggcgcctgccaccacacccggctaatttttgtatttttagtagagatggggtttcaccatattggctagactggtctcaaactcctgaccttacgatccgcctgcctcggcctcccaaagtgctgagattacaggcgtaagccaccgcgcccggccacattgaattatttttgatgcatcaagattttgtttctgaatactttttgtaaaagtcatttaaattataaaatattttcataattaaaaacttcacttttgaaatgtcagattcattgttttgtcatgtaactatataataaaggttttattttaatttgtttatacacttatcaggattttctgactttactggctatctataatgcatttgactaatggaaaggacacttgcaggagactttctttgaagagacatctttttcctcctgcttttgtagattcgttttgtaatgaaggcccactcatttgtcagagagaacgtgcctcgggtactaaattcagctaaggagaaatcaagtatgtaatttcttttgttcattatttcttcctcccctcccctcctctccccccaccccattcccttcccttcccttcccttctttccttctttccttccctccctccctctctctttttctctttctctttctctctctctctctttttcttttcttttctttgtgtaatttcattagtttaaaggattattggctggatatttcaccctttgttgttttctgggatgtcacattatataatgtagagattgtgttttatttcaaatatatattatccatattgattttgaggaccacttcattgtttcctgactattccggctttgcccttgaacctacaattttaaaaaattgattatcttttgcaactttgcattatttttatggaatgttaatagcctcattacacctgtgcctgcctattctttgcaaattgttgcttcacactctagaagttatctcagtcacaggaataacttggtttaaagagattggtaatattcaattcgtgcaagaataagaagtcattccggagatcaggaaaaaagaacatgagctgataagtcattttattcttccctgttctgtgcttccttatattcccccctgtatttttgctgtgaaaaatcaaagagcctttgctctaactatagttttccttttctaggcactgttccaatacctacagtcaaccagtatttgtacttcttatttgctcctacccttatctaccgtgacagctatcccaggtaatggtactgtgaaccagaaatgtggtaaacaccaaaagtgtggcatgagtgaggtgggataggtaaacaggggccagttcatgtagggacatagaaaatatagaatgagttttcattttctgtctgacctgagaagcctcaaatggtgagtagggaagtctaatttgattatagtaattcttgacagaattataaagtatttcatatggtcataaatgatgttctgaattaattaatttttatttatttttattatttttaatttattttttattaattaattaattttagttttttctgagatgggagtcttgctctgtcacccaggagtgcagtggtgctatgtcggctccctgcaacctctgcctcctgggttcaagtgattctcctgcctcagcatcccaagtagctggcattacaggtgtgtgccaccacgcccggttggtttttttgtatttttattagagacggggtttcaccatattggccaggctggtctcgaactcctggtcactgccttccaaagtgcttggattacaggtgtgagccaccgcgcctgaccaaaaaacattaattgtgagggtctttattcaagttcaattactttatttagaaaccttatttttgtttctttctttttcaggaatcccactgtaagatggggttatgtcgctatgaagtttgcacaggtaagtttttgtaactgcctaaggtatgttgattaggggatggggattcatatttatgataataatataatctagttaaatctaattgggagctaagaatgctttctgttgacattatgcagtcttttaaactatttccagtacggtaaatggtgtttgttttgccaacatcaaaagtaattttctttaataaaagaatatattaggctgggcgcagtggcttgcgcctgtaatcccagcactttgggaggcctaggtgggcagatcgcgaggtcaggagttcaagaccagcctggccaacatggtgaaaccccatctctactaaaaatacaaaaattagcctggcgtggaggcacgtacctgtaatctcagctactcaggaggctgaggcaggagaattgcttgaacctgggatatggaggttacagtgagctgagatcactcctctgcactccagcctgggcgacagagcaagactccatctaaaaaaaaaaagaatgtattatttataaagtaattctaattggttatttcagtaagcattaatttcccccttccttcctgtttttgggggaggtatatatgtatgtgggtatagtctgactcttacccattcctcctcccacctccatcagaatcattaatcctggaagatcccattttaaattagtgtctcaatcaaatgcccatttatgaagtaagttctttcattaaggggtttttttttttttttttttttttttttttttttttttttgagaaggagtcctgctctgttaccgatgctggagtgcagtgatgcagtcttggctcactgcaacctctacctcctgtgttcaaacgattctcctgcatcagcctcctgagtagctgggattacaggtgcccaccactgcgcctggctaatttttgtatttttagtacagatggggtttcaccatgttggccaggctggtctcgaactctgacctcaagtcatccacccgcctcagcctcccaaagtgctgggattacaagcgtgagccactgtgcccggccatgttacgggttttaagcagcaggaaaacaggttccaagagtaagctcttctaaaaatatcatttggtaaagggttaggaaaagtgatggtagaaactaggcttgagtaatctccctgaaggattatagcagtcttctatactagtgttaaatggaatacatatgcgaacattactgtaagggtcacatctgtactttcttttggagagaaaaaaatcgccttccatcttattaagccatcgttattataattctgtctctgttatgttccaggtctttggttgctttttctatgtgtactacatctttgaaaggctttgtgcccccttgtttcggaatatcaaacaggagcccttcagcgctcgtgttctggtcctatgtgtatttaactccatcttgccaggtaacatgggtacttgttaatttggtcatgcataaattcacgaggtaaatagaaagctattgcctatgagcacctttgctttgcctactttttcatctaaacttctatacatctatgcccatcttgacctcttttgcatctactttataaatgaagtatccttcatccagtctcaggtcagtctttcatcttatggctttcactcaagttgtgcctttctctgacagtggacagtccacattcatgctgtgtcttcctgttcgctattaagttcattgtaatcttgctcctgattccaccaagccacttaaatgccccttgttgaaattactagtaacttgtagaaattacttgtagaaattactagtaatccatattctaatccagtggatggattaagatgtactttaccccttatccaagttgacctccatgaagcattgggtgctgctgaccacatttttaaatctctcttgtcactgttttcttgccttttttttttttgaaatcgggtctctctttgtcacccagtctgaatgcagtggtgtcatcatggcttactagcctcgacctctggggctcgagtgatcctctcgcctcagtagctgggactacaggtgcatgccaccatgcctggctaagtttttattttttggagagacggggtctccctatgttgcccaggccattctcaaactcctgggctcaagttatcctcctgtctcagcctctcaaagtgctggggttacaggcttgagccaccatgcttggccttttgccactatttcttattttcctcctgtctttccgaccataccttgatttcttaaatatatttattgcatttttttgtctattatagagatatatgagtacctagtactatgccaggtgcagaggactcagaagtgaacaagagatgtattatctttacagtctgggagcttttatagtttcccttacttttcctcttttctttactcattgaatgttggtaatgttttctgtcatcaccttccctttcttttcttctcttgcattcctcttccagtaaccctccctcaccagccccaggacttatttgaatgaactctgtatctgtccctaaaatagaatatgtgttacatacttgagtgtcttcctcactagctgcaaagttattgagttcaaggattgtgttttatagccaatcacagtctctctcatattgtctggtacatagttgatgctctataaatatatatttttcaataaatgagtgaaagagatggacatataaatggatattttacaatatattgtaatatgtactacataagtaggataaacaaaatgcttatggcctttgtttcacattagagataacatttaatattgggtattgaaaaataggtaggtatttgcctggcagagaattggtggaaaggtcattctaggtagtgggatggatgcaagggcatggagcattctggaatggcataaacccagttgtggataatgtttacaacacttagagggtagaatcactggagatatgtttagaatgttatccatgtcactatgttaaccatgtcactattaacattttggactggttaattctttgtttggagtggcattcttctgcattgtagcataaactgttcagcagcatcctggcctctaacaactagataccagtggcaccactccctctcctccaattgtcacagcactggtgcagtagcttgcaccggtagtcccagctattctggaggctgaggtgggaggatcacttgagccccaggagttgaagttcagcctgggcaacatagtgaaaccctgtcttttaaaaacaaaaagtctctagaatttcaaatgtcctgtgggggagagggggcaaaatctctcccagttttaaacaattgtttaagaggggggtatgggggccagatttttaaaggaccttgggtactaagttaagccatatatttaggcatttcttaaaaacagactgggtaggctgggcgcgatggctcacgcctgtaatcctagcacttcgggaggctgaggtgggcagatcacaaggtcaggagattgagacctgcctggccaacatggtgaaacccggtctctactaaaaatacaaaaaattagccagatgtggtggtacatgcctgtagttccagctacttgggaggctgaggcaggagaattgcttgaaccctggaggcagaggttgcagtgagccgagatcgcgccactgcactccagcctgggtgacagagcaggactctgtctcaaaaaagaaaaaaaaaaaccagactgggtaatgtcatttgttgaacccactttgaaggaagttactgttttaaaattaagataattaactccaaaagtatatcatctctggaatgggtaaactggaataataacttatattttacaaaataatcccagctaaataaaatgatgtgatataattagttgcttggtatgtgagctatttggaaagactgttaatattgttaatcttatttttaggtgtgctgattctcttccttactttttttgcctttttgcactgctggctcaatgcctttgctgagatgttacgctttggtgacaggatgttctataaggtagtatatacttagacttagctttctttttacattttattaacttcttcattattagtattttgacattgttggctaatgtcaccagcctttcacacaaacattgtgaaataattttcttttctacaagttttgccagtattttctgaaattcggttacagatataactagcataaccttgtgttttcttctgtctctaatatctgctcccttaacataagcacatggtttctgctggatcctgcaaggatatattggtgattccagtaggaaactgtttgttcagagcacaccatgagacttccctgagtgttcattcatttgaaatggaccgtctagttctgtaggaatgacctcagcaaattattccatttaagacaattgagcagttcatgagggaaataacttttccctctttagttttgaaaggtgttaattttgcttcagatagtatccttatgcttctaaagttggaattaagctatagaattagagtcagaatggctcatagcattctttaaccctacctaaagctctctttgagttgtttttggcaacactccaagtctaccaccttttttctcaaagaaactttaagtgtggattgcagattttagatacctgatttcattcatctgatcttaatattgggagcaagaagcatatatagggataccaggactttgaggtagccaccatctcaccctggataattttgccatttatggtaaccaccaaacagctctctagtgttagcactctctctggtcttcatgaccatagaattttctcatgacattctagtagggtaaggggggtggggcttactgattgctgtttagatgaacattagatttaaatgattctatgtgttccgtatgaacctaggaactaaatcatatatagtatgagaattcatgtcatattcaacactaataaccaaaatgcctttgaagatttttctgtcaccagtgtatgaaccaacagtttatcacagtataatttgatttttctgttacatatgttctttgggaagtcaggggggtttgctttcgggtgggatgtgtgtgtgtgtgtgtgtgtgtgtgtgtgtgtgtgtgtgtgtgtgtgtgtgtgtagttttatacctttactttttccctcaggattggtggaactccacgtcatactccaactattatagaacctggaatgtggtggtccatgactggctatattactatgcttacaaggactttctctgggtaagtagcaaggtttaagttgatattatttatgaaatggagattctttttcagaaagtatgagtattatacagctggaagaagttatatttaattgctcatgaggaaagggtgatagtatcttttcagttttcttttgagaaatttacatctagaaacctgctttgaatggtactgcttagaaaccactgtgtgtacactagtaggtctaatactgtgtcttttgctctgaattttatcttacataacaaagtaagaatgcatggaggttgttggagttgaaatgatccaccaataatggatagtttcttatgagtcttgttgccaacaaataatctccctttggtctttttcattcgtttttcatggttaaaggtagagaaacactttttttttttttttttgagagagtttcgctcttgttgcccaggctggagtgcagtggcatgttgtcggctcactgcaacctcctcctcccgggttcaagcgattctcctgcctcagcctcccaagtagctgggattacaggcatgcaccaccacgcccagctaattttctatttttagtagagatggtgtttctccatgttggtcaggctcatcttgaactcccgaccttaggtgatccgcccgcctcagcctcccaaagtgctgggattacaagcatgagccaccgtgcccgggtgagaaacacttttctgtgagaaacacttttgtgtggattttgtatctctccaatcagtgacacctggctttgagacattctttagagcagaatatacttagactgatgagatgtaatcttgaatctcctggttgataaacaggtatctagattacagtttttattaagtgagggcaccatttggcttagtgacagcatcttatggtggaaatagcattgtattaatatttgagtgctaattctgtcattcaagtgtagtttcacatacggataaggcaagtcccttttctccttctgaaatcttagttttgttatgtgtaaaaatggagaggacagttgccccatctaccatacagtgttactctaaagactgaaattcaatatgtttcatttatataggaaaactatgttttgtcagttgtaataacttacaaacataagttattgatatttttgaaaatagactcagatatttgaacaataataagagtttgtaagtgtatatgatttgtagttattttaatagacttggattaatccaaggagtagacttagaaaattaagtacaaatacaataggtgcctttggcatataattttacatcctatataatccatgcttgctttaaatttttaaaaattactttgtagtgttttcctttttctttagtttttctccaagagattcaaatctgctgccatgttagctgtctttgctgtatctgctgtagtacacgaatatgccttggctgtttgcttgagctttttctatcccgtgctcttcgtgctcttcatgttctttggaagtaagtatcttggtatgctgtgagtactgggtactatgctaaaaaagaaaaccagatagaaaggaaactataaaatcaatgtaggagaactagatagtagtagtaacattttaaggtagtacttctttatcagatggtcagaatattgactttgaataattatacacagctctgtctcaagatatttacactttgaagtagggaaatgaactaggtaacctcatgaagaccattgataacactgatttgataggtcataaaagttatctatataaacagctttcccattcgtaaacattgtcggtatgcaccccctagaaaactgacaagtttttgagtgagtagagagggaaaagttggaatatgaatattctaattccatgaaatatatatacacatgttctgaaaacactgatttcttgtaagttactgattttaacactgaagctttatttttctttatagaaacagtgaccagaataaaaaaatatataaacagttgttgctcactgtgattattaaataacagcagatacctgaggtccctcatcttctgataaattatgttttgatacctgtatatttctttctttttttttttttttttttttttttttttttttttttttgagacagagtttcactcctgtgacccaggctggagagcagtggtatgatctcagctcactgcaacctctgcctccctgcttcaagtgattctcctgcctcagcctcccgagtggctgggattacaggcacacaccaccacgcctggctaatttttgtatttttaatagagatggggtttcaccatgttggccaggctggtctcgaacttctgacctctgataactgtatatttctttgttgccttcctatttttagtggctttcaacttcattgtcaatgatagtcggaaaaagccgatttggaatgttctgatgtggacttctcttttcttgggcaatggagtcttactctgcttttattctcaagaatggtatgcacgtcagcactgtcctctgaaaaatgtgagtcaccaacctggttggagtgcaaaagaacctgtttattctctgtttgtgagagttggtgggcaatgttgaggagcacagtagtggagattatgatgaattagtgttaaagagagggaaatgaggagtaaaagcattagtttatcatctgatcttattgtacttgaagtttttccttttgtttagttttcttcacatttaactctcctagcttttggttttcttcttttactgccttttcttcagccccttctaattttttttttttttttgagacagagtctcactctgtcgcccaggctggagtgcagtggtgcaatctcagctcactgcaacctctgcctcccggattcaagtgattctccttcctcagcctcccgagtagctgggattgcaggagcatgccaccatgcccgctaaatttttgtatttttagtagagatggggtttcaccatgttagccaggatggtcttgatctcctgacctcatgatccgcccacctcggcctcccagagtgctggagccaccgtgctcagccagccccttctaagtattctccagggttttcctaatgccatgtatgtccctactaccaccacctaaaacatacctttttttttttttaaacctctttcttctaaataaactcttgtaaaaatattgggcaacactgagatccttccatttctcttgattctatttttgtttttggtaattcaggtttcatttattcttaggactttagtttttagctatacatgggtacagattttaggaggatggctttttttttttttaagaattttattttcaagtaacacagtataggacataggaatttcccagcaaacactctggttaatttaattgatgtgatctggttaattagatctactagcactagctgaaagtactgcttatagttatggatagaatttcatgatggaaacaccctaagaagtaggattgccaggctttttgtgcatatagggcgtgtcctatatttaacatttttgtcctgcctcctgtattgggtttcttagaacaccccaaatgtcctatattctgcttttttcagtaaattacaaaaaatatggcagatagagctatttgtctcaagttcatctcggcatcctgtacttgtatttgctaaatttggtggccctactaataattcattcaatccctacaaccttccaggtttggaggggataccttcttgatttatttcctgggtatttctcataggcatctgtaactgaagatgtccataatgaaattaatcagtttcctctccaaagcttcccctctttctgtgtaccctatgtctgttaggctgcctcaactctccctctttatttcatattaatctcctttgttcatctgaagtaattgctcttgactgtccctggtcacctggattccacatgtcagattttattctcctatcaaaatccagtttggatgccacatcttccatgatgatttttcaaatgcttgcttccctctctttcctatttctgaacttttgtagtgcttcatttgctcctcctttgatagttcagtaattttaaaccttgtattagtcatttttatatatatgtcatttatgtatatattagtcatttatatatgtgtatatataatatatatttatatttatatatttatttatatattatatattaactaatatatactaatatttagtaccttaaaatctaaatggtggttatatataaatatatatatatatatctatttgtcgtccttaaccaccatttagattttaaggtactaaaagtagggctgtgctaaaataaagatacagaaagaaatagtgcctatttagaaactggtcaaagtccacacaattgtgtatagtttactggactttaaaagctttatgtgaagcacctaattgaataaatctgtgttatagataaaagtactgaacatcttttgaattagtgagctgcttataccttgagggttgttgaaatggtgggaggcattttagagatgtacaatgtatcatattaacatccctgcctatctccacacctcctctactctgtacacaaattatttttccattcttatttttccccactgcagcccacatttttggattatgtccggccacgttcctggacttgtcgttacgtgttttagaagcttggactttgtttcctccttgtcactgaagattgggtagctccctgatttggagccagctgtttccagttgttactgaagttatctgtgttatttggaccactccaggctttacagatgactcactccattcctaggtcacttgaagccaaactgttggaagttcactggagtcttgtacacttaagcagagcagaactttttttgtggggctgggtggggggagaagaccgactaacagctgaagtaatgacagattgttgctgggtcatatcagctttatcccttggtaattatatctgttttgtttcttgactctgtccaatcagagaataaacatcatagtttcttggccactgaattagccaaaacacttaggaagaaatcacttaaatacctctggcttagaaattttttcatgcacactgttggaatgtatgctaattgaacatgcaattggggaagaaaaaatgtagaatgatttttgctatttctagtagaaagaaaatgtctgttttccaaagataatgttatacatcctattttgtaatttttttgaaaaaagttcaatgttcagttttccttagtttttaccttgttttctctataggtcatgatttctgtgaagcaaaaagatgccttttaccatgaattcttgagtttacatcaataatattgtatattaaggggatcagaagtaggaaggaaaaaataagagatagcagaggaaaaagaaaaacatttcctcttataacttctgaagtaatttgtaaaaaagatttgtagagtcaatcatgtgtttaaattattttatcacaaacttaacatggaagatattcctttttaactttgtggtaacttctttgaagttatttagaaatatcctttggaacaattattttattgtctaataaatattgacttctcttgaattattttgcagactagtgagtctgtaccataagtattaatcacctccactcatattaaagtgatcattaagaatccagaagctggcttctgcatttgctcagttatacttttaatggtagtatgtttttaggtggaataaattaatatgtgattggtttcaaggaaatgtactctattatgtaatacttccattttataagatgcccatttctaatacaatgtgtgtaggaattatttgtatgtatgaggtatgattgtaaagattgagcattggaaggggtatcagagaccatgtagttcaactttccactcaaagtaagatttatgaattatttaaatgatagttgttacttggaacagccacttgagaggctctcttggtattgtttggaattgttttaaagtcagtttgagtctcacaagaaggtaagtagagtttcttaatagtcacaacttaatttgaaccacaagtatccagcttaatcacgtatcttactcacgataccactggtccagatgagtttaggtaattttcaaacattaaatccaacttcaacggaaacaaatacactcaagggaagttatttttaaaaaggtactctgcatgttcccgcagtaatgttctgcacaacagtattgtaattgtaatggaatcataacctgctaactagtttgctttaatatggcttgtaattcttgacatttttcttaaaattaaaacgaatttttattttgaatttataactgcattttaaatatattggggacagattgcgctgagacctggttatgagcaagccaatcttttgaatctagagaatggaattcttaggtttatatttctgttaagaaatactataaatatgactcttatgagaagactttgttgctctgtagtgtttctgaatactgtatttgttggattgatcaaggctatttttcaaaaagctctctgcttcctgtttgtttgtttgtttgtttttgagacagagtcttgctctgtcgccggggctggagtgcaatggcgtgaactcagctcactgcaacctctgcctccctggttcaagctattctcctgcctcagcctcctgagtagctgggattacagggccacgcctggctaatttttgtatttttagtagagatggggtttcaccctgttggtcaggctggtctcaaactcctgaccttgtgatctgcccacctcagcctcccaaagtgctgggaagacaggcgttagccaccgtgcccggcctctgtttcctgttattagtgattttcctgcccaagattgcaacaacaaatatgtagaactacagactgtttagaatgctgagactgttctaagaaactttcaaaaacagtagcacttcaaggaatggtcactttctatgaaagaaactggtttgatagccataatcttattgctagctgcttttagcaaaagtcttttcttgaaaccaccacctatactctttaaacaaataaaaactaaaatctcttgctaatgtttcaggaagatttattttttctattttgctattgtggcgaaaattattttcagttataggatacttttttccttctgaaaagtaataagcttaaagtttttgtttctgtaagatgtaatgatagtaactattattttgggcatattaaccaacagaacaattatgtagtatgtatatcactttctcattagatctctaacttgaccttctagtacctttatgtgtgaggataaatttgttagatccttttattctcaatcttggataatgatgcaaaatggaattttgttttgtttgttggtagattcacatactaaaactttgcaggtaaagttgcttgcctcatgttagaatttaattagaaaactgaggctgcctttttttttttttttttttttttttaagacagagtcttgttctgtcgcccaggccagttttttttttcttgtacagatggggttttaccatgttgctcaggctggtctcaaactcctggagtcaagggatctatttgcctcagcctctcaaagtgctgggattacaggtgtgagccacggctcctggctccttgctccagaatcagttttttaatggaagatagctcatactttgtttttgtttttaaagagacagggtctcactctgttgcccaggctggtagtagcgtgatcatagctcactgcagtctcaaactcctggactcaaatagtgctctggagtacctagaactacaagtgcctaccaccacacccagctaatttatttgtttttttttttttagagatggggggggtctccctatgttgcccaggctggtctcaaactcttcacctcaagcaaaactcccactgcagaaagctttgggattacaggcatgagccaccatgccaagcccatacttattgttaataaagtttcagtgacttgcttactaatcttatgcaaaatttcatgtaatttatgtaatactacataacaatgctacatatggtatgtatacatacactgtatacacacaaaggtctgttctgggtattttatgtatcttatctctaggctttatggctctgaaatggagggaactggacataaatgtttcaaggaataaagtgaatgttttgtttgtttgtttgttttgagacggagtctcagtcaccaggctggagtgcagtgctgtgatctcagctcactgcaacctctgcctcctgggttcaagcgattctcctgcctcagcctcccgagtagctggcattacaggtgcctgccaccatgtccagctaatttttgtgtttttagtagagatggggtttcaccatgatggtcaggctggtctcgaactcctgacctcatgatccgccagcctcagcctcccatagtgctgggattataggcatgagccatgctcccggccaaagtgaatgttttgggtgaagtttatataaggatttgacttttgtatcattattaaagtttctgtcaggtaatacagtgttggccctctgttgaaataaaatgttacatatcgctgggtgtagtggctcatgcctttaatcccagtactttgggaggccaaggcaggaggattgcttgagctcagaagtttgagaccagcctgggcaacatagcaaaaccttgtcactataaaaaatacaaaaattagccaggcgtggtggtgcacgcctgtagtctcagctactcagtcggctgaggtgggaagatggcttcaagccgggagatggaggcttcagtgacctgtgacctgtgatcacaccacttaattcctcaaaacatttatgtcccagttccctccatttcagagccatgggcaacagagcgagaccctgtctcaaaaaaaaaattacatataagcccggtttaaagagaggataatatgcaaccaccctagttgaaacagagtgtatcacttctttctcaccctaaatttaatgcctagtttgaaaatcagtagacaataataaagttgataagctttaggttggtaggaaagctatgtaatctatatagtgtactaaatccttatatgtttttggtaaaaaaagactttaatagctaatttggacttcagaaaatgggttaatttcacgagtgcatatcacttttgactatattagtcaagcatattattaaagtttaaaaaactctaaaacttctgtactgtttttttcttaagtgctctcttccttatttctacattactacattcacatttctgctgtcaataagccctaatggagtgataaactttaagctagtagatactgcaccatgtcttgtggtggtgttttcttaatgaaatggaagctgtacttcctgtttgtttttaaatacttttgaaacagacagttcatgtaccccatcatttagagatgcagtttgaatttccatggaaaaaggtgccaattttggattgggaaaggagctgaagccccagtcaagactttgccatttggggtaatgcagcagattcctgtgtctgtatctttccagtgtgtgtgttaatccatagtgttctgagcaccagaagggtcatgtaaatctgaagttgttattaaaggtttttctatagtgaa

SEQ ID NO: 1760 - DNA, 64967 bp, Homo sapiens; identical to SEQ ID NO: 1759

SEQ ID NO: 1761 - DNA, 64967 bp, Homo sapiens; identical to SEQ ID NO: 1759

SEQ ID NO: 1762 - DNA, 64967 bp, Homo sapiens; identical to SEQ ID NO: 1759

SEQ ID NO: 1763 - DNA, 73660 bp, Homo sapiens
taaaatggtagaataatttgaatttatttttaaaatatactgtagcaaaagttcataagttctgtgtcccagcctggacactgaccattgaaaaatagatgcctttctgtgccagcagctgctgatgcgtgccatgctccttgactctcccattctgaaacaccactattaagtctgcattctggatggtggacaggcggtgagcaatcacaatgcaggtgcggccttctctggctttgtccagggcttcttggacaacctattgataaatcagacagacaccttatcccaaaaattgtataaattagttttaacattcaagtaaatttgaaaatgttacctttctaatcaacttttaatttctagtatcttagaatctttgaactttatgcatgtgtattttgtataatcaacatttaatctacatagttatgttctgctttttaaatataacacaaatgggttcccatgctgtaaaaaaattcataagtatttaaattttctaatcttctgtttaactagttcccttttgagtattttccagtttttcattcctaatgtgctaaaaatgtaatttgtgcagcttttttcttttgaatgctttactttataaaatatataatcattttagaaaatttagaataaaatattccattacttcaaaataaccactatcagccgggcaaggtggctcacgcctgtaatcccagcactttgggaggccgaggcaggcggatcacaaggtcaggattcgagaccagcctggccaacataatgaaaccctgtctctactaaaaatacaaaaattagctgggcatagtggcaggcacctgtagtcccagctactcaggaggttgaggcaagagaatcgcttgaaccctggaggcagaggttgcagtgagctggattgcgccactgcactacagcctaggcaacaacgagaccccgtctcaaaaaaataaaaataaaaaccactatctaacgttctgtgtttttccccctgtgcttgtgtgtgtttttttcatggttgacagcaaaatcccttctatttcataaattaaataagacataagttgggaggccacacacaccttttcactttcagtatccagagctgatgtagcttcatccaacaggaggatttgaggttgtctgatgagggctcgggcaatagcaatcctctgtttttgacctcctgagagctgagtccccttatctcccactcttgtttcatatttctgcaagttaaccaaattataaatatgttgaatgaactgttgcttaacagttgacagttctatttacaagaaaaacatttagagtcaataacagtttctataacgttgtttcaacttaacagagtgtttattttcaaaatcaaactagaaaactagtgactttaattctcaatggtattctacaataggctatcttataattaactttctttaaaataggaggaggatactctaaaataacaaatgctataacggatatatgaatcaataagtcatttgttgtcattatcaagtattatgcactgtacatagtagtatgtgctatactcttatacaactggcagtgcagtcgctttgttatgccagcatcaccacaaatacttgaattttgtgttgcactatgatattatgacagctatgtcactaggcaataggaatttttcagttccattataatcttatgggaaccactgtggtatacgcagtctgtcattgaccaaaatgttgttatgtaacacaggactgtagtagtatacacagcacactatgaaagatcagaagaaggagatagaagttgttatggagacagggtagaaggagaaaaaaggggaaataaatgaaagaaatctttttagagaagtttggggagctagattttgagagagcattctaggctgagaaagagcatatgaatagagatgtaaattgagtcagttcagtttgcagggcttatgcagtgatgtatatcatgtgaattaatttcctaaggtccagtggtcacttatattaagagctgaagctgtaaatttttctattcacagtcaaatccaatatttgattcaggtcaatgtgcattaaaggttggtaaggctaaccaaaatgaaagggttttaaaattttatttgtgggtgtgagtgatttctaactatagcagaaaataaaagcaaaaataattaagctctacgtcagtgtaacccagtggaaccccgaatgctggaagaatgccataaaatgaattgtccctaccatcacttttagggacctcaagccatccttccagggctacacatgtttaaagtgaactaaaaatggatcatggactgaaatttaaaatgtaaagctataaaacttttagaaaaaaacatggagaaaatattttgggcctagggctaggcaacgagttcttagacttgacactgaaagcataatccataaaaggaagaattggtaaattggacctcatcaaaagtaaaacttttgctctgcaaagaccttcttataggatgaataaacaagctacagactgggagaaaacatttacaaactacatatccaacagtaattacaatatgttaaacaaacaaacaaaaaaaacttctgaaaactcagcagtaaaagataaaaatccaattagaatatgggcaaacaacatggagacatttcaccaagaggatatatagatggtaaataagcatataaaaaactatgttcaacatcatttgccattgggaaatgcatattaaagccacagtgatgtatcactacactcttatcagagtggtaaaaataaaaactaatgacaacagtaaatgctggcaaagattcagagaaactacatcacttacacattgctggtaggaatgtaaaatgggatggccactctggaaaacagtttagcagtggcttataaactaaacatgaaattgccatactgctccacaattctactcctgggtgtttatcccaaagaaataaaaacttgaattcatacagaaacctgtatacaagtatttacagcagctttatttgcaatagccagaaacaggaaataacccagctatccttcaacaggtgaatggttaaactgtggtacatccacactgtggaatatcactcagtaataaaaagcaatgcctatgaatacacacaacttcagggaattagctgaaagacaaaagttaatcccaaaagtttacatactgtatatatttttataaaacatttttaaaatataaaattatacaaacggagaacagattcatgtttgccagagtttgagaggaatgagggtgggaggaagggatatatgcatggctctaaaagggcaatatgagggatctttatggagatgagaatgttctgtatctttttttttttttttttgagacggagtctcactctgtcgcccaggctggagtgcaatggtgtgatcttggatcactttaacctccgtttctcaggttcaggcgattctcccgcctcagcctcctgagtagctgcaactacaggtgcccaccacgacgcctggttgatttttgtgtttttagtagagacagggtttcaccatgttggccaggatggtctcaatctcctgacctcgtaatccacccaccttggcctcccaaagtgctgagattacaggtgtgagccaccgtgcctggccagtgttcttaattagtggatctatgaatccccatctgcaatacagctgcacagaactaaatccatatgcaaatgaatgcaagtaaaacaagggaagtctgaataagatgagtggagtgtatcaatatcagtatcctgcttgtgatactgtatactagttttgcaagatattgtcattggcagaaactaggtaaagggtacataagatctctgtattccttacaattacatgtaaatccataattatctcaaaataaaaactataattgttttaaaagtaccatagggctaaaccaaacatgactgcagtctaaatgcagccctcaaccaccagtctgtaacctgaagtatggtggttttgagcttctcactacatttgtatgaggtaggcataatgtattcccatttacaaataaggaagcttggtatcctgaagtgccttgtccaagttgttaatgttagtaaatcaacatattttgttacaagattttgttggcataactttggtaattgtttgggggataaaaagtagtctcttctgatttcagctactctttaacttacgtggggtaacgtctcgatgaaaggatgtatgttggcagctttggctgcactcacaatttcatcctgtgatacaacccggctgttgtctccataggcaatattctcggcaatgctgcagtcaaataggataggctcctgagacacgattccgagttgagctctgagccactggacattgagtttctttgcttcttgaccatcgagaagctgaaaaccaaagtccacaaactataagaagggtataaaaaagaaaaaaaaactaaaaagttactagattgtccatttggaggatcgttgcatgagggtgtcagcagcttcaaaacaacaaccctccaagacttataccattgaggccagcatggccaacatgatgatttttatggtgattaagccatccctatcttggtctaactggcaaaatggtagcacatttgaccctcttttttcacacttctctttgtccttgtctgccctcctccagccatctgtgtcctactctgcgttaaagaagcctgcatcaaggtgtcccactcaggtctgctgtccccagaataatcctaacccttcaccttgacttgatttccccttcccccatgcacagcagtgaaaaagctgatcagaagcagggccccaaaagctggttgactctggtcctacctctacctctcttttccctgaaaactactagccttaactttccctcacctctctgatagcactaaggacaagaatcccatggaaaaggaacaagttacaaagggcagtgtctttgggaggattatttttgctggcagtgatggttttgtttttgttttacttgctataggcaggaggcatggtgctcctagggaagtgttgtaatatgtacttgaaaatacagcctcgtgtaaggtaaagcttacaggcaaaggaatagacacaagtccagctagtcttgatctcaataaagaaaaaaattcccaccatcgtatcagcacaccatatttacagagttttggtgagctggtttgcctatgttacctgcagaatagctataatagcaaagcagaagatttccagagagaaacaactaaattaggcttaacaaggctgatttaggcttaacaactattaataaaagaaacaaggcttaacactttggtgactgtctaatggggacaggctcccagggctctgtcatgggtgctgtcccaaggttatggcagatacaagcattatcagtaagagttggtcttcactcaaggaagagagccacggggctacatgctagaaaatcaatgacaaaagccaaatatgaaagggctggaggttgaggatcaaagtcaaagttcgagagccgagaattcaaggtaagagaaggcagcaaaactgaaagcggtggggaggcaataagcaggtagcaccctgttttggaagtcagctttgaatttgggcaggagtctgtagttcacctttataagccagtaagtcagtatttgcttagaacaatcagactgactggaaaggcccatgacagggtaaaaattaaacttatattcagtattttctgagctagactgaattccagacattctgtcctattgtccccatatatttcccagatatggtgccagttggggtttatagaatgtggtcattgtatcaaacaggattctaggtctacatttgtccaatattttccattatgacaatattggttgggccaattaaaatatagccttcaatcaagttataaggaaatgtgctcaccactgtccccgccaaggggtcgtagaaccgctccaggagctggaccaccgtgctcttcccacagccactgctgcccaccagggctagtgtctggcctttcttcacctccaggctcagcccctgaagcactggcacgtttgctcgggtgggatagttgaacacgacttcattaaatgttatatttccttcaaatttatcctgaataaatgtttaaatgttgctattataattggcctgataattattggaataagaaatattatttcaaggaaactttaccaaagactgtagtagagaaacataaaattcatatttggtatagttctggtgccagttaatattgatagcaagttattatggtgtgaaatgaaggtgagagataggggtataggtgagattagacaaaaagtcattaccatgagttgttatctaacttagtttctgatttctttaagatattcatttagctttcccaactgcttattctgaagctggaatcaagccagtgtccaaaagactctaaaggcttggaaatttagcaacagtttctacccaaagtttcagtgggcagccctgatggcaaaccctggcagtttcttaagttcactttctttatctcactcactgggcacagcaattttatcagaacatgaaatacctgggaaagtcctggaaagactgtgttaagtcctagcctctttacctacacagctgcttgtatattacaacgtgtagcatcttgtgtcatacaaagaacactcagatgtgagtttaagttacctttatagataataaagcacaggattattactctcattgtgaacgaactgcccttcttaccaattacatcttaactattataaaaagtgattaaagtcaaattactaattgcattaacatggcagaattatacctttatgtagaaatgactaaatttttgtggaaactattcagttctaatatatctggttttcccttttttttttattttgatgtgctaaacttcaggatccttgaaaccacctataaaatttttaaatgtcagtcaagttgcccaaatattagctatataaatattacaaattaaatgaaacacatgttggtgtaatcatcacaaacttatcctgtagctataatctagcagacagcaaaccttagggaaaaattgatcaagcatcatcaggcatcagagaacttacaggcttcagcccctcttcactgtagctgtcaatcagaggttgtctttcaaacagcatgaataagtgggctgcagacagcttagctttagcatagtctggagcaaatgaactggcatgtcctagagccactgcaccaaatacaattgcagaaaacaccctagacagaagtagaggaattcaaaaattagcttttataattaactccatgatgtttgaaagtctaaaggtatagtgcttaccagtattttttccctttactccttaatcatcccctttctccccgacatacattttcataaaattctagtaacaagagaaatctaggagaggggcaagatccacttcctgagggtttaccttttctcgacttgctttctgacttccctttgcatagtagcccctaatttcttaggactactgtgacttcccaaaggtttttactttcaagaagaggcttataactgaatctgatctgtgagctcagctaattttagttgctggttatactctttttagagttgagggaattgaagcacaaagtgtgtaagggccttgatcagttccaagtaagctttttctgataaagctctggccctgacttccagtttgtggtttcttctgtactaccacacaaatgataatcatcatcactgtaaataatttttattagggaaaataagcttttactagaaatagctttttatttacaattaaaataactatgctatcagttattatgcttagtatctgggtgatgacatggtctgtacaccaaacccccatgacatgagtttgcctgtattaacgaacatgcatatgtacccctgaacctaaaataaaagttaaaataactattgacagcactctggaaaaaaaagtcaccttaaactaaagttctattttctaattatatgctctttaaagatggatattgattatgacaacttttaggaagggctaaagatcctgagatctacaacttcacaaagcaatttacttctgataccagcactaccccagagaaaggagtgggagttctctactaataatggagaactttaagttttcaccttcaaatttctaaagctaagatattaaaaatgggttttaatacctaggggctgggatgagaggtatagtaaaactttcctttaaatgcttgacgaaaaggtgagttgccaaaaactaagttttaaaatagtgatgaacaacccacatgtggctgcatagcttccctgtactgcctaaagctgtcttctaggtttccataatttaacatttcaatgattttaaaaaagaaaggaagcaggaataatgtgactttccaacggttttcactttcagaaatgttctcaatattttttatacaataaatagttgtactctaagttgtaatccccagctgctagttccatttgtcccccaaaatcactcctcactttttacccatctctaccttctatccccctactccatgtctggggattccaactatcatgaactgaatcaaaaggttttcttgtcctctggtttcataggatttggccaatggaaggcacagcagaggatagggaggctggaagggagtgaggccaaggtatttgtttctttggcttctttcttgtcagattgcttgtgcagttgctgtccctccatcaaagaccacagaaagcacctatgctgagttctggctatctttcccttctcttgcctttaggcttagggtggtagcagtttccagctgggtattgctggggtgttaacttccttcttgggtactgcttaccttaacactttccaggcctttgtaaatagaccctttagcaaactcatcaattaacccatttgctgtgccatttgtttcctgctgggatcctgatacaaagattatatagatacattttttcatggtaattttaattttggatgaaaaaaaaaacccagctcttaacacactttcgcttttttgtcttgaccctgtttcaaaaatggctgttcaccactgctttaaaatcatcccaccagagcagaaacataccaaatgatcttaaaaagagttgcttccctctttcaagcccagattgcaacctaatggaatgtgctgagcacattatgaaagaaggcatcaaacagaaagaccagtagtttgccttggaaaccaaggaaaaaggagaggctgagaggcaaatgttggcagggctgtctcatctcaggcctggttagggagagagtgcctttgccagacttccaacaagtattcccatcttgttttccaggccatgttttggttgtagataatagtaagctatataaccctgttttgagtccatggtcaccagcaactttctaattatgattttttctgcctatattctataatgagaaaatttgcatcatcctgaccaggatcatatgtacaactaaaactgtgctttctgatcattttcataagcttaattgtagcccgcaaaatgaaactgcacttggagtattaacaagatcagatctctgtgcctgccaggatggaaactgtggtaaatttaaatccctgacctcatctttggacacaggagtcatttttttcctactctaaacttttgcataaacctactaaaaccttattatagaataatcttaatatttctaaagctacttacagaataacatctctgaagcgcatatgtccattcacaatgagatatgcaccaaatcgaaaacaaccggcataggaaaaatacataaatgcttgtgagatactaaaagtaattccatagatgtgtgccttctgcacagaattcctgaaaagcaaatcagtatacttgtaaccatctcttcagcctcctttagcgctgtgtagtggaaagagcacggcttctaagtctggccgagtgggtttaagttccacctccagttatattagtttgggtaaatgataacttctctaaacatttataccatggaaataatcactgtaatgcagaattgttttgacaaaaaccatataaatgtctagcacagtgcctagttcatagtggttcctcaaatgataactgatattattacatattaatatctgatgactccaatgttcaactcctattaagcatagttgttgtttcaaaaatacctaaaatgtcaggatctgaatttaagtttgaattatctgaatgtgatttactactattatgttgtttcctgtaactaattgtactctgttaggttaaaattcatgtttcagattcacaaaagttgagtccctgaagtttacatagatatacaccagaagtcctttcccaagctagatcctgccagccgcccctgtatataatttattttgtacagtttctaatttgacttcatgctatactttattggcttctgaatcctccaaaagaactataattgagttactctcaaatatgagggtgtttttggcaaaaggaaaaattcaaagtattactaatttggatggtttaacttatgtgctgtgaacatggtgttacaaaacttgagcattctgtgaagctattgaatctttaaattataaccaagttcataattagcttcacctttctattcttccttaaccctccttgaagttaaaaacaggtcatcattaatggtgcatacatgttttatgtcaaacaacaaatggacacaaaggtgtagctgcatgttatttagtatcatatgaagtgtgcataactgaggagatggcataaattgagactttcaaagatatctgttcaaatttgcaagtgttcaaaactactgttccagtctgcaaaattgtaatctaagttgtgttcaactttgtgttaaaacatactcatttataaaatcaggctgcagtggaaatgagtggcaaatggtgccattaggagtttcttgaattgctcaactataaaccactgaaatagtctgtgtttctttatcttcagagtaggttggatctggtcctcattcagagaacaaatgaaatactttcctctggaacatacccaatagcaagtctcacttttggttcagtctacacactgcaaagaaaggtttgagcaattccttaaaggaatgtttgtcttaagtcacccagataggttatttatgttgcctgcactgataaccaaagactgtgcaattctctatatcttttacgtcttggagacctattcttgttgtttgcataagatgtaaaaaatataattctgtgtcctagtcacatcaaaaagctacttattttcagtgacagaattgttgaaaaaaggccacccttatagtcatatcattgtttggagcagcagagcttttattatctttttgggacaataattcagccttaggaaagcactaggttcttagcaggaatcatatggttcattacctgtaaggtccatacaatttttcaacatacattgattcaaattttctttcctgggtcaaagacacaactgtcctaatattttctattgcctctgttgcaatctgtaacacagaatagaccttcattagaagtggtgttttcacttctgaaataatgaaaaataagccctagggctctgtcaaaagtatcctgaaggttacgttgataggctttaatttcctttaaattaaaaaccaaaggcataatctgttcaagactagctttatgacaaaactggtacttctggctgtgctaagtatggtaggcaagtctttgtatgctcaggaaggctgatcagctaagggcaagaactgtggcctgggaaccaagggcctggttctattcccagcctgccaccaggcagttacatgactggccttagtcacaacccctttgtggcctggctttcttcacaaggcagagtcctaaaagaaaggattaggctgtgatttctaagggcctattggagctgccaattatttcctccctgagtataacttcttataaaagctgtccacccacaatgggaaggagatcccaattgtcaacaacatgagcatgctttaaatccgtgattaaatcagagtcagacatctgactaatctgggtcaatcagatttggtttcctggccctggacacaagtttgaaccgtgaggccctggggcttcagaggctgatgtcacattgggtatgtgtaagaagctggtctgaatatacagcatccgaggaatggaatagatgtataggaagactcagatattagagcctgtggctgtaagagccagttacacacaaactgcctgtatttcttgcactttggagtgtccttatatcaaatcgcttttacccaaaccagccagagcagttctctgattcttacagccaaaccacccttgacaaatgttgattgtctgtgacttagctatttagtctaaatcttagttctgtagttgagtcatctaaaccaacagcacatggagcataagatcttaattttaggtttttaacagctttaagacttttttttttacctcagttcttagcttctgcaatgagctgaaaggaagatatgtgatgcttgagactgaataaccatagatttttcatttgtaataaagatataacagatagcaattacaagaatagagaaaaattactgagcttttactatgtccaagtattacctcattcaccaatatgatctcatttagcctcacaaccttgaaagggaaatagtattcctatttacacagatgagagaaccgaggcacagagaagttaactgaattgccttaagttctaaagttaataagtagcaaagcaagaattccaactgagactatctgatgtggagtccatgttcctaagccataatgctattctgctacccctgctgtgtaatttacacaaggagaaaccagtaatgacttgacactcctcttgacattctagtcatggatcaactcccttacgggttagctgtggcacagagggcccttaatctcagtgaccagacaagccctgggtcaagatggttatgaggcagtcttccctccccactccctgcccagtaaccaacaccctcactaccaagccctttttggaaaattgggatgggaatacctcaaaccctgttgtactttaatgatgatgaaactgtacccaggtaaatgagagtgtttctttttaaatagtgatttggggtttttctagaaccttctttccgactcttaagcaagtgctgactgagtaaacaatattaaactatgattgaactgctgatattaacatttaaaacatttttaatctttcatatttaaaatctttcatatttcatatttaatctttcatatttcataaccctattaggttaaagtagctactaaaaaaatttaaactggccagtctgagttattcaatctctgatgcttagaataacagggttttagctggaaggaacttggggcagtatctggtacaatttctcattttactaaggtaggacatgaggactagagaagttggggatcttctccagcctcacacactgtgaatagcaagaccaaagctaataacccaagattttgttttgtttcaatactgctcaattctacctgctctactctgacaaaattctaacaattaatggagctaagactattaactagattcaagatgttttctatcatgtaacttgtctaagaaaagtttattttcattccatccaactgaccattctcccatatgaaatgtggaaagaagcaggattgaggggcaggggaggaaacagagctacacagtgtttcttcagcagttagttgagacactcagaagtcaaggaaatgatgccctaaagtacccacagccagcagccaagagaatcttcaagaactctagacacccaggggttcccaagtcctgggaaccacatattgtcctagcaagctccaagtcttggagaggatgcagcgtgaaaatgaggagagtgaattctgatggaaacctggagatactattatacctaacgctgcatgcagcggcagctgatgctgattacaagaggacaagaaaggatttcaccagacataattggtttagtggaaacatggttagtccgaatgttaatcttccctcttaatatggtgcctctgaagctagtcactcacccagtctctgacgccttcttccctatagagatactgtctgttccacttctcataactagttaaggtcagttgcagtaatgcttgtaaaagggctttgtaaagtgcaatgctataaaacctatatcacaatttatatttattatctgcttcacttcctcatgtttcaataaaggataataattacataaataagactaagaatgttcatggttataatctacatgtgaacatttcagtgcatgtacttgtaaataaaatgtttatgtgtagatttagacacttaaacacatataaagagaccatatagtagaggtaagagctttgaaactagacctgaacttaaatcccagccaaatctctaacttctgtttgaatctcaggttctgtatttctgaaattgggataacaatagtgcctgccttataggattattgtgaagatgtaataaattggtgcatataaatatgtagcacaataactggcacgtagtaaggctcaagtaaatgttaagcccaattgccattatagtgagaaccacaaaattgaggcattactgccatctggtggctgccatcttaattatagaaatcacagccaaaaagaagaggatctcttaaatgccagcacatgtccgaccctgaacaattcacttacagtcttctgcatgaaggtttgtgaaacagggatgacatttgtccaaacagtagcatttggacatgaagtaaaatgaaatgcactttgaatattcagaagttctttatcataactatgttaagtgctttctataggctcaacgttttatgttaatcaccttatatttaagttctagacattaatacagtaaaatatttcatacacaattgacaattattagttgtagtgggcacaaacatttaattattaaagcctgcatatcatgataaataattcaaataaaacacatgtctaaaaacaacacttaacaccaattgaaatcttatttgacctacctttccagcagcttccagttcttttttatctcttttggcatttccagccaacaatttcatttcaacaattcctgacacagcaataattggaacaactgctaatagcaatagggttaactgccaaccgtagataaatgatatgataataccagttccaaggttagctatattctgtgcaattaaagccaacctggttcctgtggcctgggagagaaaaagcacaaagcaactgtagttttaagctccaaatgcatgcgctccagccttagcctcttggtcagaatgatgagtgggttctatgcctgagctacattggcttactttcattacaataaacccacaacacctgtgcttaactcatgaggctctgcagacatttcttcattgtgcctttacactctcattcctctcctgcccacctgaaccaacattctagaaccaagtaatcaacttctctgctttgtggatgggcactgggggtgcatgtattttttcatagatgcaatgttcaaagaggaaactaactccaatgtacctgggtaattttaaagaccatttaattcaaaagtgtaaaagggaaagagaccatctgttgttacaaagggtacgtgtcctaagagacatccaccacaaagcacatataaggatgaattagtgttgtaccactcagaaaacaaaggtggctgtagcaacattgcagtcagctctctgcatccattcctccttctcctgttgtgtggaagcagtgagctgcaaagtaacccacctcagctaaaggggtgggggacgtaggccactcagaacaccaccatcccctggagacagtggttcagggtggggcatgtgacccaaattagcccaaattagatttcagcaaagggtttttgtttggtggttgaggtagaggtgtgtgctctctttcactggatgggaaataaggaagcctgtagttctaattactattagcagccatcctgtgactgcagggaatcagccttgggataaagccaaagccaatgagggaacctggattctggattaaatctggagggggcagtgggtcaatcaaccttgaagtttaatcttctgcttattgtttacagcagttttgatttgagctttctgctatttctagctggaagcatcttaacaagtgtgggtatgctacatgcttatctaaaaccatgttatgtaaaaaactacaagtagagtgcagtctacctactccttggacttgggcagcatctgtggcaagtcttgtagaaagtgcaccagtactgtttttatggtcatcaaaccagctcatgtcctatggcataaaatacacgtttatgttagttcaaaattaaaacaagcaaagaaaaccagacaaagcctcccaaagctccaatgctgaggaaatttaggggagacctcatatgcagtgtagagtccctggccttgctctgagcacacacccccagaatctagcagaacccagcttcctgactgctctgtggtagcagggagggcatctctggtctaggggggcagggctcacccagatggctgccatgctccttgccagctcctcccaaggctgggaggctggtaggcattccattcacccaatcatcaggtctttcactatggacacttctgccctgatatggtgttgtctctcataaagggtggtggagctgtcttggacatgttgttctgatagattctaggcaggagaaaataagcactggtttctcaccaagcttttgtttgattttttgttaaacactgattgaaagtgtgtctgatctccagttagccacagggataaaaaaagaagcatgtctgagacttaattttaattgtaagctactcatccatggcatcttttaccttcacataaaataatttttcctgcatagcaagagtttaggagatactgaaataggatttgtagacagatttaatcagaatatactacctactatgtgcccatttgtgaacagaaatgtaatcagttcctgtcaattgaatggataatattctggccctctcttaggcattttctataaaaatagataattcatgtttgcatattttcctatgtcaggcactagaatgtgaacttacgaggagagcaaataatggattatacagtaccagccaccagcacagtgtctggtacatgataagtaatgtttgaataaacaaacaagtgaattaatgtgaaaatagacctcaaataagaaataaacaaaactcaattattaacatttgaggatacctacagttagtatggtagattgtggtacatgagattaaatgctatcaactaggtttttcttggtttaaagacatcctggagtctcaatggactcaccagggcctgcacaggatccagaaaagagatacaggtcttcgaaatgatagtgtctacatggagagagatatttacagaataagccaaagctacccaaataaagcctatttctatgaaaaaaaacaaaaacaaaaaaaaaacaaaaaaaacatgagaagtctttagctcttgaaggaccaggacaatttgcaggactctgccccatccttgcgtgaataccctggggggaaaacatgcatatcgacataacaataagaacagtaagaagcttaatatggaagaaatgtgaaagatcagaaggcattctccagcgcacactcctacctgtcttagcattgctttaaaagccattgaccgcagtcttctggtgaggatctcgccagctttcccaaacgtgaaaccctggttgagaaaaaaggctatggtctcttttgatctttatgtatgtaattgcaccagaccaatcatgttcaacttttatgtagcaaagttatgagttgttttacagttgccacggatcctcaagtcatgttaataacctgagcagccccagatgaatcaagcatgcaaccatagcaggaacctaagtgctccgaaacaagaatcagggactgaattaagaagcagacaccacatggcaggatgcaggattcaatcagattgagctctgacaccaccccatggcaggatccagtcagatggtgcttcccggcatcacttcattgcaagatccaatcagatcacacttcattaccatacgcttataaaacctgacccagcctccagcttggggagatactgctttgggaactaagctctgtgagcttctcacttgtgacaagttataaaattcctttgctaaatcctccttgatgtggtcattgggttgaaacccaccaagtgaccaaacctgcccgttgtgtgggtaacagttgctagtattctgacacaggtgcctatattcacattgattttacattatttgtatgttaactatttaaataacaaaagtccaggaccaaatacgaattcaaagcccccacgtcaaattcatgtactgcaaaatcatcagtatgcattacaatcaaaggccaaaaatcttaaaggtgtccagttctggcttctaaaccattctaaataggtttatttttcaaaactttgaaggacaacatctcagtgacaaagatactgtgtttaactacaaaattcagtgtgttcctactacttccaataaaccagttaaatacagaagtaacaaagtcctacacacgaattcattttggctcatgcagtgtaaaggaaggatgaccttagaaacaagatccaaatgagtatgctggttcctggtcacagctccacctgcactcagattggggaacaatcagggtactcttccttccccagcctctttgggacaatttcctactttctaattaccacatccaaactggagaggagtccagatatccagaagtgggcttacttctgggacgtgtgagtctccagccacagtgtgagtgttggggtagccgtgccgagggcacacgggggagtgcacatcagaactgtttactaagccagggggatagatgatcagtgcacccagtgaatcggccccaggtgttccttgtccaggaccagactgccctccccctccatttgctggtggattgctacaggttctatgcatcagcccactgttcctgcggcccctgaaacacattttctagctgcactccctagcatgccagggactggggctggatcaaatcattgagttgtgtctagtagggcaatgatttctaaataaaaaacttggtttactttgccattggttcaacaataataaaagagaagcatgctggcatgactaggaaacactattttgctgacttgatggattgtattatattcgaaaggcctatgtggtgcccactgggttaaagagacaaaagaaattacagagaagtctaactgggtagaaaagtacaattagagagtttgactagtttattttggccaggtctacaacgttagaatgcaaaatattatgttctttcaaatagttcatcaattaagtaggaaaagatcagagaagttacttgatattctataaagagtaacaacagaaaagagaatgctattggactgtactttcccagttcccaacctgttgaatttaagttactcttatgttctgcagtaaactgaggtctcttgtccttggtaatgaatgtctgctgagggcaaacttgtaatgtaatataagttaggacacagggaagtcacacttccccctgataaggagtctaccctccagcagagccttatgccaatcatgtttgcaatttatttcactgtaagaatttggaagctccattaggtttaatttaatttctctaattaaattataaacttgatgagaaaggcaaatcatgggtacctacctgaaggaagaaagtaaaaaaagaaataattcccagaaataagaaaatcaaagagaatatgttgcacttctgctgcttcactgcatcatcgcctggtccaaaaatctacaaaagaatatttaaaacgcccacttggattacataactgatccttcttcattcctctcataaatagtggcttgagtgtcacatgtttaaaactaggcttcaaatatgtagggttttggtaattgtggtaaaatatacataacacaaaatttaccattttaaccatttttaagtgtataattcagtggcgttaagtacagtcacattgttgtgcaaccttcaccagtatccatctacagaacttttcgccttcccaaacttcccaaacttgataccattacactgactccccattccctcctcctcccagctcctggtaatctctattctactttctgactgcatggttgttaacataggttgacatactgcatatggactgtgagtggttgcacattttagcatttgttcctcttcctatatgtcccttgctccctgtgactcctccctgtcccagccctccacttctcattccatcaggcttccacccagaggggcctttcctgagcatcctatctgaaacagcacccccagctaacacctctctattaccctacccatcttttaaaactcttgttatccctcaacatgttacatgtttgtggggttatttttttgtttgtccattgcatgtcttccccgacagaaaccgctgtttgagggcacaacttggtttatttgtgtaccactgtatctccagtgcctggagcagcactaggcagacagatgccccaaaatatatagtccacattgccttgaattgcaagagagccagagcttgctttgttttgaaactttaaaagatttggaggaggatcttttctaatttatttattttttggcttgtggtcttaattgtggatcgatgtccaacatcacaaaaataataaactcgtaacatgatggagaattatttatcctcaacaacaaagtctctccaataacattagagcttgactgaaattgtagaatatgaattctggatttcatggaattgatggaggctttatatttgtgataacttcctttaaatatcccccaattaattgaatgattggctagtatgttttctttcttagtcttggactccccaagccttggaaggattgctaaaatggggtggctatcgctttttgaatacttactacaaggcacacactcttaaatgctttccagatagttacctatataatctcttaatcctcagccatgttatgaggtagatttattgtatagatgaagaaactgaggtaccgagagctattgagtggtgaggccagtctatacccagtgcctggactcttattaaactctatgactttaacccctccctgctccactctctctccacctcactgtgcgacttgtaccagcttttctacacaaacagattggggatcattgtctgacaccagtttcaccaaatgaagagagctcattagaatgccttcttcattgattttacattttataatttcattaatatcataacttagagtgattcaaaggctacttatcttttccctcacagcttttctcaaaagggatttaaggactttggcttagtttaatttaaggctgcttaatcccagaatggagccagtcagtgaggttgggagaagcagcagctgatgaattgatctaattcaggctgttatgtggtgtttgcaaacttaccgctatgatctctgagaatatgactgaaaatgccggctgaagccccccattggcaatggcacatactgttcccacgacaaagtagggccattctgttttattcagtttcaggaccttcagaaaggacactggtggcacatttgcttcctagaacatataaacatcagggcaaactggtgatgacacaacagttaccagagtctgtagacatagaaaaggcatggccattgccctcaagggactcgcaaactaggtgcagagaatgacaagcaaactactagagagtaggacagtatattataacatgttaacaatgtttactgattacacatcataagctgagtatgggttgttcggccaagaaataaccttcatgggatgcttagcccgtccctattctggcctcagcagactgcgaggtagcaggatctgggcacaaataccttggcatccagctctggagttacacaacactgtattggtgtgacagtcatggctggaccacataagccgagctgcagttttctcatatattatgatacagtcctgcctctctaacagggatgatatctgggtcaaatgagacaatacacctgagtagatggataaacatctttgcaaatgtaggaaaccattactaactggagaacatgggcttggcctcctcaccccaaaaccttgccttttctgtaccatatttccaactcacaaaaccaaattaattacattccttttctcttaccacacttttccctgtgcagacttctcttatttcatagcttagcttgtctgtgatttttttgtttacatatttccatttctagtatgtaactttttttaaggtaaagattatgtctttatattcctagaaagtagtccaattcctggcacatataagattctcagcaaatgtttaattaaatgtctggccaagcatgcaggatttaggtctcataaagaatgttttgatgatagaagcagtttaacattaaacttgagacagaggtgactatggaatcccaaaaacttgaggtcactgagaaaggttatatttatatctctataaaacagagaatatagaagtaggttctactgagccttctttcaaattacccattttttctgtatttcagggtttttttttttcctccctagttaacattatctttaagtccctatctccagcataatgaatgaatctttttctttggttactgctcttcagcacacaaacaggtccctctaatcagacttaatctctccctctcctttggcatgttgttttctccctatgatggtacttgggacaatcttgttgattgcagcatttcctgcctccccctcttctctgtgcatttcttcaagagacgtgctcctataaaatactggagtttaaagagatagcaaaataactctcaaaataaatgaggaaatgaaaagtggataatttcatagccaaaagaggggaaattgcttatctgacttataataatgacgctccaaaatggtacaattgttattcttctttctataaatataccaagattaagacctctaagagagtccttgtaatttctgcagtaatagcatgcacagataaaaacagatgcaataaattattggtagaattagttttctcaggccaacacaagagtaaaaataaactcagtcttcattaacaaataacatcaaaatatatcaaaactatatcttgaaataaggaaatctttttttggaatggattccctctgtataataaaattatttgttccagcctgggcaacatggtaaaacctcgtctctacaaaaagcacagaaaaattagccaggtgtggtggcacacacctgtagtcccggctactaaggaggctgaagtgggacaatcagttgagcccgggaagtggaggttgcagtgagccaagattgcaccactgcacttcagcctgggcaacacagcaagaccctgtctcaaaaaataaaattaaaaataaataaataaataaaattatttgttaactggagttaataatctcctaaatccaacgttgctatttctcaccattctcctctttttctaagtaagagaattccaatctaatttagaatgtcaatgcatacagcaaaaaaaaaaaattgaattttccatactcattgctaagtatggccatgtgatcgaattatgaccaatgacttataagtaatagtattgtgtgggaattctggaaaacctctttgtttcttcctgttgcttggaccacagatgtgataggtagggcttcaggagccaccttagatcataagtgaccctgaggatggaaacctgatgccagggtagtgcagataaagatgaagggagcttgtgtctatggggactgtggagctactgttctagccctgggtttttcacctctaagattttggcatgtgaaacagaaataaaaactcttaatttgcttaaacggatgctattctgggtttcctaatatagataatcaaatgtaatcctacccaatagagtatgcaaatatcagggcctctcgttttggaccagtcttattacctctggacctcaaagatgaatgtcaaatttaattttaatattaagcatctcagcgtaaagactacatttctggattttttttcccttgaaaacccatttataattggaactgatttcaattcattgtcaaatacatttaaaatttgaaaatttttttctttacaaagagtatggctcatagtagcagtcatctgtgcctgaaaaatatttgcaaggctaagaatttcaataattgtagcaaaactacaaagtaaaagacttaatttaagtgaaaaacaacttacaagtccatcggtttccacatcaaggctcttctgacacatttgtgaatttttaaggtttttctgagtagaatgcctaaataggcgagatttccagccatttggggccattctagtggcagccttttcatcatttagttcaaattcttctgactggatctggcttcctgatgtctgaaagaatatcaagacattaaagtgtgtgtgtgtgtgtgtgtgtgtgtgtgtgtgtgtctccaaatggatgtaacctccaagtttagaatcataaagcaatttggaatattacatgtatcaagattttcagatttcctaactgcttctcaatcaaggatagctagaaaactataaagtatagaaaggttaaattcaatttgaacaataagaaaatcggagtataagaatattttctaaaaatttaaagacacatttttcgtaatccagaaggtatataggaatttacttaatatgcaataatccagggaacaagtcatggccaccaagaaagggaagaagactacatggaaacactaacaagggcttgtttttaaagctacaaacaagaaaagctgaatcaaagggcctggtcactacccacgggaggtaaaactgtcttcctcgactggctgagtatggtcatcttccttcctcacagtcctgctctcatgcacacaacgagacccaacatgcaggctcagcctcattgctggctgtgagatcagttctctttttaatgggaatgggggtgggggtgctgatctaaggacttctagttcactgcctagtaagggtgagggaacatcaagccctgctggagttggactttggactggttccctatttgcttcctccactattaagatgtgtccaactacacatcttaatagtttgttcagggtcttagtccttgtagtagtgtcttgttcttgctcctcccttcaagacctgccctgaacccaatcctttggctagtgccttactgtacatacaatagccaatcatgatctcttagttttccagttgctcattcaacatctgacagaacactgcccatgtgcttatatattgccttgaaccacattgcagtgatatgttctgcttggtggatttccttatttgctcattactgaatcagttttataccatctctcaacaaaaaccaacctaggctgcagactttgtaattgatcccttgcattctcactgccatctgttcccacactgctaccagatttattttcctaaagggcagctcaaaatcatccccagcttcccactacctgcccaagcctggatccccaaaaatctagctcatggcaagtcaaaccagaccacctctcatgaatacctccccagaacttttcctcttttggtaatctcatccatgctatcaagaggtccatctcaatggacagttcttccaataagcccattcagattttagcttccttctatgaccaaatgaacattacctgtctctttcataatattttttctgtgccttacctaaaacactcagttggtgttgggtgcttcagctgaaaggtcattgagctccaagccaagatagccacttttccaccaggtgttaaaaagtatctatttaaaaccaatagccctcatttcttccacccaggtatacttcagttgtctcaaagatttaattgtaaaaaagcagaacaaaaaatgctgaaaggaaatggggtaaatatcctttcggagaacaacctcaaatcctgaagacatggaggaaaaaactgacaacctaattacatacattttaaagcttctttatggcagccaaatacaacaaagtgaaattgaaaggaacaaagcaggaaaaaaaaatctctccaatacacgcaagagaagagtgtattttctttttatgtaaagagttctcacaaatcaatgagaatatcatgaacaacacaacagaaaaatatcctaatacaggaacaaatactttcacagaggaagaaaaatataaatggccaataaaaatgtagaaataagctcaatcttataaatagttaaatttgaagatactgtttaactctttaggctggcaaagatgaaaaataaatacgaaatagctatcagtggctgtttgtagggatttggcttatgatgactttcaagtttctagaatgtaatgtttggattttttaaaaaaatgcttgatttttaaaaagaatgcattacctttataatcagaaaaaaattaagatacatttaaaagaaacaactaagagccaacagtctacctaatggaaaagcagtgatacttgttagaaacaataccaaaacaagggtgaatgaaaaccaggttggtctttgaaacttgagaaaagagtactgcattagcttgagcatctgctgactctcaggctcacagtgggtctttccctcatctctccagcctcaccaagtaagtgggagggcaaaactcaaatcagaaatgggaaatgtgggggtacccaggtggaactattcaaaggggctgagaatcacagaatgccagagctggtagaaatatcagaggtcatcttacctgaagcccctgctcatttagcaagtgaggataacaaaacccaatttggttaaatgacttgctcaaagctattgcctagttggtgacagatttctatcatgccagaccactgactgttcagtcttcaaatgtacaacttttcctaagaaagtaagcttgggaatttgatatagaaaggtcagagctgtctgcatctctttagcagtctcccaatccaagtcctgatggaagcagaggtcattcttacaagagcttatggcaataggacagccaagtggttatttcacttgaggattcaacatgtcattatgggcaaaatcacagacccttggtaaccactcatgaaattaaaactaaaatggatttaaagtaacattttatgcattcctaactagtgaaatgacaaagaccctttatggtggctaggccatatggtagcattcggcagagacactatcattgattccctccactgtagaacaccctctggcacatgcaagcctgagttataaaacttttcgtcatttcatttggtattttcatttgggggaatttgcaaattttagtaaccaccatttatcatcatctaatttgtgtcaggtctttttttttttaaaaaaaaaaaaagaaaaacagctttttaaaaatataattaacatatcacaaaatccacccttttaaacatttcagtaggttgtttttagtacacaagtattcagatgtttatttttctaaacttatagcaacctctcatggtaggtttggtattccaaatgtagaaacgaaggctcagaagagttacttgtcagaaagcaaggcaaaattttgacaaccttttttgatctacttgtgctcacagtggcaatatttagaatagagaaatactggaaacagaccaaatatctaactttagaaaaatgactaatttcacacattaataaaatgaacttctgagcacccattaaaataatagtatgtggatgacgtatatctgaaatgttaagaaaaaagaacaaaaatatgtgtgtacatgctaattacagttgtatcaaagcaaatgtatatactttcacaaatagaatcgttcatagaataaaatattcttaggttatttattctgcaatgttgctcaagtgactgagtataataacatgtcttaataatatgaaaaaccaatcattatcaatataacctgttttaggaactagaatgaatgagtgctcttttctttcttttttctctgagacagagtctcgctctgtcactcaggctggagtgcagtggtgtagtctcaggtcattgcaatctccacctcccggattcaagcgattctcctgcctcagcctccaaagtagctgggactacaggcgtgcaccaccatgcccagctaattttttgtatttttagtagagatgggggtttcacaatgttggccaggctcgtctcgaactcctgacctcaggtgatctgcccacctcagcctcccaaagtgctgggattacaggcatgagccactgcacctggcctgctttttccttttaaaagacaaactattcacttcctagagccacaaatcttgatgatggtcttattaggatcatctgggaaacaattttagatcacatgagacctccctcaaccactagagatcctggctggtcaaaaggaaccctacagcagtgctctggaaaaggcggtcacttgtcaatgacttccctaaaatgtttctggtaaagtctctggcattccatataactcagagccggggctcctcggacaagtcgaaacacttttctcgtcctctgactcccaaaactctgaccatcccattatggtagaaaggaccttttagtttgaccacattccccaggcaattaggaatctgtcctaaggaatatatccatgatgtttttggcactttcccctattttctcacctgctacctctttacagattctgatttaaagtctcagatatacacttttaggcatcttgttgaagtttcttcttgctcagtatagcattcactggatcatattttaatatttaaagaacactatattgaggagcaaatagcagaaaaaattcctgaaaagcaagtacctgcatgttgacaagtttgaagtacaccccttccttcttcatcagttcgctgtggcttccttgctccacaattactccatcctcaaacccagcgatgacatctgcatttcggaccgtagacagtcggtgtgctatcacaatggtggtccggccttctctggcctaaaagaacaaaaatgtggtgcatcagggttacagtattggcacactgtcaattaacatgcacagttaagcacttggatgaatgctgtttgtagatgattagagagtagtttatactccagatctctgcgtgattatggcaaaggcatcactctttatgaaaaattaaagtcagacgagtttgggaccagacaagtggctaaccccttcagtaggaggatgggtgatttctccagaaacctatggtagtgtcagtgtttacttaagaaaaataagggtttgatccttcttcagtgttttcacacttgtctgagaagccctagctctaagttatatggaatgctagagacatcaccagaaatattttagggaagttgttgccaagtgacagccttttccagagcactgctgtaggatctctttttaagagcctgatcttaactaattctgatgaactgaaagcaggcagtttaggtgaaaatgtaccttgggatcaggactattaaaattatggttcaaaagccatccaaagcataatctctagagtaaggcaagtaaatctgctctttaacaagtgccctaggtgatttttatgcatgctaaaatctacaaatcacctgtctaactagtttagtggcctcatatgtttgctgggtggatttataaatgggcatttaaaccctggataatgccaataaaagtattgatattatgtcattaataatggctactctttctgacactcattagcccttttacccaatagcttaagatcactcctactctgagacaatcaaaccacatcattaggatggttattagagaatagtctaattcacctaagtggttaacatataaattaaaaatgagaggctagattcataataggcaaaaagtggaaacaatccaaatattcatcaattggcaaacagatttaaaatgtggtatatccatataatggaatattgttaggccataaaatagaatgcattttgattcacatcacaacatagatgaactttgaaaacattgtgctaagtgaaagaagccagtcacaaaagatgacacatggtatgattttatttatatgagatatctaagagtaggcaaattcatagagacagaaggtagattcatggttgccaagggctagagtgagggtggaatgcagagtgactggtttcttaatgaggtggtgaaaatgttctggaattcgatagcagtgatggttgtacaaccttgtgaatattctaaaaaccccggaattgtatatttttaaagggtgaattttatggcatgtgtttgtatctcaattttttaaaaatagccatgaaaattctgaaaaagaagttaatgagaggagtaatgagaaggaaatatctctaacagatattagcatataaaaagctacagcaattaaaatagtaaaacctaggaaaaaccagcacgtgaatgggtaatttgatcaatagaaccaaatggagagtccagaaatagacataaaccatctaagaatttaattacaataaatatggtactacctattggtaaagaaaaggtgaattatacaataaatggtattgggacaattgtgcagccatttaataaagtaatgtggtatttctactttagtccttacattaaaataaatccagatgaatcaattgtttttaagtaaatataaaagagaaacatcactggaaagagagagaggctagaacacagctctcttggacaacatttaagactattatttgatttttagtatataagccccaaagaagcactcacaaatatttacttatatggaagctgggtttagtccatatataataaggcatatacaaaataatttgattactgtaattatattcatgatgctaacagtgatgaataaattgctaacaatgactatattatcatgatgatgataataggttgatgatatgtcaacatatatacacaaaggaattggaatcagatgtatgagtgaatgattgctatgtaaaagaaataaagtacgtgttcatcaatttagaagtaagcaactgtcacctttgaccaagagaagttggccaaagtagagctttgacacaaaaaattgttgttgtttttttttttttttttttcagagctcccagacaccctgatgatgacaggacattgataaataaatatcctagatttagggacaccagctattatgaaatttagacctttgactaatttgggatgttcagggatgaaaggtgggcctaaacaaagggaggactaatctactagcctttctggaactttggtaaaacagcatcagaatgaaaccttttggaatctttttataaaaatcaccataaaatcaccgttttcattcttttttttttttgagatggagtcttgctctgttgccaggctggaatgcagtggcatgatcttggcttatgcaacctccacctcctgggatcaagcgattaccctgcctcagcttccccagtagctgggactacaagtgcccaccaccacacctggctaatttttttttttttttttttttggattttaatagagacagggtttcaccatgttggccaggatggtctcaatctcctgacctcgtgatccgccagcctcagcatcccaaagttgtgggattacaggcgtgagccaccacacctggccaccattttgtttcttttcctgttcttctatgataacaccatgatcaggagtgtgcatgtaggtatgaaactgtattgcctttctttaaaagagtcaaaatacaaaatctgctgttatatctttcttcaagatcttatatttaatagcattttatttattttgacaaatagttgctatctgtagagtcaaaagctaatatggtcatcactattaaaatttattttagggccgggcgcggtggctcacacctgtaatcccagaactttgggaggccgaggcaggcgaatcacgagatcaagacattgagaccatcctggccaacatggggaaaccccatctctactaaaaatacagaaattagctgggcgtggttgcatgtgactgtagtcccagatactcaggaggctgaggcaggagaattgcctgaacccgggaagcggaggttgcagtgagccaagatcacaccactgcactccagcctggagacagagcgagactccgtctcaaaaaaaaaattattttaatgtagacatattttctcaatgagctgggccatcatagtcaatttagtaaatatttatttagcctctactatgtgcaaggcactgggctgttgaagagattcaaatatgaatctttttattaattctgcctcctggggtggtttattcttcctaggaaagagaaggcataaaaataagtaggtaactacagtaagctgttgccacacaaggaaggcctgatcaatgtataaaggatccacaaaataaaaatattattcttccaggatgggtaattgagtagaaataacagtagatataatagtgatacatccttatggtcctcagaggcaagactacaatttatgaaattcaacttttcatcattaaaaagagagttggattgtaagttagagtgactggctaactgattgattggtatcttctttggggacatagtaataaagggtttatctttaaaggtatggtttattgtctgtaaaaatattagcataattaccttgcagtgtggagccaattagtgcagattataaactgttttcatagcaactatggcagattaatatggccacaaacactttgcagcttctcctatacagaagtggagccaatttctctgcctcctcatatctgggcaggccctgtaacttgttttgacaaagaaaatgtaaagaaattgatttctacaatttctggagcccaggcctcaagggatctcacacagctcgtctgtttgccatcttcggatgttaccctggaaccgcagtgaaaggaagtttctctagcctcctgaaggataactggcttcagggaggaaaagcaacctgccttaggcaacagccatccccaactgccaggcacatgagtgaggccactttgaatattccagcccaggtgaccctgagctgaaataagactaggcaaaaccaacagaaaaaccactttaccaacccacaaatttgtgggcaataaaagttgtattttaagtcactaaattcttggcttaaaacaactgatacagaaattagtaattagattggtatgctgctgtaaccaaaaacctaaaacatgtgacattggctttgggattgagtggtaggtggtggttgaaaggaaggtgataatattgttagtggagactgaaacaagagtaaagaaattgctattagaggatagaaaaggagtaccttcattatgtaaccttggaaaatttgacaaaaatatttcctgcagtgacttggaagaaagacattttacttaatgaacctgtacatctggctgaggagatttcagacatctctagacagactataggagagacaagtggattcccctagctgtgtacaatgaggtttgggaagagaatgatcagctaaagaatgagctacttggttacaaggagaatttaagacaataaagcagaccccagtactcagttggaaaatgaagttgttagtcatccaataaaattagggcaaaaatcagagtgtgtaggtgtaagatttttagcaaaaatctctgaaagattttaggcagagcctagtggacactttcagctacaaaaaaaaaaaaagccttaaaaactatttaagagttttctgatggcaggttcacttgcagcccaaagaagagaggagcctgtctcaaaataaaatatataggcataacttctggggcttgagtaaatgacagctagattctaagtaaactcacaaagtctttaagacagtccttcagcttagtctaaaagagactgaaaaaaatacaaaatgaaaagggccccaaatttctatgggcagaaacatgcaaagaaatccactcagctgcagatacagatcatttcttatgaaaaaggaaagccctcttagagggaaggtaaaagaccctggaactaaagagaacaatggactagggaacccactcctggggagcagaatcaggccttaatcaagaaacatcccatttccctggagtagtggggtaattggctgcatgtcagaattgctatggccaaggactgctatgagctttctgttctcatcctttttgaatgagtatctgctatgattatcctgtccctgcaccgccactctatgttgagagtatgtgttgatgataacttgtctttttcataggtctgtgggtcaagatgagctgaaaatgaagaccctcatctgtattagaccacatgcagatcttcagatactggtctttgagccagatgctatcactgtatgaacattttgagggtctgaggaagaggtgaccttcttttgcatgtggaagaaatgtaaataattgtgacagagggcatgctttagaagattcaatatggtcacagattttttactgctcacccattaagaggcacagtctgttatctcctcaaatctgggctagcctatgacttgctgtgaccaacaagatgagttctggagtctaatcctctggacacttcacacattagtctttgctctctgggtacactgccctgaaactttcatataaggaagccaggttagcctattgtatgagtgtgagaagtcacatggagaattgagatggccagccaacagccagcgtgtgagtgaggccaccatggaccattttaatgaagccagccctccaggtaaatgcagccatgtgctcaggtggaaagaacagaggatctactcagccaatacactgaattgttttaagcgtggactcaagatagtttcttacatagcaataggtaaccaatttagcaaccaaaaaataataataataataatcctggtaatgctaatcaccataataatagcagcagccaacaatatcaagtgtttcatatgtgctaggcatgtgctaataactttacatgcagtatcttggttattctttaaataatcctatgatactatttctgtcccctcttcccctattacttcagagatgtctcaggcttagagaggttagttaacgtgcccaaggacacagctagaaaagaacagagccaggactccaatcccagcctagcatcaaagcctgtgctcttaaccatcaccctaagctgctaatggcttttcctggagactttaaaaaattatgagtagttcatcagctatttttaaagtaaatataaaaaaggttatcaactgaggagtgtgctatgatcctatagaacacgaagaaacagctaaaattgaatgaattgacttgtccaaatacgtactaaaacttgcaagatcacagtttttctggcagaggtcatattatgaaaaacaatacatactggtcatctccaataattctattcttttagcacagcaagaactatattgtatattgaatatctgtatcctggaaatgattggaacctagactccagggctgaataggactcttttttgtttttgattttttggtaaatatatctctcattctacccgactttactctaaaaagtctatgccaatacatgaatgtctaattatatttttaagttagaataacttatgcatgtattactttatgatgtactgctttaagtaacttcagaataaccaaccatataccagtctcatatgcattatattttgactccttaatatcatgatttaatatacacaaaagcagtataattcagtgcaagaatttgtaaggaataattattattgtgttattaatcattattaaattatataaaataagtcaagatattggttaggtgcagtggctcacatctataaatcctagcactttgggaggttgaggcaggatgatcacttgaactcaggagtttgagaccagcctgggcaacatggcaaaaacccatctctaccaaaaatacaaaaattagctaggtgtggtggcgcacacctgcagtcccagctactcaggaggctgaggtggaaggatggcttgagcccaggaggtggaggctgcagggagccataatcacacgactgcactccacgctgggtgacagagcaagaccctgtcttaaaaaacaacaaaaagagtcaagatattaagctgataaaccatgaggcattaattaactacagtttacagcataaaagggaattaggttaacttaggattcagatataaattttcctgagaaaataaggttcgtgcagcttgtctcttaaattgtaagaggtggttcagatagaattccttaaggaacttgcacatattattactgaactgtcttaaatcaaatatatttatgatatttatgtgtttgaaactaatttctatggtgtcatctgactctggtatttacattgtgttgttaatacagatgacatcagcattacccccaaaagtgtaccaagataaggtctttcctgtgacacttcagcttagtaaaaatgctaatgagagacttagaaatatctgagctggacagatgaactcagcacccttaaaatgaattgtttatttatatgcttagacaagtacagagttgaactttatttccagaaaagcacctggtcacctacatgaatagataaagatgatgtcactgcctacaaaatagggtgagtattctgaattagttttcagctggaccagtgtctgggtaaccggatttaaaaatatatatattttaacatgactacttttggtcaaaagtagtcttgcaatagcccatgtgcaagaaataaacaaagctaaatggcttgttataaagacctggatctgggctcactgcaccatggtcaaaacaagtcagtacccttcacctgtctctgaagacaatgtaacctgacagaaaggagaaatcaatacagctccatgaggtagctccatttgctatgtttctgtttctcagcccagactccggaagcactggcaagaatcttcaataggtttcaatgtggtggtccttcagctttttagagtctactgaccttatccagagctgcctgtacctcagcttcactttctgtgtccaatgctgacgtggcctcatccagcagaaggatcttggggttgcgaaccagggcacgtgcaatggcgatcctctgcttctgcccaccactcagctgggcccctctctctccaaccagggtgtcaaatttctaacacagaaaacatggatcagctcttgaagtaacttaaatttaaaaaggctaggaattctatagaactacataaagacaacatggagctttgtcttaactattttaatgtatcataaagtatgataagataaatgaattctgaattataaaaaactgacacatgctgtataaaattttatattaatcatctaccatgctataatcctttaacccctaactgagtcattcaggggacttatctagcaaagttggacaatcttgcatctcaaacattattagctaaacctttgaagaataaactcagtcctatgaggtgaaattctaatttcaaggacaactactttatcagaggctttacctgtggtaatttcatgataaactcataggcgttggcctctttgacagctttctttatctcatccatggttacatttccacggccataacaaatattttcagcaattgtggtggaaaacagcaccggctcctgactcaccacaccaatgatttccctcagatagtttacattaaagttcctaatatcctgcccatcaatgttaatctgaaagaaagaaatatttcctattaagtatttaaccatttaatagctgaagtatcaggaccattcatgaaaaacatcctacctaatatttaacttggttcagtgtttagaaataataattagaaataaacagcaatatgcaagaacaaaaataaaaagcttatgctctctcctgatatttattttcatatatacagttttttcgtggaaggattatttgccataaacaattttgggttttatgtttttggcataccattatttttatgttccaatattaaatttaaataaaaatgcacacttaccttcctggtctacatataattttgatagcttatggtgttctgctttttttttgaaatggagtctcgctctgtcgcccaggctggagtgcagtggcccatctccactcactgcaagctccacctcccgggttcacactgttctcctgcctcagcctcgagagtagctgggactacaggcacccaccaccatgcccggctaattttctgtatttttagtagagacggtgtttcaccatgttagccaggatgatcttgatctcctgacctcgtgaccgcccgccttggcctcccaaagtgctgggattacaggattacaggcatgagccactgcgcctggcccatgttttgctattttttacatgctttaatttacttcctttcttcttaaatatttgacttacttcaatatttattgcaagagtagagaattactaagttgaagattatgatttattttttctcccttgacaacaattgcttacatgtacaatgactggatttgctgggcatttgttgcttgttaataaaaggctaaataattatcttaaaacattttaataacttacattgtcaacaggaatatataaatatatctgtttcattgtaatttactagcactgggttttatcattttaatctgttttcttccaattaataggtatgaggtgatagcttatatctgttttcatttgtatacatttataaagttgaccatttcttgaaactttttacaaatctttatatattccagagagtcgcatgttcataatgagcagggttaccttcatatattcatattaacttctctaataataaatataatactttttccatatataataaatcttttgttccaattcattatttttgtccttttttttttttaaatttagagacagagtttcattctgtcactcaggctttggaggagcatagtggtgcaaccattggtgcaacaatagctcactgcagccttgaactcctgggctcaagtgatcctcctgcctcagcctcccaagtagctaggactatgggtgcacaccaccaggcctggctattttaaaaaatattttgtagagacagattctcattagttgcccaggatgatctcaaactcctggcctcaagtgaacctcccacctcaatctcccaaagtgctgagatcacaagcattagccaccatgtcaggcctttattgctttctttcatcatagttttattggtttttattggaaagaggcttaaggaacaactgaattaatcaattatgccactgggcatttttttctattatttcagtggtaagaaaattgttaaatcatgatgttaacagtgaatatctctgagttatagaatttctgaagatcttttttttctgttaacatatgctttctttaaaaatgtcagttgtttcaataataatttaattctcaatggttggtattttaccaggttctttttaaaaaataaagaaaatatttacacttgaaccaacccagagtttactttagtaaatgagaatgggcctatgttcccccatagtaatatcagatttttccaataatattaattttattaaattaaataaatagttccatgtattgtagaaaattatgtattaattctggagatctctgttctgtcccaatgcctttttatgatttttggttttggcatgccattatttttactttttaccttataatcttctgttttcacaattattgaattataatccattttaatatcagataaactcaatgctctaaaattgggacaactgaggaaattctgaatatagctcgtggacttgtatattgcattaatgttaaatttactgatttttaatcattgttttgtggtaatctaagagaatgtcctttttaggaatgtattctgaagtataagggtatacataatacacacacacacacataaacacacacatacacacacacacggagaaagagaagatgataaagcaagtgggtcaaaatataaacaatctaaatctgggtgaaggatctgtgagttctctagttacaattttctgtaaattcaaatttatagcaaaacttttaaatggcaaaaaaacataccctaggctattactgtctctgtgtttctagaattttctcaagagactagtttcttaagagaccatcccactttcccccttagatattcctaagtttaagaaaactcaactgtcttggatgaatttaattgctgtcctaaaatatctggtgaccctaattgtcatcaattgttcccaacaattgctatatggagtatgtttgaccaaactctaactcattgaaagtaatcctctcagtggtttgtagactgctttgcagtaatttaatgtgttatgaaagcttagtcagaacagaggagagctttgtccagcttccacagcttttatgacttttatttaatgcatttgtgaaaccagcccaagggtgtgaaggcattatccatcggcattgccattttgtaggctttttaccaaaactggattcacacgcaaatttgttactgaaaaaccaatttcaaagggccaatttgtatccagcttcccactctggaaagcttggttcttcccacttactgtgccctcatcagggtcatagagcctctgtatcagctggaccgttgtgctcttcccacagccactacttccaaccagggccaccgtctgcccactctgcaccttcaggttgaggcccttcaagatctgtaaggaaaatgagaaaaaagaacacacttcacaacaaagccctaaaatgggaataattcgattcagtttgaaatttgaaaaaaaagtatcaaataagggaatataacccccaaaggaaaaggcacataagtatcaaaataatagagactttattctttaaaatgattcaacaatcaacctcagttaggaattcctataaatattacttacagtaccttgacgttagctcgagaagggtaagaaaagtgaacatcattgaactccaaattccctttgatgctgtctggtttgtgtcctctctctgaaaaactgtcaattttaggattctaaataaaacaaaatgtaatgactattccatcatagcacaaacaagttgcatttttaaggaatatgattcagcaaattccaaaaataggacctggaatgtcacaatcccctttacataagaaaaacccaagatgaagattgtgtgtatatgtatgtgtgctgtttaaagaaatactccttttcagaaaatagtgttttcctgaaaagtacgtaagagatattcatctcatttcatataatatttccctttaagtttttggcatatcctcataaattttctaaatggtcagatatgcatatttatacaagtgcaataacaaaaatatgctataattgatatatattatagccaagtatttcagcatttagtgaaaattagctcattcctaaataataaatgtaatagattgaattgagaagattgaatggttgattatagcagttatttagaaataatgtaaacttttaatacaatcagaaactgagcacttttctcacgacttggatcaatgaaaaaggaaattgcttagattaaatgatcaaatttcacttagctaccttgcaatatttgaatgcagtgacttacttttttacgtcaaaactttttctttttcactgtagtcagtttatttaatgtagtttatttaaaatcataccaaacatgcagtgataattttttggagagggggaacccacagcaaaatatactgtcaattttggtcccaccgataatttatctaccccccatcccatatagaaatcataagattctcagtctggctacaacatgaaagtgaaaaagataaaaactaggaagagaaacgtctttgctctgcactagtgcagatgtccttttccaaaatgagatcagtattattatattatctaaagatacatttaaaaaatattaataagaggtattttctttcatttattactaacaggtcattcatttcatataattaaatgtcactttagtcagtacaacttattcaatgtagttgattcaaaaatatgcaaactaaagccagatttaattatacaagctcaaagacttcttttggcactaaaataataaatgacttacattatcaataatatcaaagatcacatatgctgctcctcttgcattggcaaaagcatcaatacatggggcagcctggccaacactgaaagctccaattaggattgaaaaaaaaacctgagcaaaataacatgaggaaaagtttaagtcacattctggcattcattattatctaaaatgtgatgtatatgtaacatagtacataaaggattaagtttaggtttatcctttccttttttttttgtggaagagcaacatttgcaaggctaatatagcattttattgcctgagtgggtctattttctcaaactacctattgttctcctgaatacatacagagttaaaaagatttttcaaacctatttcattgactcactcacaaatgccaccagaaagaaacattttcagtcagtattattattccatcctatatgattttctctaactatgcatggaattacatagacggttcaatataaaacatggcagattttggccctatgtaatgctcctaaaaagcaccatgtcacatatatttttaaagatttttaacataaaaagtaacagtttgcacatcataaaacataaaatcactccagtgtgcactggttagcaattcctttacacagttattctgtactgtagcatacaacacttaacacatttcccttcacagtattttttcactaggaaaatgaattgatataaagaagctcagaatacagcttcaggaatccagattattagcataacttaactgagaaaaacataagtgaagataaattatttttttctctcagggcatggtaaaacttctacatataatttggcttttctcaaaacacagcaacacttcatgttacccataactcaaatatcagttaaatatctatcccccatctgcaatacagataaggaccagtaagaaagaaaaataatgttgaccaaaatagttgccataaggttaatgcaatagagtccctgccctctatgcagagggctttgcttgggctccctctggggatagcaatctcagccctaccggataggtgtcattatccacatactacaaatgaggaaattaaggccatagaggacaaactcatcaccaaaggtgaacggttgtcaggattcaacctcccttcttcataaaacatcaatagtaaatgaggaagtgaagaaagggtagcaagcttccaaaccgactgccagagagaagatggaagtgagaaaaattagactcagcattaatgagggctcaccaagtcgaacacccacaacctctcaatgaagtctgaagataccactgcataaagcattctgaaaatattcactttcataatgaccccaagtcatcatcaaagggccaaattatgctcagtatcctcattttagcaagatagggaagtacagatgttaaaagatttctatttaaatagttacatattgttctgagtctctgacatgaaaagatggtcacaaaatattggtagttcataaatgtggttacaaaaagatatacatagtatgatcccagttttgaaagaaaacaatgtgtatatatatagaaaatgacctggaagatatatgccaaaaattatcatcaagagaatataaattattagattgtaagtaattttaattttaaaaattctgtatcctaatcctttgtaaaattagtatatattattttaacaatcataaaatgaagctatcttcattttgataaataaaaacaaactaacataacatctcttcttgtatttcagagagctgattgttttaagtgatataaatgtaacattttcttgtgcaatgacctattctgtaataatgatgcttactttcttatacaataaaactcaacggcagagggaggatggctcccatccatatttgtttattcctaaattcatcccatttttatttccttttatacattgtatatgtttcacaaatggtctaaccacatgctattttcttatccacactcataattatgacttgtatatactagaaagtcagctctgcccactggacagtggaaagattcaccaaaaacaaaaacctataatcatgttcatctttcaaaaaggagcgatatcaaagaaaagagaaggtagatggagaaataagattttcatattcttcataaatgttaggagaactacttactgtcattgcatttccaatagtatattcttttgatatgactagagtggatccataccagaaggccagtgcatatgatgcatatattaacaggaaggcaatacccatggaaatgtttgctgaaatagcttttttaattccaatctctttggcattttctaaatgtttctgatacctaccagaaaaatgagagggaaaacattataattaagaataacaatccatagtccgagtcacactcggctcctatatagttggaggtttaagtaacaaagtcagtcaaggtaatgaacccatggtgagacccagatctttgggaattgaactaattcaggatcagccaggcctagaacagatccaagccttctctttactggcccggttccatttcccttcatccattccaagccaaccaacattcctgtggttattccagaattgagggctcaccctgggatatggaagagcttctccatcaccttcacggcaatatcacaagtcagggttaagagggaatgagagaaaccaagccaaaccagaattgattgtaaatgtcactggaactcataaacagttagattcttaactctggtcaatgtctcttctctggagaaaagaaaatcgtccctctattgtccactgggtgagggatgaaaattttacatgttgttgtacataaacataggcttctctctttgacttttttaaaaatcaggctgaccttcatctgtcaagctagatacaggttataaggtagtcactacttatggaatatgagttcttattcaatttttccagactttagtttcatatatgaaaaatggatttaataatgcctaatttgcaagataattgtgaggttggtagataattgtagaaagtagtacagtagctggttcatagttagcaagcctgatcatttctcttactattatattagtatcattgtgttcaacttttatctcttcctgagttttgctcattctattactatcatatctttgaatcataattcaaatgcattattactggctgctggcatttgatataaagtttaaaatatctagaatgattctgttaaattacaattttttttcatcaagttaaatcaaatctactttttcatactagacccagagggtatgtaaaatttaatttgggctccctgaaatttaaagaaaaatccaatgggtatgcaatgacacttcgaggggaaaatatcacacaaactaggatatttttctttgtgacaaaaaaaaacaaaaaacaaaacacagcaacaccagttttagtgttgaaccaaataaaacatgagaattcattagtcttttaaaaaacatattctgccatcagaaggtttgtcttttttattgcgtaaagcacccaggtcttcagggtgctttcctctggttgggggctgcattcatagagcacagctgcatctctgggggtagccagcaggccacagctagcgctgtgatttctcctgtgtggctgagcctcaaggcgtggcaggaagacttgcatctgcccagtgtgacacacagctccagtgacagcagcggacacactgtaattacctttgcttaggtggctcgcttaccggggctaatggagcggcacagattacactgacatcctgaggtccaactgagggttagtgtggtctgtgtggactattatgtacaggaagcagcagtgagagagaaaaaaggaagaggttagaggatcagaaacatgttggctttgaagagggattaaggaatagaaaagtagaaaattaaatggggggaataagggaaactttgtttttaatgctagagaatttccagagaatttttatatccaagagttgtgagtatcaagagtcccatagaatagccaaagaaaatactttatatggaatcatacttcaactacagtaggggatattgttatttaaataaaaccctaagtaattattttcatttaagtagagcagaatagcctttttcataggtgtattcttatccccaaactcattgagatatacacactaaagatgtatacacagcttttcatatgtcaatcatgccttgataattttttcagagaagagtttgcaacatgcctccagatactggtcaattttccaggcttatcctggatcattaaagttgaatgccagaggcctgggtgggaagccctgcctcattgttatggaggacccacaaggccctacaaagaattctgggctataactaggaagtcgatgttttctcaggtttttctcttctatattccagttcatagtcattaaggagtaaaataaaataaaaaatattttgataagtatttttaatataattattttcctttgtaaccctacttattttgttttttggggcttttatttatttattttttggtttttaaaaaatttttactctttttttgtgatagaggctcactctatcatccaggctggagttcagctcactgcacccttgacattctgggctcaagggattctcctgcctcagcctcctgagtagctgggaccacaggtgcacaccaccacactcagcttattaaaaaaaaaaaaaattgtagagccagggtcttactacattgcccaggctggtcttgagctcctggattccagctaccctcctgccttggcttcccaaagggctagcatattttggtttatgcatttaaaaacaagggagtccatttgtattatcacatagccaaaagagtccatggaacataaatgattaagaatcttgctttagagtctgacattcaactatagccatcagtaaagggtgcttataatttatgcgagaagggttaatattaggaaagggaaggtaaaaaacacataccacaaagaagaagcaacaaaatgtaaaaacacattccttaaaccagtggctaaagaaccttcctgacctttccagctctttgttctggcccccgaaagctatcacagtcctgatggcccccagagcctcttctgccacggcgcctgcttttgcataagcagctagttctttgtcactaaatgccgagagtatctggacagaaaagaaacagtgatcacttttgtatagggagaaaagtttaaaggcactctggtcaaccctttaacctactttttcttcccaaaccctctcctttaacaaatattaaagtcatgtagcaaatgccagtgttctggatccaatggctgcgtccacatccctcaaaggctatatctgacccaccctggtgataggctccccaagagtactcaggaaaaaagaaaatccacacataattctctaaatagcactcttgggaacactgtcaagttccacatctactgtttttctttgttagttgtaaggtaaaataaaataaaactttactgctttgaaagaatttaccattcttaactttattgtgtcacaattttttttttttttttttttgagacggggtctcactctgttgcccagactggagtgcagtggcacgatctcggctcactgtaacctctgcctcccagtttcaagtgattcttctgcctcagcctcccgagtagctgggactacaagtgcacaccaccacgcctggctaattatttgtatttttagtagagacagggtttcactgtgttagccaggatggtctcaatctcctgacctcgtgatccacccactttggacttgtgtcacaatttttaattactataaaaacaatacttccagacctcctcatgggcattctgctgaataataagatagccaaacaagatgtttcaggagaaaagcaaaggaagaatcaaaacaaaagagatacaggtagttcactgtgtaaatcatcaacgtcaggatgagcaaaaattgccagtaaaatttctcaactctgaagtgttggctaaagtagaatacattttgtgtattttattgccaggcaaaactggcagagtgccacttaaccatcacaggtaatgattaaaacaaatagaacaaatacaaactctatttaaaatttttatgttcatgcaataatttgagggaaatgttatattttaaagttgcacttccttaactaagggtaatcgaagtaagaactgtgaattttttttttttttgagatgaagtcttactctgtcacccaagctggagtgaagtggcatgatctgggctcactgcgacctccacctcctgagttcagcgattctcctgtctcagcctcccaagtagctgggattacagtcatgcaccaccacgcaaggctagtttttcatatttttagtagagacagagttttgccatgttgtccaggctggtctggaactcctgacctcaagtgatttatgtaccttggcctcccaaagtgctgggatacaggaatgagtcaccacacccagcctgtgacattttgaattatgttaaaaattaatttccttatgaaagcatcatattaacaccatgttactggatgtagtttcaactgacatttaatgtagacctgaacaggtacaagtacgagacttctgcatattaaagattactgtgtgcaggggttaacacacataaaaaggcccagctttcacatacctttgcccaaacggctgcagagagtcctagaatagggctgatggccattatcacaagggtgagcttccatcctctgatgaatcccactatgaatcctgcaaaaaacgtggctactgcttgaaagaacattccaaccttgtcaccaattccttcactgattttggagatgtcactaaaaaagatcacacctaagtggttacaggcaggaggtttcagttagaaagatgaagtagacatccaacaaacacatagacaagtaaaatttgttcactgactgcaagcctctttcagagtcttagcctcttgaataacatcttccccacctaaacaccgcacaaaggaagaaattcaggattgatcaatgcttctaataagttagtatcattaagttgatactattaaatgagtcaatcctatgagagaagcattaacattttgagcataaaaatgtatctgtttaaaagcaagaattaagaagaacattgcaacaataataagcaacagtagtagggaagtattactgcatttcttcttatagggaagtaatagggaagagatctttgcttctactcttgtccctattcccaaccaagtctattctcaacacagcagccagtgggatgctttgaaaatgcaagtctgaccatgctactcctcagctcagaaacttccagcggctgccatttcactgggtgaaagctgaagtcttgaagtctttgtggaggtttacaaggccctaaatgtcttgcttttcccttttttttttttttttttttgacttatttgctcaggatgcctttgccaggactcccagtcaggaaagtttatcatctatctccctctactggaatgtaagcaccaaaaggacagagatctgtgctttgttcactgatatattacgaacacacagaatggtacttcgcacatgaaacaccctcaaatatttgttgaataagtgaagagttgacaattactaaagcaagtctctttgtaaattaattcaatcatctattcattgattcaaccatctttactgacagtctagcacctgtcacgtcctgcagtagaaagttccatgagaaataaacaggtataagatgtgaattcagtcctcaaataaacctactatgcaccttgggggaaagccaacatgcaatggcataggctatagatgctgctagacatggctgccagatgatcgatttctaatatagatcagatgctcaatctagtaacatttttcatttaaaatctttccttgacatattttcacacagtaattaatttctatatgaaagtgtgacattaacaatgtacctactctgttagccgcgtattgagttcagtggtgtcgttgatgtcaaaccatcctatttcctgtcgtagaatagcatgaaaaaacttctgcctaattttcctgatctgtcgaccagctgccaaagtccaaaatgaaacttgtatataggcagcaacaagaactccagcacccaatcctgagtagtaatatgcatatctgaaaaaaaagagaaaggctctattaaataccttctcttttcttttttcttttcttttcttttctgaaactgagtctcactctgtcacccaggctggagtgcagtggcaccatctcagctcactgcaacctccgcctcctggattcaagtgattctcctgcctcagcctcccgagtagctgggattacaggcatgcaccaccatacctggctaatttttgtatttttagtggagatggggtttcaccatgttggccaggctggtctcgaactcctgacctcaagtgatctgctcacctccgcctcccaaagtgctgggattatagcatgagccaccacccccaccctaccatcctttattcatctctttcaggagaaattttcagaactggaaattaatcaatttactaaacttaaaacaaaaactgtataggacattataacaaacagacattacatttttctttttttaaattataaagtgatgagctccatgatggcaaatctatttacttgaactgttagccaaagaaaatggataaatttttgttgttaactgcaaaaaagttaatgatttgtttttaactgatattgataacttgtggatacaatttaactcctctttaataattatattctagacttgtatatcttattgtactgaaaagttcactactatttacatattgcaaatatagtaataagcagattgaacatgtgaaatcgccctttccatattgatttttccacattctttataaaaagaaccaaaaaactttgttcctatttgtcagaatttgaaatattttaaaaaaagatatgataaaatgtcatgaattcaaacgaatttggaatgttttaccaaattagtagaaagttagtattttaaaaaataataagtacatatcaatactttcaaatttttattatctaattttataaactgcttccagatagacacctttcaggccttttagcatacagacagcactcgttacaatcagcaacactgctatgcagacatacaaacatcatgcttacaggctttagagatttctattgagaaactagaaggaggagaaaatgccataaatgacattattggatcaaatgacaaaattggaatatagatgttatattagataaaagtactgaaatttactgaagctaatagctgtactgtgattatgtaagaaaatatccttattcttaggagtcatactgcagtaaagggccatgatgtgtgcatcttactttaaattgggatttgggagcaaaaatgataataataggtgaatctgggtaaagagtacacgttatttgtatattcttataactctgtaattggaaattatcttcaaatgaaactttaaaaaagtagaccatatatatgagttacctagtcatttcttcttccagaattttgcctggatttagcagcgacaaggaaaagttcactaaattaaaaaataaaataaaacatgttaaaagatcaaactattaataggcattgccaggtttttaaaaatctgttaataatttaaatgtatgaaagctagaagatgctattgttaagtttctctttaaaaaacacttttctttgcacacttaagtgcattcttttcactttactcaagtaaagagcccaagggtttaggtactggacattaagggccaagaaaggggaagataagccctcccaggtctttcccccatcctggcggtctcagcctttagcaaagcagccttctaaggaggcacagaggagccactgaagagacaaggaagccacaaaacacacagaagacagaggagggaataagaaatatttaaaatagaaaacacaggatttaagaggcattttttttttttggtggctcaaagcactttatagaacttcaataaattttatttttatatctgtgtgttttttctttacatgtctcatatgacataagtaagggaaaggctaagttacatccatcgcaaaggaggaaaaactagacagggaagataacttagttgctcaaaggcatgtcagtgatcactggcaattagtgaacatcctgcattccacctcttgtttaccagcactgctgtattctagtattttttgaagcagtattaattggaaagaaatctattgtctattaatttgagctaatttgataaaatgtcaatgtatctttcctgatttccatgttttaataatagctaatgtttattgagcatttattaaataccaggcactgctctgaatactttaggtgtgttaattcatttaattatcttatgaggtgagactatttcacaaaccccattttatagaataggaaatggaggcacagataaataaagtaacttactcaatgtcatacagctagtaagtggcagagctgaaagtcagcccaggcaatttggcctatgctcgtaacactatactatactgatttattcatgtgacaatgacttatttttattttttagaaaagacaaatgaaaaaataagaaacagcctacatctactgcattcacaaaataataggataaaatatcaccacagcattgttgagaaaacacatcagggtacatatttctcattttccatggtcctaggagagaaattggtctctttgttcctttgccatgtgtaaatagcccaggggtcgtgttttcgtgttttcgtggtgctgtgtatcctccttatctttttccaaagaaagataaggttgaaacttatttaaaactcaaactactgtcaggatcaattaccaggcatctggccccaactgcagcatcatctttcccccaggattataatttctactgatgttcacagtgaaatttccgattattaatctagctctttataagctatcagaaccttgaagattcataccctattttacttttcatcttatcagttcctttctgtgtgttcatttccatcctgaagttttaaatagggcaaattggaagagtatttggaactagaggcaggcaagctattctaaagctgtggcatttgtaaaaatcattgtggtttttttatttccctgaactgaaaaattgggtgaaatcttaaataagtttttcctctctttcaacacctacctcaaacttttaaattctctcaataaggatactgatatggtttggatatttgttccctccaaatctcacgttgaaatgtgatcctcagtgttggaggtggggcctgatgggaggtgtttgggtcaaggggacagatcccacatgaatggcttggtgccctccctgagataatgagcgagttctcactcagttcatgtgacagctggttgttaaagagagcctggcctctccctcctgctccctctctctccatgtgacacatctgctccccattcaccttccctcactgagtaaaagcttcctgaggctttgccagaagccccaaacagatgtgggtaccatacttttacagcctgctgaaccatgagccaaataaacatattttcttcataaattacccagtctcaggtattccttcctagcaacacaaaatggactaacacagataccaactcaaattgactctccctcctaggaaagaatctatgagcgttccagattggacccgctcctttctcagagtctcaagaatggaaatctagtgctgggttagtaacctgaggagctccagagtccccggggaaactcagagtttctgctgcctgggacaaaggtgaactaaacatatgttggtgtgttgcctgaaaagtcatggcctgctagatctgaaaagagcctactcctggtcttgtcagatgctacctattctgcttcagtctcataaacgatatctacatggtcatttggcttggtggtacttaacgctgtctgtgcattagaattacatggggagcttaagaattacagatgttcaggctccactcaagcccaatgcagccagaatctctggttgagtccagagcatcacatttttataaagtgccccccgccaggcccggtggctcacacctataattacagcactttgggaggctgaggcgggaggatcacttgaggccaggagtttgagaccagcctgggcaacgtggtgaaatccacctttacaaaaagttggccgggcatggtggcaggtgcctgtagtcccagctacacaggagactgaagcaggaggattacttgagcccaggagctcaaggctggagtgagctatgatcacttcactgcactctagcctgggcaacagagcaagaccctgtctcaaaaaagaaaaagtaccctggttgattctaatatgccaggatggagaacttacaccccagtccacctgaatgcctcccgtagtaaggaactggggaactcctgaagctgcctgttcattttagagagtacctatataacctatccattttacagatgaagagacagagtgggttgtttcatttccaagttcttatagctagtttgtcccaatatttattgatcatttactatgttccagacactttacacaaatcatctcacttaattctatcagtaaattgatgcttacctctcaaagatgagaacagtaaggattatagaggttaagagacttgctcatggtcacacagcttatgggtgaagggtctgaataagcagtgtatacattaaggattagatagggaaacatagtcttcattttcacttttgagtctcaaagtaaatcaatgtctgccttcccggattctgcccaagacttctttttttttcaaaggggaagaaagagaggtatccatcacctcaagcatctctcctttctttgtgttacaaacaatccaattatgtacttttagttatttttaaatgttgcctaggacttcttttaacacatagaactattcattataaaataaagagctggtgtttgttcaggcaccctaggcactatggacagttatgaagatatcttgggggctcaaaatggcatttttcccctcaaacaagaggcaatgcaaggacaatcagggtgcagctattttcccgcagaattttctagactattatagtcacagagacagcataaaagatatcaagtccttgacactctgcagaaaaactgttttctccaactccgtccttaatgttttggatgcagaatgttgtgtgcatactttctgcacaactgactcattgtgagggaacaaccctgtcatggagtggctttattctgttgacaaggacgagctttgctcacaataagtcattgtcagaccctcttgtaatatgaacctttttttcttctaacatgcctttctcatttggctcctattaagtctggttgtccaagcatccaacaattctaaagaatagactaagtaaacatctctaagagataagctggaacctcagctaagtacctcactctatctgttcccaacccccatgatttttgttaaactctacaactctcaacacatcaataagcagtctggatttagagtgagtatcctttaaagatttcattgtcttctaagaggtatgagaatattatttttacaaacgaccaaagagtggatgctggaaattcataacatttgaggaactttccatctaaatactccatagcatccagtaagcctaatgagaaacatggctacagggtaccaagcatcataacaggagtgtttataattcggaggctaccaaaacaaagttggcaactctcgcgagtttatctctgtgtcaaccacagttctgtaagtgacttgcttgtgccattccccagagagaccttgaatttggcacctctctgccatgtccagcttaaagccattcagtttcataattaggcacaagttaaaaaaaaaaaaaaaagcaaactgctccaaataagaaagttgggaattattctggtattagtaaaaacaaaaacagaactaataaaattggtccaaaagagaaatgatgtgtgataagtgaattgcattgctttaatctgactttaaaaattttaattgtgataaaataccttacataaagtttaccatgttaactatttttaagtgtacagttcagtactgttaagtatattcacactgttgtccagccaacctccagaactttttcaacttgcaaaattgaaattctatacccattaaacaacagctccccactgctcctccccacaacccctattaaccaccattccacttgcgttcttatgaattttactctagatacctcataaaagtagaatcgaacagtatttatctttttttgagtggctcatttcatttagcgtcatgtcctcaaggttcatctatgacatagcatatgtcagaagttatttcccttcaaaaggctgaataatattccattgtatgtatctaccatatcttatttttccattcatctgttaatctgatttttttaaccctgtgtagaagccatttaaaattttttttttactttaaatttattttttcttggtaaaggtgtatacgtcaacagttacaagcgagaatacagggagacatcacacccacccattttcaaagccactcactttctctccctagaagtaatcatcagtttctctacattatttcacagatattttatggacatataagtgcttcgctggaaggctaatgtgagtcaccaagagataatatctgcgacacttgaaaagaggtgctagaccatacatgaacagataaagttgggtcttattccacaaaaatattccattggtgctctaataaatggtgctttatggtttgaagatcaggaaatgtgaaacccaaagataatttcaaagtaggggcagtggagatatggtgctgacaattcaggagttggagaaacgtctttgtagtttctttgattttttttttccagatgaaataagatggaaatcaaaggcagctggtgtaagttcctatacagtcattgtcctgctactaaagggatgggtgagaaacccagctccgcatctggaaggtcagaccatttaatagacccttgagtattaatgtgcataaatgcatctctgattcactgtggggaaggaaatgtcttgctaaaataccattgctaattcagtgggtccagatgtggcctgggagtctgcatttcttttttcttttctttttaaaataatttcaatttttattttagattcagggggtatatgtgcagttctgttacatggggatactgtgtgatgctgaggtttgggatatgaatgatcctgtcacccaggtagtgagcataatacctagtatttggtttttcaacacttgctgccctccctcccctctctagtagatctcagtgtctattgttctcatctttatgtcaatgtgttacccaatgcttagctcccacttataagtgagaatatgcagtatttggttttctattcttgtgttaatttgcttaggataattgcctccagctgtatccatgttgctggaaaggacacaattttgtatttatttatttatttatttatttatttatttatttatttattttgagacaaggtcttgcactgtcgcccaggctggagtgcagtggcaccatctcggctcactacaacctccacctcctgggttcaagcaactctccagcctcagcttcccaagtagctggtgatttcgtattttttataggtgtgtagtattccataagaaatagatttttaactgaggtgtcttaatatgggcatcatcctgctctatatgtatacaaaattaatatgttgtagatctgtagattttctaggaaaacaaatacacaatagaaaattcctacctctcccatttctttaaagactttttttttcttgagacggagttttgctcttgttgcccaggctgtagtgcaatggcaacctccgccccctgggttcaagcgattcctctgcctcagcctccagagtagctgggattacaggcatgagccaccatgcctggctaattttgtatttttagtagagatggggtttctccacaatggtcaggctggtctcgaactcccaaactcaaaacttaattgccaccaccttggcctcccaaagtgctgggattacaggtgtgaaccaccaacacccagcctctttaaagactttttaaactatctgtcctaccacaacttcacaatgtttatgttaaagttttggtcactagtcacaaataagcaatccatttaaaactttcccaagcacttttttttccgaatcatctatattgacactatactatatatgataataagcatggtttggatggcagaaagaccagcagtgtaactatggaaaagttatttgccctctccaagccttggttttgccatctatcacagaagataacattacctactgtgtagtattgttcttgtgagggtaaagtggaataatgtatgtaaagtgctcagcataggacctagcacatagtaagcacaatgaaaaatcaccattattgttatttttattataaagaggtttttttcagaaactatattacttgagaataaataaataaacttttataggagtttgctttaaatattcaaaggatgcttttactggatttttaaaaggcattaatatttatcaatatttatgtaaacatattctgctgtattaattaaacaatcctattctcttaggaaattacacgtaaggcctacaatagtaactaaatatgtagttctcagtcagtgaacactgtaaattcttattcaatgctgtctaaatgatagagtaatttttcttacatatctttgctaagaaagctgcctttcctttaccagtgttttgaaaatattctaccatctgtgcaacagtaaagcttcactcagtcttctccagcccagtgcccacaaggtctcttagagaaaagaggcttcaggcttggtagaaagcatgaaaattttcctttctatgttgaatttcgttactatgaaaataaccatgtctattggagccccactgtaatgctattgtcagggcctctcgtattgataacattaacttatgggacacttggctcttcagtaatcatagtcctttgggtgagttccaagggacgtattgaatccattcactctttagtgaaatgccatctcaagttccagtcaatctggttgatccaaaattagagacagaaaatgggtataattttttttaaggtgaaggggagagaagaaaagaaaacccagaaacagatctacaagctaaacacagctaagaagtactgccatgtttaactgatgtgctttgaaactcatcagcaattactaatgggatggatactgcatagagatactctcattacatttccactgttctcaagtagagtgacttccttactttatttagaagcttcctgtgtatttccttcacctgtattaaaagtcaaacaacaatacacatatttctttaaatttaaacgagtatttgaacaattttctgagaattttacaactccttctatgatatctggagtcaaccagatatccaaatcattaaataagatggtaatgaatagcaaaatcaactcccaaatttttacccagttaaagaaatgctatggatttttttaaaaggtaaagaaatgcttacctggaaaggagaagtttcctgcagtatcaacaaatttgtcagtcatctctccaaatactatcatcatgagggggagacctgatccgtgagctatggccatgatggtacccagcgacataaacaatttatcctgccaatcggagtatcgaaactaaaaaaaggaaataaaataatacttagctgtggaatggaatttctcctcttccataattatatattctttggatttttatttaaagtcagtacttttttaagagttgtaaatgaatgtcttagaaaaggaggccttcaaatcattaacaacttaatttcatgattctgtttattttgtattctgtgaagaaatcaatctaattatgtttaattggtatctgatttgaataaataattactatacaatcaaaagggataaaggtttaagaaatattatttgatatcccagagctcctgtggtaataaagaacggctagggaaagacattaagtttaaacacacacacacacacacacacacacacaccacatcctttaaaaaagcattcagaatatttcagagggagaatttaaaatagaggaaaatagatgctctgagttttgagataagatccctttagaaggtttaagttagctttaaaaaggcaactcagtagtgaagcacaataaacattacagtgtgtctatatatgcaccttagggaagtcttgcctatggagatccttatgcagaaccttttttaaaaatttagttttcaccagtgtcacctgccaagtatgcagaaccttgaagggtaagagggagttcgctggagaagaatcggcgagtgtaaaagaagtaggaagaatttaggcttagaataagaaggtaactagaaactacatggaatgcttaagtaacccctggcagtggaattcctgaagggcacagtacaaagtgtgggagaggatgttggagagagatagaaggcctgcgctggtgggccacaccaagaatcttggacacagtactacctacagaggggaagggtgataccagttgtcacagtgaagtgcacaaccctcaagaactaaccagcagttcagtgttctaacacttcaaaggactttgttactgtcttattagtcctcttccatttctcaccttttctttctgtttttgattgacccatttatggctctctttctctttgttcttctttcctcctctgccttctagactacattttcctcatcttacatttccatttctatagcttcctatcttttttttctctcctctcttttaaaatgctttactctgcccattccccccacctcagccccttttggggacaaagaacagttattgggagagagggtgatgagccaggcttggcacagtggagcctttgagggctgaagctaggtcagactgggtcaataacccgggtgaggctgaggttagaggcacatggtggaaagtggatatgtgtgtacaccattctcaaagatttccaggagttcaggcaaggtttcagggacagggacaaactccatcatcaaacacacagggcaagcaagagaaccgaaagagacaaagggtcagaaaccaggcagagcttggataaaacaatgggagcaggtaaagtcaagagccaatggagctgggtccctaaaattgtcacaaagggaccagtgtcccaaaggttcatttttagtggttctgggaaaaggaaaacagaacacttgagtctgtcagctatagttaaaagcacagggtcaggttgttaacattaaaaagcattttaaatgttttcatattaattgaatacaattttacagcctctaagcataaatttaaaacgaggtgaatttcacagcaacatcctaagtaaacctaggtttgttttcagtgattttccagaaaataatatatttctaactcctgttagagcacagttttatcctcaacctctttcaggacaaaaaatatctattaagatatctagtaagaggtgaaaataaatattaaatttaagtttaacttaagctaaaacttctaaattcaaatgaaaatttctgttcctacattaaggtttgtaggattgtattttctgtaggaggcagatttaaaacctatgcattaaaaccagctttcagaggcggttccaagatagctgattaggaacagctccagtcaacagctcccagtgcaagtgacacagataacaggtgatttctgcatttcctactgaggccccaggttcatctcactgcggcttgtcggacagtgggtgcaggacagtaggtgcagcgcaccgagcatgagccaaagcagggggaagcatcccctcacccgagaagcacaagaggtcagggaattccctttcctagccaagcaaagctgtgacagacggcacctggaaaatcgggtcactctcaccctaatactgcgcttttccaatggtcttagcaaacggcacatcaggagattacatcccacgcctggctcagagggtcccacacccacgaagcctcgctcattgctagcacagcagtctgaaatcaatctgcaaggtggcagcgaggctgggggaagggtgccctccatagctgagacttgagtaggtaaacaaagcggccaggaagctcttgagtaggtaaacaaagcggccaggaactgggtggagcccaccacagctcaaagagacctgcctgcctctgtagactctgcctctaggggtagggcatagctgaacaaaaggcagcagaaacctctgcagacttaaatgtccctgtctgacaggtttcaagagagtagtggttctcccagcacagcatttgagatctgagaatggacagactgccttctcaagtgggtccctgacccccgagtagcctaactgggaggcaccacccagtaggggcagactgacacctcacatggccgggcagccctctgagacgaaacttccagaggaacaatcaggcagcaacattcgctgttcatcaatattcgctgttctgcagcctccgctgctgatacccaggaaaacagggtctggagtggacctccagcaaactccaacagacctgcggctgagggtcctgactgttagaaggaaaactaacaaacagaaaggacatccacgccaaaacccatctgtacgtcaccatcatcaaaaaccaaaggtagataaaaccacaaagatggggaaaaaacagaacagaaaaactgaaaattctaaaaatcagagcgcctctcctcctccaaaggaatgcagctcctcaccagcaatggaacaaagcaggacggagaatgactttgatgagttgagagaagaaggctacagatgatcaaacttctctgagctaaagacggaagttcgaacccatggcaaagaagttaaaaacctagaaaaaagaatagatgaatggctaactagaataaccgatgcagagaagtccttaaaggacctgatggagctgaaaaccatggcacaagaactatgtgacgaaagcacaagcttcagtagccaattcgatcaagtggaagaaagggtatcagtgattgaagatcaaatgaatgaaatgaaacaagaagaggagtttagagaaaaaagaataaaaagaaacaagcaaagcctccaagaaatatgggactatgtgaaaagaccaaatctatgtgtgattggtgtacctgaaagtgacaggattaatggaaccaagttggaaaacactctgcaggatattatccaggagaacttccccaatctagcaaggcaggccaacattcaaattcaggaaatacagagaacaccacaaagatactcctcgagaacagcaactccaagaaacataattgtcagattcgccaaagttgaaatgaaggaaaaaatgttaagagcatgcagagagaaaggtcaggttacccacaaagggaagcccatcagactaacagctgatctctcggcagaaactctacaagccagaagagagagggggccaatattcaacattcttaaagaaaagaattttcaacccagaatttcacatccagccaaactaagcttcataagcgaaggagaaataaaatactttacagacaagcaaatgctgagagattttgttaccaccaggcctgccctaaaagaggtcctgaaggaagcactaaacgtggaaaggaacagccagtaccagtcactgcaaaaacataccaaattgtaaagaccatcaaggctaggaagaaactgcatcaactaatgagcaaaataaccagctaaaatcataatgacaggatcaaatccacacataactatattaaccttaaatttaaatgggctaaatgctccaattaaaagacacagactggcaaactggataaagagtcaagacccatcagtgtgctgtattcaggaaacccatctcacgtgcagagacacacataggctcaaaagaaagggatggaggaagatctaccaagcaaatggaaaacaaaaaaaggcagggattgcaatcctagtctctgataaaacagaatttaaaccaacaaagatcaaaagagacaaagaaggccattacataatggtaaacggatcaattcaacaagaagaactaactatcctaaatatatatattcacccaatacaggagcaccaagattcataaagcaagtccttagatacctacaaagagactcccacacaataataatgggagactttaagaccccactatcagcattagacagatcaacgagacagaagttaacaaggatatccaggaattgaactcagctctgcaccaagtggacctaatagacatctacagaactctccaccccaaatcaacagaatatacattcttctcagcaccacactgcacttactccaaaattgaccacgtagttggaagtaaagcactcctcagcaaatgtaaaagaacagaaattataacaaactgtgtctcagaccacagtgcaatcaaactagaactcaggattaagaaactcactcaaaaccgctcaactacatggaaactgaacaacctgctcctgaacgactactgggcacataacgaaatgaaggcagaaataaagatgttctttgaaaccaatgagaacaaagacacaacataccagaatctctgggacacatttaaagcagtgggtagagggaaattaatagcactaaatgcccacaagagaaagcaggaaaggtgtaaaattgacaccctaacatcacaattaaaagaactagagaagcatgagcaaacacattcaaaagctagcagaaggcaagaaataactaagatcagagcagaactgaaggagatagagacataaaaaacccttcaaaaagtcaatgaatccaggagctggttttttgaaaagatcaacaaaattgattgactgctagcaagaccaataaagaagaaaagagagaagaatcaaatagacgcaataaaaaatgataaaggggatatcaccactgatatcacagaaatacaaactaccatcagagaatactgtaaacacccctacataaataaactagaaaatctagaagaaatggataaattcctcaacacatacaccctcccaagactaaaccaggaagaagttgaatctctgaatagaccaataacgggctctgaaattaatagcttaccaaccaaaaaaagtccaggaccagacagaatcacagccgaattctaccagaggtacaaggaggaactggtaccattccttctgaaactattccaatcaatagaaaaagagggaatcctccctaactcattttatgaggccagcatcatcctgataccaaagcctggcagagtcacaacaaaaaaagagaattttagaccaatatccctgacgaacatcaatgcaaaaatcctcaataaaatactggcaaaccgtgggcgcggtggctcacgcctataatcgcagcactttgggaggctgaggcgggcggatcacaaggtcaagagatcaagaccatcctggctaacatggtgaaaccctgtctctactaaaaatacaaaaactagccaggcgtggtggtggggacctgtagtctcagctactcgagaggctgaggcaggagaatggcgtgaacccgggaggcgcagcttgcagtgagcccagatagcgccactacagtccggcctgggcgaaacagcgcaactccgtctcaaaaaataaataaataaaataaaataaaataaaataaaataaaataaaatactggcaaaccgaatccagcagcacatcaaaaagcttatccaccatgatcaagtgggcttcacccctgggatgcaaggctggttcaacatacacaaatcaataaacgtaatacagcatataaacagaaccaaagaaaaaaaccacattattatctcaatagatgcagaaaaggcctttgacaaaattcaacagccattcatgctaaaaactctcaataaattaggtattgatgggaggtatctaaacataataagagctatttatgacaaacccatagccaatatcatactgaatgggaaaaactggaagcattccctttgaaaattggcacaagacaggatgccctctctcaccactcctattcaacatagtgttggaagttctggccagggcaatcaggcagaagaaagaaagaaagggtattcaattaggaaaagaggaagtaaaactgtccctgtttgcagatgacatgactgtatatctagaaaaccccattgtctcagcccaaagcctccttaagctgataagcaacttcagcaaagtctcaggatacaaaatcaatgtgcaaaaatcacaagcattcttatacatcaataacagacagagagccaaatcatgagtgaactcccattcacaattgcttcaaagagaataaaatacctaggaatccaacttacaagggatgtgaaggacctcttcaaggagaactacaaaccactgctcaacgaaataaaagaggacacaaacaaatggaagaacattccatgctcatggataggaagaatcaatatcgtgaaaatggccatactgcccaaggtaatttatagattcaatgccatccccatcaagctaccaatgactttcttcatagaattggaaaaaactactttaaagttaatatggaaccaaaaaagagcctgcattggcaagtcaatcctaagctaaaagaacaaagctggaggcatcatgctacctgacttcaaactatactacaaggctacagtaaccaaaacagcatggtactggtaccaaaacagagatatagaccaatggaacagaacagagccctcagaaataataccatacatctacaactatctgatctttgacaaacctgacaaaaacaagaaatgggaaaaggattccctatttaacaaatggtgctgggaaaactggctagccatatgtagaaagctgaaactggatcccttccttacaccttatacaaacattaattcaagatggattaaagacttacatgttagacctaaaaccataaaaaccctagaagaaaacctaggcaataccattcaggacataggcatggtcaaggagttcatgtctaaaacaccaaaagcaaaggcaacaaaagccaaaattgacaaaaatgggatctaattaaactaaagagcttctgcacagcaaaagaaactatcattagagtgaactggcaacctacagaatgggagaaaatttttgcaatctactcatctgacaaagggctagtatccagaatctacaaagaactcaaacaaatttacaagaaaaaaacaaccccaccaacaagtgggtgaaggatatgaacagacactcctcaaaagaagacatttatgcagccaatagacacatgaaaaaatgctcatgatcactggccatcagagaaatgcaaatcaaaaccacaatgagataccatctcacaccagttagaatggcaatcattaaaaagtcaggaaacaacaggtgctggagaggatgtggagaaataggaacacttttacactattggtgggactgtaaactagttcaaccattgtggaagacagtgtggtgattcctcaaggatctagaactagaaatatcatttgacccagccatcccattactaggtatatacccaaaggaatataaatcatgctgctatacagacacatgcacaagtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcctcagcaaactatcgcaaggacaaaaaaccaaacacctcatgttctcactcacaggtgggaactgaacaatgagaacacttggacacaggaaggggaacatcacacaccggggcctattgtggggtggggggatgggggagggatagcattaggagatatacctaatgtaaatgacaagttaatgggtgcagcacaccaacatggcacatgtatacatatgtaacaaacctgcacgttatgcacatgtaccctagaacttaaagtataatttaaacaaatttaaaaaaataaagaaaaaaaaacttctaaaaaaataaataaaaccagctttcatttgataaacaatttattctccaaagtgctaatttttttttaaattgcccttactgaggctttttaaacaaataaaaaaagaggagagaagacaatgaataggggcttttggttacatgagaagtatgcagcagtgtttgagagtgtggatgttttggtgtctttttatccatttaattactaagttggatttcagctgacatgacacttaattctaacttctttgctaccaaataatggctgtcacagtttgaaacacgtcatatttaccaaaaatgggcaaatgctttcttgagctgcctctgtaagacatatttcaaatgaaaaccagatgaggagacttcttccaaaaatattgtcttgtcttgtaccaacagaaaagcaccgaaaactgttttaagcataatcagaattcctaatagttaccccctatttagccaattttttggaaaccaaatgtgaatgtagattccttaaattaaaatttatgtacttaacaattactttcttgaaatgcaagcttattttaagctaaatttggggtgggggtctgtgaagcaaatgcagaaatgcattttcttgaaattgttgagtttgcattgtgctactaacacaattcccattttcactttccttgcacaccagttagctctgtccggtgtcatcgccagcctgtctctactttttaaaaaatcatccatcttaagaatgtgggtcattgactataataagccaaacttatacagcacaggtgcagcaaggacaatttattgctgtctgcagacagttttttgttgtcgttgtttttgagacagggtcttgctctgccacccaggctggagtgcagtggtgtgatcataactcactgcagcctcagactcctaagaccctcctgcctcagcctcccaagtagctgggactacaggttcatgccatgacatatgctattttttaagatttttatttttattattttgtagagatgagatctcactatgttgtccaggctggtctcaaactcttgtgctcaagcaaccctcccacctcagtctcccaaagtgctgggattacaagtatgagtcagctcgcctagctagacaatcttaaagtatttgctttaaaggtaattgattcaatacctcaaatttgaataaaaggtaggattattcacatttaacatttcacagcttaccaatgttaatactccaatcattttcactgtcttcgtttttttccttttttgtttgctgtaaaaaatagaattgcttcaatttaaaactgttacaaaatgttttacaatcaattgaacataaatatgtttagttacaatattcaactattatattttcaaatataagagtgatgttcacaaaatgtcaaaattattcagttcaacaaacatagcaagcacaaaagtaactgtcgaaggtactacaaagatacatggatacataagaaatggtcgcctgccttacagagctcacatacacaggaaagataagtatgctaacagtgtcgctaagtcaattaagttatttgttttctaaaattaaaaaaaatcatgatttaaaattaggaatgtctattcttctgaaggattgtggagagtggtgtcaggcaatcttgttggtgatacattcaaagtacatctagaatttaaccacttatcaccagtttcattgctgtcaccagtagggcagcctcctgcctagtctctccacttccacctatgccgcttcagtctatcttcaactagcagtcagagtaattatttcaaaatgccaagccatacactacttctttgctcaaaaacctacaatggctttcctttttcttacaataaaagccaaaatccttgcattaacctctgaggtcctacacgatctgtttgcttatttcctctctgaccacatccctactcccaaacctgcttactctgctccaaccagcctggactctctgctgttccatgaactcaccaaacatgtacctgactcagggtctttgcattgccagttaccttttccgggaatgctctccccttagatacccacacagctgtctcctctcatttctttcaagtctttgctcaaatattacctttaaaataagatctaccctaaccaccctacttaaaattacaaagtactccccttttgtactcctgatccccttaacctggattaatgcttttttccatggcgttaattaccttctaacattggctgtggtttacttatttagtatgtacattatttatgtctgtcctccgtactataatataaactctatgagggagtgtgtgtgtgtgtgtgtgtatgatgatttatatatatatgatgatttttacataaatatgatgcatttatccaggtaaatgataaagttttactcataagatgattccaaattatgtaaagtattgactaaaatcactggacaaacatctgccactaaatatgttcaaaagaatgtgccatgggcaatagcaacataattagaacaagaatataactaatttgattgaagcaggcttaacttcctttaaatatattatctttggtctgcttttataaaaattagtttcactacatttgatttcataatcatgtggtcttaacttattgttaactttctgtatttctcttttgagctgctttcttctttccagcagaagctgtgggcttcccctctgaggactttcctgggttctgaagtgttactacaccttttgtaggaatagctcctttgcacacgcatcaaatgttaagccagtgcaatacataaatagacttcttcatgaaaatgccatctattaatagactcacagtcaatccctgcctaaacagccagctgatgaaaaccatatttttctattgcgtgtgtaagtacttccattggaagtaacaccatctatcactttttcaattctacatggcaaaactaaattttctatgaaaaaatacaatggtgcttagaagaaatacagcaaggttactgcacaaccacattaacaggctaaaataatgcttcagtttaagcatcaggtaggcatgttttcagttagctaatcaagcccctagcagcttgaggacaaactacagagactgataaatttgtccctctgggtgatcacttgacacaggtcaattttttctgggtagcctggtatgaactcagagaccgtaatagcctcataaactatttcaggctaaaggcgaaaatgattcactattcccacagtgaaagaggaaacaaagacacacgccattgactgggaacttctgccccgctcataaagcctgtgaagtgagtttaacaagggccaggggaaccgagaaagacatgaaggcaaaggaagcgctgcttccccctaccacttgaacaaaactgattcggatgtacagaagttccccctccccacctatcctcccagaaaggagaaatacaaataagcctggcgatgagaggagggggaggggtaagacaaggaggaagagacataacaggggatgggcaggaggggagggagtttttgcttcactgcccttgttcaaaaagcacagccatcaacagcagatgtctgacaccctttaagtctgaacaatcagatgatgtatatgaaagtcatttgtaaaagtttcaagagttacgtaatacaatgaatgttatacaatgcagatattcattgaatcccccctgcacaaagggaagggagcacttttcaagacagccttttcttcctgaatctgttccaaaaggagcctcagtgacattctttgaggccacacaacacgtttgctccaaggtcagaaccggatgcaagacccttcaaagaagcctccaaaacaaaggtcttcaaaggcatcaaccgatttttacaacttctttccaagggtgaacttagtcctgctgattggcgtgtaacggaaaagccagtggctgctggggatgtacctgctgatgcccagttcaaagtcgccctccgcgctcgtggggcgccaggctgttccgttctttgccgcctcaagatccatctcagcctgaggagaaaccacagcctcagaaccaagtacaccctctccggcggcccggcgcacgagtcgcggggcccgggggcactgggtggaggtccggccactcccgccccgcgccccacgtcccgggtctcccttcgaggccagacgcgcccggacctctctcacctcgaacctcgcgcgtgtctggcagggcctctggacgcgcgggcgctgcagcagaggggcctggactttg

SEQ ID NO: 1764 - DNA, 73660 bp, Homo sapiens; identical to SEQ ID NO: 1763

SEQ ID NO: 1765 - DNA, 73660 bp, Homo sapiens; identical to SEQ ID NO: 1763

SEQ ID NO: 1766 - DNA, 46510 bp, Homo sapiens
caaggaaatggagatccaaaggaaagcctgaagcactttgtggcttccacgggttcgtttctaggaagcttttgctttacctggggaaaccccaagctctacagtgagaaagttgtaaattagcctttaggagacgctgtttgtcaaagttatcttaaccctggaaaaggggagggaaaaaggcagataagcagtgatgacatcagcaggaaactagtatcaggctacccagtcctgaagattcagttttcacttaaacaaccagcaagtcttgaagtctcttcccaagcaaatgggagcttctttggaccttggagcacacagaggattctactttctttaaaactttgttttcaggcaatttccctgagaaccgtttacttccagaagattggtggagcttgatctgaaggtatgtaattaacaacccttcttactccagagtctcatgcttgaatcttttcctttgcttcatggcttcgtgttgtagaaacttgcaaaaacttgtcagcaatggcactattttttcttagatttctttgtcatgcctgggaaaacaaaagttaaaaaatccggaagcctccaacatagccttttaccggggcagaaatatgttagctcacagagacaaagtttggtagactcactaaaactagagatcagaattgtcaagaaaccacaaggcaaatgctagatgcggtagaatagaaaggtgtctccaataaaccactcatttgacctcagggctagtagcagggaagatcccctggattatcacattaaaaatgacatttttttgtttcttttaacaccaaaagtaatgtgtatgctcacatatgcataaaatttgagaaattcaattggaagcccagaaggaaatttgtattatctatagttatgtcacctcgatataaccactgtttgttatggaggttttgatttttgctgtgtcttccttcctttatttatttatttatttatttatttatttatctatttatttatttgagacggagtctccctctttcaccctccagcactcaagctggagtgcagtggcacaatcttggcttactgcaacttccgcctcccaggttcaagcaatcctcccatctcagcttcctatgaagctgggaccacaggcatacaccaccaagcccagctaatttttgtattttttgtagagacggggtttcaccgtgttgcccaggcttgtcccgaattcctggcctcacagtgatccacctgcctcagtctcctgaagtgcttctctgattataatgaaatttagtatgtagaataccatagtttatagactagtcagatggaaacattgactcatgtaatttttatcttccttcgctgatttgagcaactcttgtctaaaatcaccctttccttctgaggtctaggaggtttttttgttgttgttttgttttgtttttgaggcagggtcttgctctgtcacccagggtggagtgcagtggcacaatcatggctcactggaacctccatccccggggctcaaatgatccttctgcttcagccctctgagtagttgggaccacaggcgtgcaccaccatgcctggctaatttttgtattttttgtagagatggggttttaccacgttgcccagtctggtcttgaactcctggcctcaagtgatccacccgccttggcctcccaaagtgctgggattataggcgtaagccatgacaccccacctgttccttcctttataaagtattttcttgtttctaaaaatagccaagttctgcatattgactacatacctcaagtgcttatagaataaatagtattacaatgaaaattttatcactgcattgctcctctgattatgatgaaatttagtatagagaatagcatagtttataaactgatcagatggaaacattgactcatgtaatttgtttttttttagtgaaaacaagtttattagagaagtaaagaaacaaaagaatggctactccatagacagagcagccgactcatgtaatttttaacttcctacactgatttgagcaactcttgtctaaaaccaccctttcctcctgaggtctaggatattttatttatttatttttctttttgaaacagggtctcactctgtcacccagggtgaagtgcagtggcatgatcatggctcactgcaacctgtgctccccaggctcaaatgatccttccatcctcggcctcctgagtagttgggaccacaggcatgtgccaccatgccctgataattttttgtatttttagtagagaccaggtctcgccatgttgctcaggcttgaggtctaggattatgccttccctttctgtaagataaaggcctgccctcttacaggtagcagtctgaagttaagatgtaacacacatacctcacggtaccttgctgtctttgggttgatagatcataaggataaccctgcctcccccagattgctttgtgtctaaaacttaaagcatagagccaagtgctatttctgccacgtgctggaaatgaatgtaagggctccaatcaggctaccaggcttgagaaaaattgtgctgtgtccctccatcttaactttctctctctgggaacattttgatttgggagaaatcaaggtgaattgaattccaatataagcaccctccaagtttcctaaaaagtaacttgcaagtgttggggaaaagttttctgggctgttgctttttgaagtagcctcgccgtaatttttatttttcagcacttctaggaaagtctaatgcccagaacggagaaggttgtggtgaggggagggcctgggaagtcagggggccatatgtcctcactctctaactccctgccccacctctctgtccctttcaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttaggtgaggacgggtctgtggtggagatgggaggatctcccatctagtgttcattctggccattgggctttgaaaggaagctgcagttaagatcttttggttatctacctccttggatgataaaccaggagattctaaacctccttctcagcctctgatgctaatgagataagagttgggaggtcagcaaagcttcaagaccaagccctgggcccagaggtggcttccctttgttttgcttctcactagcagtgaagcccacctcagtgtggcagagcccgtgttttccctgcttaccagcggctacacgtgcagatcttctccctcctgggatccactagtctgtctacctgtttcccggggtcttgagaagagagtaatgcatacttggagtgaaataagcaagatgaaaaaagagatgtgtttctggggtagggagggatgtcatttatgccatgtctagttatagaaatttctatatttttgggtgggaatccagaaaggtaaaaacaggcattttgcccaaagaggtaaaatttaggcattggtcttatcatggatgacagcgttttatttttattttgagacagagtctcgctctgtcactcaggctggagtgaagtggcaccatctcagctcactgcaacctccgcttcctgggttcgagcgattctcctgcctcagcctcctgagtagctgggactacaggcacccaccaccacacctggctaatttttgtatttttagtagagacagggtttccaacatgttggccaggctggtctggaactcctagcctcaagtgatccacgcacctcggcctcccaaagtgctgggattataggtgtgagccactgtgccaggctgatgacagtgtttaaaattgttcactgacatagtgtccacatcagagaacctcacgaagaggagcctttggagggtgttttatggtctctgcgattagaacacattaagccttagcggtggaactggcttccagaacctgagttgcccttgagtcagtggaaggaatgatgaattccagaaatccatatttccattctgctggctaaacatctgagggacagtctctgacacataggggtgttagtatgtggatgaaatcctcactgtttctggttgtggattatatctcgaagctggggtagttttcttcccttttcaatatacaaccgactgtaccttggctggcctggggtcctatctaccaagggcctgtaaagtaagcctgaatttcttgatggaatcaggagatgggaaggcatgtcagaattgtgttttatgcctttttttttttaaatatgccttcttagtgtggtgaaaaacagcattagacttggagtcagaaggcctgcttctaccacttactgtgttatctttatttaaacaagtcacttagaaactgaaagttttcattttttgaacctataaatgggattaataattgtctacacatagagttgatcattcaaatgacagaaaacatttatgaaagcacttgattgattatggtgtcctccacaagtgtaaggctttatttgtcattttgggtgtgtgtcttagaaacctgctctacgaactgtcagaaggcattgactcagagaacttaaaggacatgatcttccttctgaaagactcgcttcccaaaactgaaatggtgagtgggtcatacagaatgggtctgtgtgagcactgtcttaatcaatgattagaaagatgctggaaagggtttttagggagatttattttttatgggagacagtatcatacaatggttacgaacattggctttggtgctggatgagcctagattctggtcctgattctaattctaaacccatgctgtgaggccaatgattgaacttttctgagtctctattttcttagacgtaaaattgtgggcaatcgtatgacttccttctaggattgttgggagaattagctggaataatgttcatgaagcattagcatgaggccaatatttggtatagcattcagtaaatgctcacttctgttggaatctgttgtgttttgtttttgtttttgtttttttttgagacgaagtcttgccttgttgcccaggctggagtgcagtggcatgatctcagctcactgcaacctccacctcctgggttcaagccattctcctacctcagcctccctagtagctgggattacaggcatgcaccaccatgcccagctaatttttgtatttttagtacagacagggtttcaccctgttgggcaggctggtctagaactcctgacttcaagtgatctgcctgccttggcctcccaaagtgttgggattacaggtgtgagtcaccgcacctggccttgtccagttttttctttcaagtgccttttaatctgtaggttagatttcctccctgcccccaaatctctttctttttcttaaaatgtatctgttgaagaatctctgggcggttggcctgtggagtttctcacaggctgagttttgctgattgcacactcgtggtgcagtttggcatgttcctctgtcctctgcatttcctgcagactggcagctgaatccagaggcttcatcagactcaggtcagatccgtttggcaagactataggtagtcttgttttttcatcaggaggtacctgattttctctctctttttctttgatattagcaactgttgatgttcaaccattttatatattgaattttgaggggttgcaaaaatggagatattagaatttttttttttttttgagatggagtctcactcttgtcacccaggctgaagtgcaatggcacaatttcagctcactacaacctctgcctcctgggttcaagcgattctcctgcctcagcctcctgagtagctgggattacagcagcctgccactacgcctggctaactttttgtatttttagtagagatagggtttcaccatattggctaggctggtctggaactcctgactttaggtgatccacccgtctcggcctcccaaagtgctgagattacaagtgtgagccaccatacccggccacatattagaattgtatcatttcgttttcccttcatccattatttggttacccagtgatacagcttatatgtgaatccttgattcttttctttcagttattttttttttttttttgagacggtgtctcacttggtcatccaggctggagttcagtggtgtgatcttggctcactgcaacctctgcctcccaggttcaggtgattctcctgcctcagcctcctgaatatctgggattacaagcaggcaccaccatgcctgtctaatttttgtatttttagtagagacagggtttcatttggccaggttggtctcaaattcttgacctcaagtgatctacctgcctcagcctcccaaagttctggggattacaggcatgaaccactgtgctttgcctagttatccagtttttaagttaattggtatcttatcattctctgaaggtgacccattacaaaatatatataaatttaaactcatggatttaaacatatgtgaggtatttcaatctactgcaattattatccttactgaagttcaaactgaggctgggcatggtggctcatgcctgtaatcccagcactttgggagtctgaggtggacaggtcacttgagcctcaggagtttgagactagactgggcaacatgacaaaacccggtctctacaaaaaatacaaaaattagctgggtgtggtggcgtgcacctgtagtcccagctcctcaggaggctgacatgggaggatcgctcgagcccagagaagtcaaggctgcagtgagcaatggctgtgccattgcactccagcctgggtaacagagtgagaccctgtctcaaaaaaatagttcaattgtcccattttttcccaggggatacatcttcagtttggttcctaagtcattttgacatgaccttagtagtctttgatggcttctttactatctggcaaaaatatcccaggttcatcttgtatattttctacccagtcctggaatctctcatttctcccaaaaatcctgacttcttttaatgagagatgtcatttcaagaccacaaactcgatgctggcatgctcattgcttttgagtaaatatatatgcacacactacgtatatacacatatgtatacacacacacacacacatgcacacacacacatgacctaaaggttcagtaattcttggagaattttaaaaatcaggcgattttgttttagggaattcttttttataaaacattgtaaggatcttctgcttttgccgtaaaatttcagtgcccacatttgcagtggtacaaagcaattacctgctcaaatggtagcattataccttaaatacagaatttctcaaagtcagaggagattcctgtagtttgacaagcgctccaggtggttttcataacattctctcccaagttggggcatccgctcacaaattttccagtgtctaggtttatacataaaatgagaccactttttattgttataccccgtcctatgttagggactctctgaacaatatgaggtggcgggtgagggacgagagaaaggtcatttgttaaagcaatctctgatattcgaaacactgagtgttagttttcaaacaagaaaagctggaaaatgtttttttttctcttttgcttgcacaggttctagaactctacttgaaggcatctgtggctacagaattattattattattattattattatttttagacagagtttcactcttgttgcccagtctggagtgcaatggtgccatctcggctcactgcaacctctgcctcctgggttcaagtgatcctcctgcctcagcctcctgagtagctgggattacaggcgcccaccaccacacccagctaatttttgtatttttagtagaggtggggtttcaccatgttggccaggctggtcttgaactcctgacctcaggtgatccacctgcctcagcctcccaaagtgttgggattacaggtatgagccactgtgcctgcccagaattatttttatggtcagaagcattccaaacatttcccccctactaaaatagcttttaaatgatcaaatgcacatgttcatgtggccaaatgatcttgtttttctcagtataacagtaaaaggaaacgtaactgtgcttagctgtggcatggaattgtgatattaccaggtcaaattcaggaaaaccatatttcctctttggattccaaatgatctcagcttttttttgttgggggcggggtggggagatctcattttttgtgtcagaattgtggctgagttacacacctcagataatccaggttgatctgtattggattttgcaatcagaccagcctttggaagtgtgtaaaggacagtctctaagcaacacagatgtttccacaccagggctcagtgaggctgcattatctgcaactgcaattgcaaaagaccttatcacagaaataaattacttacccaccattggaaaagggcctgaacacccctcagccaaaacggaaaggttctaaattcttacagtctctctggggaaacacaaataaccttgcctttgaggggcattctgggctttgtctttgatagctttcatagaaatgtaagcagtatagctggcctacacatatcctgagagatctcacaactgtcaggaaatccgttctcagcacagcaatcagcatacaacattgagtctaaaggaaaccacacctgaacttactctttaacaaaaaagcaaaaaaagaactttcagatgtttgctgctagtatttgccagagtggtgttaaactaatgtccaggtcccatttaagtatgtgcgtgtgtatgtgtgtgatgtactaaacatctaataaacttttagaaagtataatgaatttccgtaattgcttctggaatcacatcttagccctttattcctcctggtaggatgctgtcaagacatgagtttctggcctggcagggtggctcatgcctgtaatcccagcactttgggaggccaaggcaagcagatcacctgaggtcaggagtttgagaccagcctggccaacatggtgaaacccatctctgttaaaaatacaaaaattagctggatgtggtggcatgagcctgtaatcccagctactcaggaggctgaggcaggagaatggcttgaatggaggtggaggttgctttgagctgagattgcactactgcactctagcctgggagacagagtgagagactccatctcaaaataataataataataataataataataatagctgaattgtgattttttgtttcagaaaattctttttcttttaaaatatcaaatataaaattctttcgaaacattttcccctcatttctttggtgtccctcttttgctggcttcctaagcagtatcatttaaagctgtgacttagagttcagtggttaataacatagactttggcatcagattgtaccagctctgccattaattagctttgtgaccttcggcaagttactggaatttctttgtgcctcaattatttcatctttaaaatgtggattataataatatctacttattcagttgttgtgctgttaatatacagcaagcactgtccctgttgcatagagttatatatatatttggtatctggtattaatatagattgtatacagatttgcttggtaatgcctcttcccctacattcctgagcaacttgagggcagatgctgttatatcttatttatcagtgcaaaacctagtgcctactggccatgcagataacatttgagtgagtggataatcaataggcaagtaaatgtaactctattgattctcttgtagacctccctaagtttcctggcatttctagagaaacaaggtaaaatagatgaagataatctgacatgcctggaggacctctgcaaaacagttgtacctaaacttttgagaaacatagagaaatacaaaagagagaaaggtaagtagcttgtgattgctaacttggaccagaccatggaaattcttaaaccaattggccatgcatgatgttttgattatttgttttgttttgttttgttttgaggcagagtctcactcactctgtcacccaggctggagtgcagtggtgtgatcttggctcactgaaacctccgcctcccgggttcaagtgattcttctgcctcaacctcccgagtagctgggattacaggagcctgccaccacgcctggctaatttttgtatttttagtagcgacagggtttcactatgttggccaggctggtctcgaactcctgacctcaagtgatccacccacctcggcctttcaaaatgctgggattataggtgtaagccaccatgcctggcccgtgcatgatgtttactcatcattctgataatattctgctaggaaagccagaaatcttccccttcgttcattcaacacatattggttgagttcatattttgtaccaggcactgttttagaagttgaggatatagcaaagtacagagcaaagctcctgccctcttgcaacttatattccagtgcagggaagtagttttagacaaacgtctttttctgattctaatatgggagtgagagtatagggaattattttaaatgaaataacatgaaaaagaaggcaggatagcatggggtaagagtggactctatagagtcggattgccaggactccacttactagtggtgcagtggtacttttttggcttttctatgtgtcactttccctatctgtaaagtgggcataataattgtacctacctcctaggtttttgtgaggattgaatgagataatttctgtaaaatgcatgtctggcatggagtaagccttctatacatgtggctattatggctctctcagagagaaaagtcataaagacttcacattctcagaaactactatcaaaaaagaactttattttcttgtgtgtgtgtgtgtgtgtgtgtgtgtgtgtgtgttttaagtctgtctgataaaggtagttctgctgtgatattttatacagatagaagcacagggcaaaagtcaaacctggctgccttaccacgtgtcagtacgctaaatatctgtgtttttctgagttcatttctccactgttaagcaagcgctatacataaaaactcatgagtgtattcatgaaacttttatgccacacccttaatttagttcagtgagtgactctagtgtgcaaatttcttggttgaaaatgaaactagctaagaggaaatgtctgtctaagaatttggttaacacagaatgagttgaggagcaaaatatactgttgtcaaactgataaaatctcaaacaataaaatgatgaataaatgcataatttaagttatgaagaataaaaacagttctttctatcatcaaattatcaaatgagaaataaaaagcagaaggttgatatggaaagaatatttgaaatcctcacatgagctctgagtttttttctaaacacattgtcatttttctgtaatgccatatcccatataaagtaaacatagggcaagtggtcatattattctggatatttaaattctaaagaagacacactagtttctatgtagttgattacatttgcctcagtgagtcttgaagactgagctttgttttttttatttttattttttgagatggagtctcgctctgttgcccaggctgcagtgcagtagtgtgatcttggctcactgcaagatctgcctcccaggttcacaccattcttccgcctcagcctcccaagtagctgggactacaagcgcctgccaccacgctcagctaatttttgtatttttagtagagatgggatttcaccatgttagccaggatggtctcgatcacctgacctcatgatcagcctgcctcggcctcccaaagtgctgggattacaggtgtgagccaccgcgcccggcttgagctttgttatttttatttttatttttatttgagctggagtcttgctctgtcgcccaggctggagtgcagtggcatgatcttggctcactgaaacctccacctcccaagttcaagcgattcttctgcctcagcctcctgagtagctgggattacagatgcccgccaccatgcccagctaatttttgtatttttagtagagatggggtttcaccactttggccaggctggtctcaaactcttgacctcaagtgatctgtgtggggattacaggcgtgagccactgcgcctggtccaggactgagctttatatcagcagagttctagttttgatttttcttttctacaacctacctgtgtgtgatctcttttgggtgtcaatcattattgatattttaatattgactttctttagttctaagagtttgagcctaattctgctgttaagatgaaagactaaaggactaaagagtaggtgtgcagactttagacttttctgtaagtgtgtgtgatccaaagtccaagctaggatactggctttatttaaggaccacctggctaactttctaagttgtcttgagccttggtgtttgcttcagtattttttttttcttttttttgagacggactcctactctgtccccaggctgcagtgcagtggggcaatcttggctcactgcaacctccgcctcctgggttcaagcaattctcctgctgctagtcagaaggtgatttttatttttctgtctgtgattttattttcagctatccagatagtgacacctcctgtagacaaggaagccgagtcgtatcaaggagaggaagaactagtttcccaaacagatgttaagacattcttggaagccttaccggtaggttcagtggtgtgctggtcaatgcttaacaaccggctccaccctccaacctcccctccctgccaccccaaaaaagaaaaagagagagaggccccggtttgtaccatttattgtaaatggtctcaccatggtgattgcaagtaaacaacatgatatcaaccagagtgcacattttctgaaaatttaacagttggctgacactagctgactagtgagagctagttagtttgagttctcgctagttagtttgagctgactccccacacccctgagttgctctgaaatggttcctctgttcttatctgtgggatgcaattagagccagctttagggacatataatctatggagcacagggcgtctgatagtaattccacagttcaagtacagagcttttgtttaatgctctgctgttactgctttgaaattcttaatgtattgaacaagaggtttgccaagcatgtagctggccaacccagagggcaagggtttctggtttctgtggtgctcagctctgaaaggatgggtggaaggggaaacgttgggagaatttgcagtctgttcctcaccatgtgatcatgatccttgggagatatgtgacagtcttccctgggatttgtggttcttccagcagacttgggtaatttctttgccaacatctgtcagcatcaatgaagttagcttggtctgggaaatgttttgtttttgttttcaactgtgataaaatacacataacaaaatttaccatcttaatcaattttaagtatacagttcagtaatgttaaataccttcacattgttgtgcagacattaccaccatccatctccagaactttttcatcttcttttagtaaaactttgtacccattaaacaataacttctcattttctccttccctccaacccctggaaaccaccattctactttctctctctataaatttgacttttcagggtacctcatataagtagaaccatacaatatttgttcgtttgtgactagcttatttcacttagtgtaaagtcttcagggttcatccaagttgtagcatatctcagaatttccttcctttttaaaggctgaataatattccactgtgtgtatatacagtaagtcctcacttaaaaggttgatagatttttggaaactgaatttaagtgacagcatactgtataatgtatttatttttatttaaaatttttttttatagagataaggttttgctatgttgcccaggctggtctcaaattcttgggctcaagcaatcctcccgccttatcctcccaaagtgctgagattacagccatgtaccaccacgcccagccacataccatataatgaaaccaattttaccataggctcattgatataaacaagagttggccaggcatggtggcccacacctccaatcccagcactttgagaggccaaggcaggcggcttacttgaggccaggagttcgagaccagcctggccaacatagcgaaaccccatctctactaaaaataccaaaattagctgggcgtggtggtgcatgcctataatcccagctactcgggaggctgaggcacaagaatagcttgaacctgggaggtggaggttgcagtgagctgagattgcatcactgcactccagcttgggcaacagagtgagaccctgtctcaaaaaacgataacaaaaagccctaagagttaagtttctatagcatacagttcgttgtttcacttaaaggcggagttaccaagaacctactgatgactctgagtgaggactcactgtattacattttgttgtccactcatccattgatggactcttgggctgctgccaccttttgactatttttaataacgctgctgtgaatgttggtgtaaaaatatctctttgaaatgctgctttcaattcttttgggtttgtatccataagtggaaatggtggattatatagtcattctattttcaattttttgaggaaccttcattctattttccacagtgactataccattttacatttccaccagctgtgcacacatcctcagcaacacttcctcaccaagacgtattattctctttcatttttgatagtaggcatcctaatggaagtgaggtcctatttccctgtggttttgatttgctttccttaatgactagggctgtcgagcatcttctcatgtgcttttggcgatttgtatatcttctttagagaaatgtctgtccaagtcctttgttcattttctaattcggttgtttgtagaagttttatttttaattcttttttttttttttttgagacggagtctcactctgtcgcccaggctggagtgcagtggcagggtcatggctcactgcaacctctaactcccaggttcaagcgattctcctgcctcagcctcccaagtagctgggattacaggcgcgcatcaacacacctggctaatttttgtattttttaatagagacagggtttcactatgttggccaggctgatctcgaactcctgacctcaagtgatctgcctaccttggcctcccaaagtgctgggattataggtgtgagccaccgtacccggcctttattttttaattctttttttttttttttttttgagactgagtcttgctctgtctcccaggctggagtgcagtggctcaatctcagctcactgcaagctccgcctcccgtgttcacaccattctcctgcctcatccttccaagtagctgggaccacaggcgcccgccaccacgcctggctaattttttgtatttttagtagagacggggtttcaccgtgttagccaggatggtctcaatctcctgacctcgtgatccacccgcctcagcctcccaaagtgctgggattacaggcgtgagccaccgcgcccggcctatattttattcttaaaaattcttttatggcttctttactattgtcatggtctgatatttttacagttacaatttttagatttaaaaataatttcaattttatagaaaagttgcaagaatgtgaataatataaagaatacctatgtactgttttcctagatttacctacctgttgttgatgttttaccccatttgctttattatttttgtgcatttactcacacttgctctctttctccctttctctccacacacacataatttttttctgaactttttgagagtaagttgcatacatcatggccttttactcctaaatattttcgtgtgtatttcctaataataaggatattcttttacagaactataacacaattatcaatgccagtaaagttatgttaatataatacttttatcaaatcaatggtccatattccaattttgtctgttgaacccaataatgtccttgacagtttttaaaccatctagtacaaaattccacataggatcctatataaatgcaacacaaggctgggtatgttggctcacacctgtaatcccagcactttgggaggccgaggtgggaggaccacttgaggccaggagttcaaggtgagcctgggcaacatagtgagaccctctctaaaagaaaataataaaaattaaaaatacaatataatacaatacaatattgtatttagttgtcatgatcctttagtctcctttaatctttttttttttttttttttttttgaaactgagtctcaccctgtcacccaggctgaagtacagtggcatgatctcggctcactataacctccacctcccaggttaaagcaattcttgtgcctcagcctcccaagtatctgagattacaggcatgcaccaccacattcggctaatttttgtatttttagtagagatggcatttcaccatgttggccaggctggtctcgtactcctgacctaagttatctgcctgccccagcctcccaaagtgctgggattacaggcgtgagccaccatgcttggcatagtctcctttaatcttgaacatttccacaacttttatgacatttaatttcctcttttatgccattgagacttttgaagaatgcagtcactcctcccacctttcattaaatagaattttccttatctttggtacatgtggtatttcctcataattagattcaagctgtacgttctggccagaatatcacagaagtgatgtgtctttctcagggcatcccatctggaaatacgtcatgtccatctgcccccctattcgtgatgctaattttgattatttggtcaagatattttctgatattatcactctgcagttaattttatatagttactattttttccccacgcaattaataagcaagtgctggagagacattttaagattctgtaaatatcctgctgcacatgaaaagtttccccctagattgagcgtctgctgatgattcttgtgtgatccagcatttactatgttggttgtaaaacaatgcttttctgactccagtattctctccacattcgtaagttggctctcagcattctactgtaaagaaggaccctcctttctccccaggaaggtgtttttgtttttttaaatgaaggagaccgtggaaactcgccagatgacctgtagctcctggagcttggcaaaggctgggcaaacgcccacctgaagactatgcaggcaatcaggacatgacacagagccgggagaggcctgctcttcggctctgccctgaacctcattcggcaggtggaggtatttaggcatttgagggaatctcagctttgggaggccactttgtaagtgatcttaagagattaagtacatccttaattaaaagaaatggtaacacctccgcctgcttgctgtgagtttattcatttgaattccccatctcccccaatgggaaataacacagaattgcaattatttataaaatcttaaattggcttcttttctctaggaaaatagcccttgattcaattaattccaatcctagaaaagcgcctagatatctgattgaggtattgagggagagaggctgctccccttgattcttttactataatccaattaaagcaacatttatgggccaactccctggccatgggcacagctttgtttagagagttgcaaatccattcccacctccccgctcccccagaagctctttattattttattttatttatttatttttttgagatggagtctcgctctgtcacccaggctggagtgcaatctcagctcaatgcaacctcagcctcccgggttcaaatgattctcatgcctcagcttccctagtagctgggattacaggcacccgccaccatgcctggctaattttttttgtatttttagtagatacaggatttcaccatgttgacttaaggtgatccaccctcctgagtctcccaaagtgctgggattacaggcatgagctattgtgcatggccatcccagaagctctttaaaatgtggttttccagcactgacattttaggattccctaattctaagttaaattgtctgctaaatgtaactcttcccacccactttttcaacttgttttgtgctcagatactgacatgcatgtagaaacacacacacacacacacacacgattctgctcgttgtctttgagaaattcagtggtttctaaaggggcatggctcagctgtggcctctgaagcgctgtggttccgctgacgtgggatgataacttggccacggcacatgcagtagggggatagtcgtggcagtactagaagtgcaaaggggactggggcacagcatctcacgtgttttcacagacttttaaggttggaaggtgtcttaaaagttatctgggcagccctttccctctccatcaaatgatgaataaaataaaacttggtgaaacatctcatgtttcttaagcacctgaggattttttttttaaatttaaaagaacactgccaataattgggctcaatgagaaggaactctcatcgaattttaagcaacatctcctaatatgtttaaaaattaaatttatttttttctcagccccctgcaacttcagcctcccaggttcaagtgattttcctgcctcagcctcctgagtagctgggattacaggcacgtgccaccgcacccagcaaattttttgtatttttagtagagatggggtttcgccatgttggccaggctggtctcgaactcctgacctcaggtgatccacctgcttcagctcccaaagtgctgggattacaggcgtgagccaccgtacccggccaaatcgatttttttgagtgtggcataaggttttcttaaggagaggcatgtctctctatggaggagacctaacacctgcttctttataaggccttattggacccctcttgaaaactatcaaaagaagttgaaagatgattcagtgtggccaggctgtgggacattcactcattcattcattcattcctctctgacatagagacttgagaggtgtcaacagaggatgcaacattctcgggagaagaaaggcagattagaccttaaagcttttttctagtccctgttctggctgactttatcagccaagggaagaacaaatcaaggaaagccagggcctggaggggctgggcagagcctgctgctgtgtctgcattgcccctaatcccagaagactcactcaactgctggacaaaaccagaaggcagtctggccaggcccttgtctgcctcttagaagaaatctaggattctacaggaagggaacagtggcttatgaaaagaaaggcaggaagccttttggaaagtgaagctaagcctcctttgcatttgttcctgcagagctgggggaacagctcttccccaacaccttggtcaggtccccttgggggctttctgctgaaggctgacggctgagagtcatagggggaagggggtgatggtgaatggggaggagggtacagaaaagacagggtcttagactttgttttaattttgtatttaattatataaaacattaatgtatgcccaaggtagtgcatccttgcctctcctccccacctcgattgccatttttatttgttttttgatttatcttattacttttgaaaaaaatccaacgtatatcttccctttattacaaaagaggtagtgcactcaaataccatttcattttgctttctccatatgacagcatcccctggagaagggtatagaggctgtccttggcatcttactccactatgtggacataccacagctttttcaatcacttcctattggtggacattaggctatttccagtccttagtgtaaataatgctgcaatgagtaagtacccttgagcatatgtcacactgtatttttgccagtgcgtctttgtgaaccttctcctttggatggagagagttggttctcttcccatttcctgccaatgaactttcttttttttttttttttgagacagagtcttgctctgtcacccaggctggagtgcagttgcgcaatctcggcccactgcaacctctgcctcccaggttcaagtgattctcctgcctcagcctcctgagtagctgggattactggcatgcgctaccacacccggctaatttttttatttttagtagaggtggggtttcaccatgttagtcaggctggtctcgaactcctgacctcaggtgatccacctgccttggcctcccaaagtgctgggattacaggcatgagccaccgcaaccggcccaatgaccttttctgtggctgtggattagatatctgtccttccctgcatcaagtctagtttttgttcctcatcctaactgtgtgaaattcctatgtttcatgccctcctttcttttttctcagcaggagtcctggcaaaataagcatgcaggtagtaatggtaggtatttctaatgtactttttacaacttagatcggtatggtagggatagacatatttgatatataccaaggaattcaaggtgacttggaagagaagctttataaataatgaataattcattttttattccaattcaaggcaagacattgaatgcatggattgtactaggcttttctatggcagtatggagagggctgggtggtttctgctctgaatgcctagtatagcagattctagggactgcaggcggctgttcttcctccacccttcagaattaggccaccctctgtgcagcagaaacagcccccgcagggctgaagccttcaggccagtagtgacagcagaatgtgcagtctgggtgcgtgtcctctatggagtggttccagatgttgcttcagagggagagaagaagcaagaggagggacttgaggatggtgtgtttagttccctgaatccctgcccagaaaccataaccttaggaaaatattccagaatctgccatcaggttaaactgcttatgaacaaacaggctttggcgaagtctttctgtggtatgtaaagtttgtcacagaccattcctcatttttttttctggaaaattatccttcagagtccaagacacacagctttgctagcaatttgtctttttgcctaacacggaggttgtgtgctatgatgttggtgacattgaccaggtcaccattattaagcacttgtcacatactaggcactgttcagagagatttcagggattatatcatttattcctccattcactggaggtaggtaatactgttattctcactaatgatgaggaaactgagacccatgaaatctagtgctttgcactgcagctaaaaggcaccgcagctaaaaagaagtgaagctgggatttgaacccagctgtctgattccagagcttactctcctaaggccaggctatcccagtgtctatttatgtgagctcaggtgactgcttcacccctctgaagaataaagcagtttctttcagctttacaattctgcggttccaacatttagacgtgacttcccgtggagcattaccttctctcatggtgaggaggaatttataggtgctctgagccactgaagcgtggatcccttttgctgtattttctggtctggggaatatggacttgctcagcctgaggactgacccttagcagtagttaataactaactcatgccccagagacaaggacagagtttggtgggttctactacaaacttcctgtgagtggaaaaagaaaactgtttgatgttacattttcctgttagtgccatgtgacaaataatgcattgctgactttctctctgtgatagagtcttttccagaggaatcagggagttggcaggaacacttcaaagcagtgtgatcctcagtcgatgcccaactggaactttctttttcccctcttttttcttttcttttcttttcttttttttttttttgagacagggcctcactctgttgcctaggctggagtgcagtggtgtaatcacagctcactgcagccttgacccctcggactcaggtgatcctcccacctcaacgtcccaggaagctgggactacaggcaatgtgtcaccatgcccagctaattttttgtattttttttttctagagatggggtctcactaagttgtccaggctggtcttgaactcctgggctcaagcgatcagcccgtcttggcctcccaaagtgctgggattacaggcatgagccaccacgcccagcctccctctttttccttctctagggaagaggtccacctagcctctttatatccagtgacataaatgctgactcaatccaaccatacttgagctggaagccttgagctgatccatgggatcttaattaattccccacccaatccctgccagcagcatagtttccaacccagacaaagcaaaaaagaatgcgaagacacatcagtctctcccatcaggaagggcatggtggctgaatttgtctcaggagggccttgagagaagcataattctccagaattagatgcgaaaattatcagtgaagaaatctaagtgcttggggaagatatttggagtctgagtacctctctttctaggtaacagagccacaaatggtgcaccaagcctggtctccagggggatgcaaggagcatctgctaacactctaaactctgaaaccagcacaaaggtctggatggtttcttttattccttttttaataaaaaaattttttttccaaatttaatcaaaaggacggtttctttaggggctctctccctagggtccagccttcgatgattttaagggctccgagctgtttgtttcagacttgtttctccctctctctgtaattatctctgttcttcccacctttttctgtatcaatcagaagtgactgatccctttgactgtggaggaaatgctgttacactttgagtcatgcataccctttgggttatttctggagaggggtagtttcttttcttatccattgaagccacttgttttctgcttggataaagatgtaccacgatttcaaggatgattttagctgcccagaggctctgctaaagccagctcagctaatttgcaatcacatgctgtttacaatagccttaaaaaataattgcacatgtttttaaattcctactgtgaatatatatatatattgaattttaaaaattgaatatacagccatctttatatacatatgaatatatatcagccatctttatatatatatgaatatatatgtgtatatatatactttatttataagtatactttatatatatatacttatatattaagtgtatatatatatatacacacactcatatatatattcacatatatataaagatggcggtctcactgtgttgcccaggcttgtcctgaactctcaggctcaaggaattctcctgcctcagccacccaagtaccaccatgccagcttgtatattatttttatattcagaaataaaattacaaaagatttcccttttttgaaggcattagatcactccagaaatgaaccatctgaaaaaaatctttgatatttatgttgtctcatgaaatccttgtgtatgctttcttcattcatgttgctaatatgaaagtgaagatgcttttgcataaaccctgggtttgacaatattaaaatatatattccattttcttaactgtcatgattgagcttctccagccaaaccaggtgaagtctgaattttaatcaggatctggcatttcaccttggaattaattagctaattccacactagggccaggatcttgagaactctctgcctctgatactgggagtggcatcctgaaagaaaggaactgtctaatctttagtgcaaatgagatttatcctttgtcctgggctctaggacttaaaaaagaatctttgaaattttattcagatcacaattgtgcagtaaaagtgagttgcagagtagtcagaatccccagtttttcaatatgtgacttcagaaataatgtggcataaataccccaaggggtttagactagagtataaaaacatggttttggacaggcatggtggctcatgcctgtaatcctagcactttgggaggctgaggtgggcgaatcacttgaggtcaggagttcaagaccagcctggccaacatggtgaaactctacctcaaccaaaaatacaaaaattatcggctgggcgcggtggctcatgcctgtaatcccagcactttgggaggacgaggtgggcggatcacaaggtcaagagatcaagaccatcctggccaacatagtgaaaccccgtctctactaaaaatacaaaaattacctgggcatggtggcgggcgcctgtagtcccagctactcgggaggctgaggcagaagactcgcttgaacccaggaggtggaggttgcagtgagctgagatcacgccattgcactccagcctgggtgacagagcgagatgctgtctcaaaaaaaaaaaaaaattatctgggggtgttggtgggcacctgaggcaggtggatcccttgaatccgggaggcagaggttgcagtgagccgagatcgcgtcactcactccagcctgggcaacaagagtgagactccatctcaaaacaacaacaacagcaacaacaaaataacaacaacaacaaaaacatggtttaaacaactggcatggggagatacatcctgctcttcctcacagtggatccattggagtggttggttagaaacatttaaggccctaagataaggattcctactaagtggctctatctattcttcaagagggcagctgtgtacaggatgaatcggaaccacagaggcctctgtgtcattgtcaacaaccacagctttacctccctgaaggacagacaaggaacccataaagatgctggtaagaaagtctggaacagtttatcaaatgcaaattggggatcttaaaattattttttattttcacattttctttctgtgacttttatcttccatatacgtgtaaggatgatatcatgtttctgagcctcttatatatccctggggagtcatcagtctgctaaagagtggcaagaatctttgactattcacaattctgaatagaggagagcatgtactgggggagagcctgctggattggcacgagacaacttgggcgtgagctccagctccaccactaactaggtgtgtgatcatgggagagtcaagagaccttggcttcttcaactgtgaaacaggatgaaacactggccactgccgattctcaggactgttgtgacaacactgggtattacgtgataggagattcattgtaagattttatggttatgaaaataaaaataatccaaagctttaggctatttgctgtgcaaattttgtaactattagcattgtttcagttttttttttctttgagacagagtcttgctctgttgcccaggctggagtgcagtggtgcagtcccagctcactgcaacctctgcctcccaggctcaagccattctcgtgcctcagcctcccgagtagcagggattacaggcgtgagccaccacacctggctattttttgtattttcagtagagatggggttttgccatctggccagactgttctcaaactcctgacctcaagtgatccgcctgcttcggccttccaaagtgctgagattataggtgtgagccactgtgcccggccttgtttcagttcttcattttgttttgcatcattttattatttcccctttctctctctctctctcttttttttttttttttgtttttaaacagagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaaggtgagagctcttttttttcttccatttgtaattaattagttttatttattttttattttactctcattcaacacctttggtaagggtgagagttctacgttgttctatccatgtacctgttcaaccatctgcctaccctcctgtttatctatttatccatctatccacccattcatctatccatccatctatccacccattcatctatccatccatccatctgtccatccatccatccatccagcaaccttgtattgagtaccagcctggacctggaaaggaagatacagagttaaaaaaagacagagtccttgccctcaggttgcttacaagctagagggatagacaaacaaatagacggggaagggcatccccagctggtaagtgcacattgtgaagtataggtgttatgggaacatgcagaatgagtaccttgcccagatttgaaggatcagaggaggcttctagaaatgacaaatagatgttaggtaaagaatcaggtgaaagatgtgctgggcagagggaatagcatgaacaaaagcatgggggccttttatttgttcgtttatttatcactcactcttacgtcctgagcacctatgtgctatctttggacttctatttgccactgctctgacagcttcccttctgtctctgccacatgctgtcctcttggcacctttagccatacctagaggccatgggctcctccatgaaaacgtctccaaagttgccatctctggcccactcatctctgaattcctgggggcagagaccctgtttcattcaactttatatcctcagcccctgacctgatatattgtgagcttgttaaacatttgctgggccaatgaatgacttgcttgagcctgtctcattaacatcccgctagatatcctacctctgtttagcccttggacctcacattcagcatgcatgtttctgagctcatcttcccagctctctccaggagctcctactcctgaatttccatttgaaggaatggccatagtgctcttctgggaattcaggattggaaccttgagtcaactttgcttttctctcttctttaccagcccctccattctcatcacagacatcagaggctaatgtctatggcttcaggaacaaggcaatatttattgagagcgtactatgtgcttactgtactgggtaccgaactggggacagggggtgcaactgtgtacaagagagacaaaatctgctctccagggagctaaaagtccagtgaaggaaggacagataataaaaatataagtgaatatttaaattattattattttaaaaattcaacaatattaaaaggagacagtatacatgcatgattaagcaatgtgtggttttttttggtactccagaaatttctgttatttttaattgatacttcataactacatatttcagggttataatttgatgtttcaatacatatatgtgttgtataatgatcaaatcagggtagttagtgtatccatcacctcatgcatttatcatttctttgtggtgagaacctctaaaagcctctcttgtagctattttgtaatatacaacaccttactgattgatcgattgatttaaatatgggatctcaccatgttgccgaggctggccttgaactcctaggctcaagcaatcttcctgccttagccttgtaagtagctaggattatatgctcaaaccacagtgcccagctcagaatgccttactgttaaccatagtcaccccactgtgcagcagaacaccagaggttatttctcctatctaattgtaactttgtacccattgactaacctctcatcttcccttccctccttctctctctcatctttgtaattgctgttctaatcactgcttctatgacatcaactttttaaacaaagattccacatgagtgagaacaagcagattttttctgtgtcttgcttatttcactctgggctcattcatgttgtcagacatgtcaggattttctttttttatggctgaatggtattctgtcacgtataaatatcacattttctttatccatatatccatttttggacccttaggttgattccatatcttggctattgtaaataatgctgcagtaaactgggagtgcagatatctctctgacatattgattgcattttctttgtttatatacttagtatggggattgctggatcatatagtatttttatttttcattttatgaggaactggcatactattttccataatggctgtactaattttcaataccaccaacagtgtgtaagtgttcccttttctccagatctttgccaatatgtgttttcttttgtttcctcgataatagccattctaacttgagtgaagtagcatctcactgtgggttttttatttttatttttatttttttttagacaacatcttgctctgtcaggctggagtgcagtggcgcaatctcagctcactgcagcctctgcctcctaggttcaagcaattcttctgcctcagtctcccgagtagctgggatcacaggcatgtgccaccacgcctggctaatttttgtatttttagtagagacagggttttaccacgttggccaggctggtctggaactcctgatctcaagtgatccacccacctcagcctcccaaagtgctggtattacaggcgtgagccacggcgcccagctgtcactgtggttttgatttgcatttccgtgatgattagtgatgttgaggggtggaagcgggtaagtaggaaaactcccaccacaactatagtgctagagtgaagtagggctgagactggggttgggccttccaaggcggaaggaagtcaggggtggaggccaagttgggctgattttcctgctgctgctaagagaaaaccaattaatggaagaaggttgggggtagggttaaggataagtatttgttgaggctctcatgtattggatgatgagaggaatcatgctatagctaaaataaagccaatgtcaccaatgcgattgtatagaattgcttggagggctgctgtgttagcatctgcttggccatgtcatcagccaattagtagaaaagatataattcctacaccctctcatctgataaagagttggaaaatgttgttggcagtaactagaattaatattgtggtgaggaaaataagtaggtatttgaaaaactgattaatgttcagatctgccttcatatatcatattgagaattctataatagatcaagtgataaatagtgctactagaataaacattatggagaattagtctagtttgaagcttaatgagagttttagggtttggattgttattcaatatcagtttgagatgatggtttcttggtctgtacacataaatgttgtgggaatgaggctaatggtgaaagtgcatgcgacagctatttttacatagtatggatatgagttctttttgtgagggttgataaaggtaataataattggtaaggttaaggagattaaggttattatagtaatggaaaaatacatgattattacttttatttggagttgcaccaatatttttggttcctaagaccaatggataactctcatcctctaaaagttgagaaaactatgttgttaggcatggaggcatgagttagcagttcttgcaaactttatcggtaaataagaagttgcggacttctattattagaccacaatctaacattttgattaaactatatttacaaggtataagtcctataataattttaggatttagagatagtaagagaattggtgaaaggtgtatgagtattagtatgttttctcgtgtaaaggaaggtttaatgctgttaatatagtatgttagtgttccttgttgtgttgtgacaagtatatagagggaataaagggctgtgattaatatattaagtcctataagcatgatggtagtgtttgatcaggagaatgaagccgttgttacaaggagttctcctactagattaatagtggggggtagggcaaggttggtgagatttgctgtaagtcatcaaaaggttactagtggaagtaatgtttgacgtcctcgagagagtaatatgattcagctgtggattcacttgtagtttgaatttgctaggcagaatagtagggacgaagtaagtccatggggaattatgaggataattgcactggtaaaacttcagggggtttgaatgaggatagccacagtaacaagtaccatgtggcttacggaggaatgtgcaataagtgactttagatcagtttgtcgtagacagatggagcttgtcataatatgcctcataaggataatatcaggaaaggataggctatatgttctgtcagagggctgaggatgagggtaagtcgcattttgtgtagccgcccaattttaggagcactgctgcaagtactattgagccagccttaggtgcttatacatgggctttgggaagtcataggtgaagtcagtataggggtatttttactatgaaggccattatacatgccaatcacatgagattgttggatcaggagattggtagttcttgatattaaatgttattattatcatgctcagtgagcctaggatattttgggcataaataagtgtaataagtagggggagggatcccactagtgtgtaaaataagagatatgtacctgcattgaggcgttctggttggttaccccatcgggtgataataattaagatagggataagtgtagcttcaaagagaatataaaatataattagttctgtggctgtaaatgctatgattagaaaaatttgtagggaaattaatatggaaatacagggttttttccataggggtgattcactggagaggtggtactggcttgctatagttataagaggtagtagtcaggctgttaagattagaaggggtgatgttagcggatcagaggagaaagttaatgagaagttgaatagattgtcgttgaattagttaaagaataatagggcaatgaagctggtgattaggctgtgggtagccatattgattcaaattgtataatttttagagagtcatgttattggtagtagtataattgtaggaatagttatttttagcattgaagtaaatttaggttatgtatgtagtctaagccatatatgttggaaattgaaagtagcaaagcaaggcctaccctggctttgcaggcagcaaatactggtagagtaatgggtattacatttgctagggtgaagtgtatatttaaagctataagggtatttactatgaataatgataatattattccttctaggcataggagggatgatattaggtgggactgatagactaatacccccagaagtgatatgataaatgctaatatgatacttatgtaaatagagggcatttggtaagtatgttctatcataatctaatgaaatcatttattttgccttaaactacttatttttttcttatacctgtggaccatttgtatgtcttcttttgagaaatgtctgttaaagtcttttgcccatttttaaatggggttatttgtttttttgctgttgagttatttaagttccttatgtattctaaatattaactccttgtgagatgtataatttgcaaatttttttcctattttgtaggttgtctcttccctcggtttttttttttttttttttttttttgccgtgcaaaagggttttaatttgatgtaaactcatttgtctatttttgcttttgttgtctgtgcttttgaagtcttgttttaaaaatccttgcccaacccaatgtcatgatatgtttgccctgttttcttgcagcagcttcatagtttcaggttttacatttaagtcttacacattttgagttggtttttgtttatggtgagaggtaagtggttagtctcatttttctgtgtatggatattcaattttcccagcaccgttttttgaagagattctcttttacctattgtgtgttctgggcacctttgtcaaaaatcagttggctgtaggtgtgtgaatttatttctgggatctatattctgttctattgatctatgtgtctgtttttataccactaccatgctgttttggtaactctagatttgtagtatattttgaagtcaggtggtgggatgcctccagttttgttctttttgctcagcattgctttcactatttggggtcttttgtggttccatatacattttagggtttttttccctatttatgtgaagaatgtaatttttttgtttgtttttgttttgttttgttttagagatggggtcttgttatgttgtccaggctagacttgaactcctgggctcaagcaatcctcccacctcagactcctgagtagctaggactacaggcatttgccactgcacttggcttgtcactggtattttgatagggactgcattaaatctgtaggtcaccttgggtagtatggtcattttaacaagattattcttctaacccatgaacacgagatatctttccatttatttgtgtcctcttcactttctttcatcaatgttttatagttttcagtgtttaatatttaagttaatgatattttaattgtttaatatttatttaataattttattattcaattattatttaatattaatttaaataatatttaaattaataagaaaaaattagccaggtgtggtggcatgcacctgtagtcctagctattagggagtctgaagtgggaggattgcttaagcccagaagtttgaggctgtagtgaactacaatcgcattaccgcattctagcctgggcaacagagcgagatcctgtctctaacaaaaagaggcaatttcaggaagtgatccctgccatgaacaaatcaaaacaggataatggtagtttcttggtggaggtaatatttcaggtgagactaaatgataagaaggaaacagacacaggaagatttgggaatagagagcaggtgcaaagcaagatgcagggattgagagcaggtaagggcctgcatcccttccctgaaaaatagtgatagttaaggatgaggggatgagagtagtcatactaatactaaaaatgatggtcagcagaacagtgtagccagtgttctaagtgcttgacccaatatacatcctttaatgctctcggcaacccctaagatggggactgttatggttcctattttagagctgggaaaaccgaggcatggagcagtgagtaaccagcctaagagcacacaatgaatgaatgatggagccacaatttaaaattgaatgtgttttcagaacctgtgcttgcttccagtgatatgtattgcctaccctgagaacgttctgctaaatgctatatgtcctgcaagcccaggctcaaatgctaccatctgcatgaagccttctctctccctcccaaccagaaatgcattctcctctgaacttgcagtggaaccttgacctttcatttggtgttgaccacattctgccttgtgttatgaatattgtgtatatgccatcctcggtaaatgtttcatatctgcattctaagtggttaacttcaggaattgtgtcatgtctatctttgtatctctcccaagactacagatagagagggcattgttggtatctgtggcatctgctgcatatttgttgatctaagacctggtacatggtacctggtgtcttttctaagacctggtgtgtggtttctacctcctgactgaaaaaagtttcttctctgggccaggcacagtggctcatgcctgtaatcccagcactttgggaggccgaggtgggtggatcacctgaggtcaggggttcgagaccagcctgggcaagcaatatggtgaaaccccatctttactaattagccaattgtggtggcaggcacctgtaatcccagctactcgggaggctgaggcatgagaatcacttgaatccaggaggtggaggctgcagtgagctgagatcacaccactgcactccagcctgggcgacagagtgagactccgtaaaaaaaaattttgttttcttctttgttgcagacatgaagacatcttatccatcctcactgctgtcaacgatgatgtgagtcgaagagtggacaaacagggaacaaagaaacagatgccccagcctgctttcacactaaggaaaaaactagtattccctgtgcccctggatgcactttcattatagcagagagtttttgttggttcttagacctcaaacgaatcattggctataacctccagcctcctgcccagcacaggaatcggtggtctccacctgtcattctagaaacaggaaacaccgtgttttctgacacagtcaattctgattttctttttcttttgcaagtctaaatgttagaaaactttcttttttttggagatagtctcattctgtcacccagactggagtgcaggggggcaatcacggctcactgtagtctcgacctcccaggctcaagctgtcctcccgcctcagcttcccaagtagctgggaccacaggtgtgtaccaccgtgcccggattttttttattctttattttttgtagagatggagggatctcactttgttgcacaggctggtttcaaactcctaggcccaagtgatcctcccacctctgtccccaaaatactgggattataggcacgagccaccacacctggccagaaaactttcattattgaagacttggattgtagccttggttttggatgtctattctgaagacagagtaattggctttggtttgtgcaggtactttttctttgagacagagtcactccgtcacctgggctggagtgcagtggtgggatcactgttcactgcagccttgacctcccaggttcaagcgatcctcccacctcagcctcccaagtagctgagactacaggtgtgtgtccatgcacagctaactttttattttttttgtggagatggggtttcactatgttgcctaagctggtctcaaactcctgggctcaagcgatcctcccacctcagcttctcaaagttctgggactacaggcatgaaatactgtgcctggcctggggaccaggtgcattttaaggttccttggtgttcaaaaaccacgttcttagcctagattgagcttagattgcctctctagacaactaccccttagttataattctgtgtcccctctgcatgcccttaaacattggacagtgaggtcacagtccacccaccctctctctgatctcccccttcctaagacttctcttttgcacatctagtgaggtgaaaatttggtctatgccaggcccatttcctgcttttgtgtaaggaaggtgctcacataggaagtttttatttggttagagacaggtttccctgtaggaagatgatggctcatttacactcagctgctctgcaagcagaaactttacaacctgatgtcatattccattttggactgggtgcggtgactcatgcctgtaatcccagtactctgggaagccaaggcaggcagatcacttgaggtcaggagttcgagaccagcctggccaatacggcaaaacctcatcattactaaaaacacaaaaattagccaggtgtggcggcgagcacctgtaatcccagctactcgggaggctgagacaggagaatctcttgaatccaggaggcagaggctgtggtgagccaagatgacacaactgcactccagcttgggcaacagggcgagaccttgtttaaaaaaaaaattcaatattggggttggaacatttcagttgccattgacagaacacccaattcaaattgactgaagcaaagaagggaatttattgcctctttcacattgaaacccaggagtggataacactggcttcaggcaaagcttgaatcaggactcaatctacaggccagcacctttctcttggccggatgtcctcagggctggcagatgcagtagactgcagtggacagtccccaccttgttactgctactacactttgctcctctggcccaaggcatgaggagagaggctgtgtcagaaactgaagctgttctcaggatcactgggctcttcttggcagaggggatgtctggcttgcctgaagggagtggctctgtaaggacgccttgatgctttcttcattaagattttgagcatttttacgtacttgagcttttttttttttttttttcaatttctagaggaactttttctctgttaattcctggaactgtattttgaatccttaaaggtgagccctcatagggagatccaaagtcctgtggttaacgccttcatttatagatgaggcagctgaggcctggggatgtgaacaacctgctcacagtcctcatttactggatttgacttcagccaggtgaactggaatgccttggggcgtggaagggcattaggagtgtttcatttgatatgtgaatgctcataaaaaaatgtcaaggaatgaagaacaacaactctcagtggtgcctgcatttataattatttatgtgaaagtcaaattcatgtacagtaaatttgttataagaatattcacaagaacactgttctgatatctctgattgtcatgtggatttgaatgtagcttgacagagggaatgtctaatctatattgacagggcaggaacaccgtcatcttagacaaacaccgccactttaagttccagttccctttctagcctcatgcatttcaaggaaatcacttcttttctaacagcgagcagccagaaagagaagagagtaaaatacagataagacagctctggcatagagggaggtgggggggtgggggaagtctcttgggtaactgccaaactttgccttcatacaatgggttccaggaaaacaatgagccttaataagcacattcctttcccttcaggtgcactaagtggggaagctaaaagcagactggaggggggtggggtgtacctacagctgcagaaatattgtatgggaacggacacacaactctccctcccagataagcacagcaaagagacatagaagcaatccaagcctctgataaactctcccaccctaaatccttaaaaactcttagtctgtaagtgagtgggctctgacctaactcggccagaagcccctttcaaatttgttttctctaaaataaacctgtccttggctgtcaagccacctttcatgtttctttcctctttctttaattcttacacatgtgtcaggatgatctcccaaaaccgtgttcataacagtcagggccaaaagctagtggtcacagtccttgtccagttggcagaactgacatgtgaaggcaagtgaaggatggtgagatactgaggaaagagcaaaggatctggagatcaaagccctgcatttccattttgtcctgattcctttgctcagagacactaactaaatcaagctagcttttttcagccttgtctgtaaagtagagaaaacattagctgttgggaagacgaaaaagaatgtgtcctatgtgtgcatctatttaaatctaactgtgctgaggtgcatataaatgcctttaggtggtagggtcttccggttgtaactgcaacagaaatagcaggacttaagttcctttgtgcgtaattccagctgactttattagcggcaactcagcactagcattacccctgacatactctgagtaagatctaattcttccctcactggttcgtgatgtctaccgcagcagaaggccagctcttgactctgagttcagttggacaaaatgctgttgataaaacctcctgtcaggcctctgagcccaagctaagccatcatatcccttgtgacctgcacatatatatccagatggcctgaagtaactgaagaatcacaaaagaagtgaaaatggcctgttcctgccttaactgatgacattaccttgtgaaattccttctcctggctcatcctggctcaaaagctcccccagtgagcaccttgtgacccccatccctgccagccagagaacaaccccctttgactgtaattttccactacttacccaaatcctataaaacggccccacccctatctcccttcactgactttcttttcggactcagcccacctgcacccaggtgattaaaaagctttattgctcacacaaagcctgtttggttgtctcttcacaaggacgcgagtgaaacctccttcatcaggagcatttggggtttgatgtttaagttttgggcctctggtgtatttcatatttctgttttgctagaacttagtgcttgtgcaaggttaaattctagaatcaggaaacgttgtttttaggggccttcagcaagcacttcggaggtccctggacgtttacagctgtgagtcgtggatctacccagacatcagaacatagtcatccttggctcattcctcctccgtaggaggggtacacagttggtagagtgtgccctccaagatttcgtgaaacattatgcttgtctgtatttgtgtgtgcatgtctgcgtgaattttgagttcaggaataacaggtgatttgatcacagctatttgacagtggtgatagtcattgtatgccaagatgtttatgaggggaataggtagattgagtgaggttcatgtatattttgcctagttgtactcacctacaagagctgtaattaaatgtttctctctttccccttcctctcttttattcattcttttttttttttttttgacaaagtctcgctctctcacccaggctagagtgtagtggtgtgatcttggcttactgcaaccttcgtctcctgggttcaagcgattctcctgcctccgcctcctgagtagctgggattacaggtgtgcaccaccatgcctggctaattttcatatttctagtagaaacagggttttgccattttggccaggctggtctcgaactcctgacctcaagtgatctgcccactttggcctcccaatggaatgaaccattgtgtctggcctcattcattctttctttcataaaagtttggatactgccaaacaaaattaaagacatgaagacatttgataaattgttattacaaatgtgacagttatttaactactggtgtttatttttattagagtcatagcacctactggcctctgcttcagggattcacaatggtgttgggcaggttggatatcatggggcttacccttagcaaggcattctattccacctatgcccaggcggtgtaaaacatataagcatctggtacgctgtggtaccgacccagtgactggtataacacaatggttaaggttgccaaatagcaacccttaatcaataatgatcaaatctccacggaggtaaactaaactagaagtttacctcatacaggtaatttttgtgccatacatgattcacagaaccttccagatctgatgctttctgagtgatctggtcaatttgttctcaacctggaattcttgggcccttaggtgtttgtaaatttgttctcagagactctgagctctccaccttcatttttaagtgctttaattctttttggtgataatctttaaaacttcacagaggtgtgtcctggctctttggggcgactgcttcatatttgagtactgccacacaatgacagctcatgttctggggcctgcctacagaaagggatgaactttatcttggaccttttaatgtagtgtggatgggcgtctgtagctggaggtcttcaggtgccagtggttaatctgtttgaagcttgcttcactccaacctctcattctgtaacagactcctcctccaccgtccctcacctctgctgaacccttctagcagagggaactcaccacaagtgggggatggatttgggagcttgaaaggaccccaatgaccctgcagtccagccctcaaagtgctaagtgacttactgaagcctcgaagccatttctggaggatttgcaattctttgtatctctggatttgctgccctgtccctccaagccacctggtttcacttttggacagctttaagtgttctcttctctgttctctgtttctgccttcttagaaactatttaaaaccactcattttcattctaaactccggagccataccaaacaactgtaactgtcctctggtgagatttgcgttgtatgtgacaaatcttttaacttttttctgttagggtttcagttttgttggaagtctgcagtttgctcttaaggatgtgataagaatgtaacaacacatttgtatctttgaattttgaataggaaccaaatttttaaatttagtttagttttgttttgtttgagacagagtctcactgtgtcacccaggctggagtacagtgatatcatcttggctaactgcagcctctgcctcctgtgctcaactgatcctcccacctgaacctcctgagtggcagctggggctacaggcaggtgttttttaaaaatggaactcttttctttttttttttttttgagacggagtcttgctatgttgcccaggctggagtgcagtggctcgatcttggctcactgcaagctctgcctcccaggttcatgccattctcctgcctcagcctcccgagtagctgggactatgggcgcccgctaccacgcccagctaattttttatatttttagtagagacagggtttcaccatgttagccaggatggtctcaatctcctgacctcgtgatccgcccgccttggccttccaaagtgctgggattacaagcgtgagccaccgtgcctggccaaaaaaaaatggaactcttaatacattagaaaaaaaatgaaatcccttttaaaaagcactagaggaaattctgtgtttaaagatttacttatttggcaatgcaaacaactgtttatttcctaacataacttttgcaaatctgaatttttatgaaaagatttttaaattaaaaattttaaattgtactaatttttactttttaagtaattttgagtaggtaatatttttataaagatatttgtatggtttgaagataagaaaattaaaggtgttcaagaagagttttgcccccagttctgtccactgtatacccagtcctccccacttctgcatacatatttcagacaggtatttcttggaagaaagaacatatgctgtgaaacttacatgtctcagtaggtctcattttaagtgattctgtaaaatgcctgggaaatactggtgaaattctagaatggaaataactttgtgagattttgagctgagtactggtaaatagtagaaatggacttactaataaataagggaattttatttgataacttttttctgattacatagtaatgtatgttcattatggaatatttgggaaatacaaaaacacaccaagaaaaaagtatatttatttataattctattttgctatgtattttcccattattcactctgtgtttgtcacagatttttccccaccctttttcaatgagtgtatcctccatgtccccccaatcatgcatccagtaaactttgtcattactaccatctgtactttcactcacgtttcaattccaagcatgtccctctctgacaaccacctcccatcattccatcttgcttcttctaggaccttcccttcaaggatcttcagtgccaccagggcttccagttaggttgactgaccctatctattgtcttcccgatgtcagcaccgcccctcactccctcttcattcagcttagagtccatgtgtctttgttaaagtctcctgtacccaccaacacccttgcctttctgtcagttccactgaggtggtagaatcccaactctggttaatcctataaatccttgtcctccaaatttgtactggaattccaggatgtggctggggtaaaaaccttccatgttgcagacaggtctcgtttcaaaccaatgaccacaaacctccaatgggctttcaggggtttcggcaatgctgtgacatttccctggttatatcacccttttgcactctcggtctgttttactaatcatcgaattctctatgatctcaacctaaaaggttagagatatttcctgagaagccccaccttttctcttgataacccactatggagctgtcatttgtgaatttaagaagaaacacttgcctcttgactattttaaaacatcaaaaacaacatttaaaaattgaaggatgaggccggggtgtggtggctcgcgcctgtaatcccagaactttgggaggccgaggcaggcggatcacctgaggtcaggagttcaagaccagcctggccaacttggtgaaacctgtctgtactaaaaaaaattagctgggcatggtggcgcacacctgtgatcctagctacatgggaggctggggcatgagaattgcttgactctggcaggtggaggttgcagtgagccaagatcatgccactgcactccagcctgggtgatagagtgagactctgtctcaaaacaaaaacaaaaacaaaacctgagggatgagccacaaactgggaaatgatatctgccacgttgtataactgataaaggagatatatgtacatatactatatatataatcttctataaatccataaaatattaaacaatccaacctagatgggcaaaaatataaactagttcaaagatgagcaaaaaatatgaaccagtaattaaaaggaaataccaatgagcaataaatatatgaaaacataaccattctctttggtcatcagagaatttgaaaaatacagccacagtgagatagcattttatgtccatcatattatcaacatttaaaactctgtcagtaccaagtgtgggtgaagatacagagcaaagggaactctattacatcgatctaggaaatgtaaattgacacaatcattttagagagcaatttgcaatatttataaatgttggaaatttgcacacagtaaaatctagcaattccatttttggatctatgtcccaaaataaacttaaaaacattgttttgtagagacagggtcttgttatgttgtgcaggaaggtcttgaactcctggcctcaagcaatcttcctgcctcagcctcccaaagtattgaaattataggcgtgagccaccacgcctggccccaaaagaaatcttgcacaggtaccaggagataaggaggaagtgttagttttctgagcagcattgtttgtaaaagtacaaaaaaaaaaatgaaaagaagcaacacaaacaatctatatattcatcaagaggaggatagataaattgtggtatagtcatataaaggaatactatcaagtagtgaaataaaatcaattagaattattaggctgaaccatatgaaattgccattcttctagatcagaaacaaccaaatattggcaatttcatacagtttaaatatatgtatcagtaacataatgctgagcaaataatatatataatatgatatgatttatataatgttaaaatacacataagagtcttttatgttgcttataaattaatatgtatattgtacaaatatacagatgcatgggggtgatgagaagtttagagtagtagttgcctgggatgggattgggtcttggggggacaggggggaacatgccaatggggaggaattacaggggcttcaaatgcatcagtcatgttttatatcttcaactgagtgctagatgtggggatattctcttttctctttaatcctttttgcgtctcagtgctgattaatggaatttagccaccagattgggtgattttttggcttgttgaatagttggccaggtttgcagggaagctttgccctcttgggcagagtatgtttttccaatctagtaactgtctgtttttggtggtgatttctgtggctgtaattaatatgatcagtgttgccaaagcaaggataaggggtattgactcactttttattgccctgagccatccctgttgcaaaataatgatctggatataatctccagaccaggaagcaagctgcagatgggaaactcccttatgacacttctgaagatcccaaacagtttctttttttaatgtaatttgattttttatttatttagttttgagatggagtctcgctctgttgcccaggctggagtgcagtggcacgatctcggctcactgcaagctccacctcctgggttcatgccattctcctgcctcagcctcccgagtagctgggactacaggtgcctgccaccatgcccggctgttttttttttgtatttttagtagagacagggtttcactgtgttagccaggatggtgttgatctcctgaccttgtgatccgcccgtctcggtctcccaaagtgctgggattacaggtgtgagccaccgcgcccggcccccaaaccggtttctaacaaataagtgttaagtcaaggggttcctctacagaatcagtcatcttcaccatgacacccacaacgcccaaattgctgctggcattcctccactctgaatgcacaattagaagctcagcactctattggataaggctgctatttcaccatttgaagaaccttcaaaaaggtctttagagacagggcatggtggctcacacctgtaatcccagcactttggaaggccaaggcaggcatatcacttgaggccaggagtatgagaccagcctggccaacatggtgaaaccctgtctgtactaaaaatgcaaaaattagccgggtgtggtgatgtacacctgtagtcccagctactcagtggccgaggcacaagaattgctcgaacctgagaggtggaggttgcagtaagctgagatcgtgccagtgacactacattccaacctaggtgacacagcgagactccctctaaaaaaaaaattccttagaaacttcagaaggatccttccactagggcagaagggatgagagagtaagaatcttcacccctaccactcatgcctttctgaaggctcagtctggccacactgcaagggcacagtgagccagttttggcctggggcttcttgctgctgccaaattaacaactccagcccttgggtttagccacctgctgctgctaaaaatgttgctgagagtgatggagaggtgttttagttcccattttacagatcagaaaatcaaggcccagagaaactaagtagtcttggagataggagccatggcctctccacttgagttatcatcttgaaacatcaaggacaagccaactttatcaacagttttaggcctgtgagaaatgggcttggtttatcttgaagattgtaaacaaataaaaaaatagactgctccattactgatgagaaatatgagtcattctgccaggaattgaaagtacagctgcccataaaaaagctatgccggggtccagcctctccaggtccttgtgtgtgaaaaaccactcagtcaaagttccccttttatttctctttgtgctcagtaggatgctgaaatttctggaaaagacaatggaaatcaggggcaggaagagaacagtgtggggtgctaaacagatctcagcaacctccctgcccacggccatctctgcgcagacacctcgaccccccatgcgcaggtggagcagcgtttcctagttctttccagaggcttccttctgcctgccttccagccacatcgcctgagattgacaacgccctacagcaagacggaaacctccctttacagcaccaccttgcgattctgcagccacaaagttgagacttctgaacgtggcactcttctgttcccttactgtttcacgtgtacctgtgtcatctttcttgtttcatcgtaaacatacttctaaaattcccattttctttatttagaaatagaactacaagcggatggttaaacaatttaaacaaatggtccatggggaaaagtgaatttcacactgtcccccaaactttcagtg

SEQ ID NO: 1767 - DNA, 38764 bp, Homo sapiens
caaggaaatggagatccaaaggaaagcctgaagcactttgtggcttccacgggttcgtttctaggaagcttttgctttacctggggaaaccccaagctctacagtgagaaagttgtaaattagcctttaggagacgctgtttgtcaaagttatcttaaccctggaaaaggggagggaaaaaggcagataagcagtgatgacatcagcaggaaactagtatcaggctacccagtcctgaagattcagttttcacttaaacaaccagcaagtcttgaagtctcttcccaagcaaatgggagcttctttggaccttggagcacacagaggattctactttctttaaaactttgttttcaggcaatttccctgagaaccgtttacttccagaagattggtggagcttgatctgaaggtatgtaattaacaacccttcttactccagagtctcatgcttgaatcttttcctttgcttcatggcttcgtgttgtagaaacttgcaaaaacttgtcagcaatggcactattttttcttagatttctttgtcatgcctgggaaaacaaaagttaaaaaatccggaagcctccaacatagccttttaccggggcagaaatatgttagctcacagagacaaagtttggtagactcactaaaactagagatcagaattgtcaagaaaccacaaggcaaatgctagatgcggtagaatagaaaggtgtctccaataaaccactcatttgacctcagggctagtagcagggaagatcccctggattatcacattaaaaatgacatttttttgtttcttttaacaccaaaagtaatgtgtatgctcacatatgcataaaatttgagaaattcaattggaagcccagaaggaaatttgtattatctatagttatgtcacctcgatataaccactgtttgttatggaggttttgatttttgctgtgtcttccttcctttatttatttatttatttatttatttatttatctatttatttatttgagacggagtctccctctttcaccctccagcactcaagctggagtgcagtggcacaatcttggcttactgcaacttccgcctcccaggttcaagcaatcctcccatctcagcttcctatgaagctgggaccacaggcatacaccaccaagcccagctaatttttgtattttttgtagagacggggtttcaccgtgttgcccaggcttgtcccgaattcctggcctcacagtgatccacctgcctcagtctcctgaagtgcttctctgattataatgaaatttagtatgtagaataccatagtttatagactagtcagatggaaacattgactcatgtaatttttatcttccttcgctgatttgagcaactcttgtctaaaatcaccctttccttctgaggtctaggaggtttttttgttgttgttttgttttgtttttgaggcagggtcttgctctgtcacccagggtggagtgcagtggcacaatcatggctcactggaacctccatccccggggctcaaatgatccttctgcttcagccctctgagtagttgggaccacaggcgtgcaccaccatgcctggctaatttttgtattttttgtagagatggggttttaccacgttgcccagtctggtcttgaactcctggcctcaagtgatccacccgccttggcctcccaaagtgctgggattataggcgtaagccatgacaccccacctgttccttcctttataaagtattttcttgtttctaaaaatagccaagttctgcatattgactacatacctcaagtgcttatagaataaatagtattacaatgaaaattttatcactgcattgctcctctgattatgatgaaatttagtatagagaatagcatagtttataaactgatcagatggaaacattgactcatgtaatttgtttttttttagtgaaaacaagtttattagagaagtaaagaaacaaaagaatggctactccatagacagagcagccgactcatgtaatttttaacttcctacactgatttgagcaactcttgtctaaaaccaccctttcctcctgaggtctaggatattttatttatttatttttctttttgaaacagggtctcactctgtcacccagggtgaagtgcagtggcatgatcatggctcactgcaacctgtgctccccaggctcaaatgatccttccatcctcggcctcctgagtagttgggaccacaggcatgtgccaccatgccctgataattttttgtatttttagtagagaccaggtctcgccatgttgctcaggcttgaggtctaggattatgccttccctttctgtaagataaaggcctgccctcttacaggtagcagtctgaagttaagatgtaacacacatacctcacggtaccttgctgtctttgggttgatagatcataaggataaccctgcctcccccagattgctttgtgtctaaaacttaaagcatagagccaagtgctatttctgccacgtgctggaaatgaatgtaagggctccaatcaggctaccaggcttgagaaaaattgtgctgtgtccctccatcttaactttctctctctgggaacattttgatttgggagaaatcaaggtgaattgaattccaatataagcaccctccaagtttcctaaaaagtaacttgcaagtgttggggaaaagttttctgggctgttgctttttgaagtagcctcgccgtaatttttatttttcagcacttctaggaaagtctaatgcccagaacggagaaggttgtggtgaggggagggcctgggaagtcagggggccatatgtcctcactctctaactccctgccccacctctctgtccctttcaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttaggtgaggacgggtctgtggtggagatgggaggatctcccatctagtgttcattctggccattgggctttgaaaggaagctgcagttaagatcttttggttatctacctccttggatgataaaccaggagattctaaacctccttctcagcctctgatgctaatgagataagagttgggaggtcagcaaagcttcaagaccaagccctgggcccagaggtggcttccctttgttttgcttctcactagcagtgaagcccacctcagtgtggcagagcccgtgttttccctgcttaccagcggctacacgtgcagatcttctccctcctgggatccactagtctgtctacctgtttcccggggtcttgagaagagagtaatgcatacttggagtgaaataagcaagatgaaaaaagagatgtgtttctggggtagggagggatgtcatttatgccatgtctagttatagaaatttctatatttttgggtgggaatccagaaaggtaaaaacaggcattttgcccaaagaggtaaaatttaggcattggtcttatcatggatgacagcgttttatttttattttgagacagagtctcgctctgtcactcaggctggagtgaagtggcaccatctcagctcactgcaacctccgcttcctgggttcgagcgattctcctgcctcagcctcctgagtagctgggactacaggcacccaccaccacacctggctaatttttgtatttttagtagagacagggtttccaacatgttggccaggctggtctggaactcctagcctcaagtgatccacgcacctcggcctcccaaagtgctgggattataggtgtgagccactgtgccaggctgatgacagtgtttaaaattgttcactgacatagtgtccacatcagagaacctcacgaagaggagcctttggagggtgttttatggtctctgcgattagaacacattaagccttagcggtggaactggcttccagaacctgagttgcccttgagtcagtggaaggaatgatgaattccagaaatccatatttccattctgctggctaaacatctgagggacagtctctgacacataggggtgttagtatgtggatgaaatcctcactgtttctggttgtggattatatctcgaagctggggtagttttcttcccttttcaatatacaaccgactgtaccttggctggcctggggtcctatctaccaagggcctgtaaagtaagcctgaatttcttgatggaatcaggagatgggaaggcatgtcagaattgtgttttatgcctttttttttttaaatatgccttcttagtgtggtgaaaaacagcattagacttggagtcagaaggcctgcttctaccacttactgtgttatctttatttaaacaagtcacttagaaactgaaagttttcattttttgaacctataaatgggattaataattgtctacacatagagttgatcattcaaatgacagaaaacatttatgaaagcacttgattgattatggtgtcctccacaagtgtaaggctttatttgtcattttgggtgtgtgtcttagaaacctgctctacgaactgtcagaaggcattgactcagagaacttaaaggacatgatcttccttctgaaagactcgcttcccaaaactgaaatggtgagtgggtcatacagaatgggtctgtgtgagcactgtcttaatcaatgattagaaagatgctggaaagggtttttagggagatttattttttatgggagacagtatcatacaatggttacgaacattggctttggtgctggatgagcctagattctggtcctgattctaattctaaacccatgctgtgaggccaatgattgaacttttctgagtctctattttcttagacgtaaaattgtgggcaatcgtatgacttccttctaggattgttgggagaattagctggaataatgttcatgaagcattagcatgaggccaatatttggtatagcattcagtaaatgctcacttctgttggaatctgttgtgttttgtttttgtttttgtttttttttgagacgaagtcttgccttgttgcccaggctggagtgcagtggcatgatctcagctcactgcaacctccacctcctgggttcaagccattctcctacctcagcctccctagtagctgggattacaggcatgcaccaccatgcccagctaatttttgtatttttagtacagacagggtttcaccctgttgggcaggctggtctagaactcctgacttcaagtgatctgcctgccttggcctcccaaagtgttgggattacaggtgtgagtcaccgcacctggccttgtccagttttttctttcaagtgccttttaatctgtaggttagatttcctccctgcccccaaatctctttctttttcttaaaatgtatctgttgaagaatctctgggcggttggcctgtggagtttctcacaggctgagttttgctgattgcacactcgtggtgcagtttggcatgttcctctgtcctctgcatttcctgcagactggcagctgaatccagaggcttcatcagactcaggtcagatccgtttggcaagactataggtagtcttgttttttcatcaggaggtacctgattttctctctctttttctttgatattagcaactgttgatgttcaaccattttatatattgaattttgaggggttgcaaaaatggagatattagaatttttttttttttttgagatggagtctcactcttgtcacccaggctgaagtgcaatggcacaatttcagctcactacaacctctgcctcctgggttcaagcgattctcctgcctcagcctcctgagtagctgggattacagcagcctgccactacgcctggctaactttttgtatttttagtagagatagggtttcaccatattggctaggctggtctggaactcctgactttaggtgatccacccgtctcggcctcccaaagtgctgagattacaagtgtgagccaccatacccggccacatattagaattgtatcatttcgttttcccttcatccattatttggttacccagtgatacagcttatatgtgaatccttgattcttttctttcagttattttttttttttttttgagacggtgtctcacttggtcatccaggctggagttcagtggtgtgatcttggctcactgcaacctctgcctcccaggttcaggtgattctcctgcctcagcctcctgaatatctgggattacaagcaggcaccaccatgcctgtctaatttttgtatttttagtagagacagggtttcatttggccaggttggtctcaaattcttgacctcaagtgatctacctgcctcagcctcccaaagttctggggattacaggcatgaaccactgtgctttgcctagttatccagtttttaagttaattggtatcttatcattctctgaaggtgacccattacaaaatatatataaatttaaactcatggatttaaacatatgtgaggtatttcaatctactgcaattattatccttactgaagttcaaactgaggctgggcatggtggctcatgcctgtaatcccagcactttgggagtctgaggtggacaggtcacttgagcctcaggagtttgagactagactgggcaacatgacaaaacccggtctctacaaaaaatacaaaaattagctgggtgtggtggcgtgcacctgtagtcccagctcctcaggaggctgacatgggaggatcgctcgagcccagagaagtcaaggctgcagtgagcaatggctgtgccattgcactccagcctgggtaacagagtgagaccctgtctcaaaaaaatagttcaattgtcccattttttcccaggggatacatcttcagtttggttcctaagtcattttgacatgaccttagtagtctttgatggcttctttactatctggcaaaaatatcccaggttcatcttgtatattttctacccagtcctggaatctctcatttctcccaaaaatcctgacttcttttaatgagagatgtcatttcaagaccacaaactcgatgctggcatgctcattgcttttgagtaaatatatatgcacacactacgtatatacacatatgtatacacacacacacacacatgcacacacacacatgacctaaaggttcagtaattcttggagaattttaaaaatcaggcgattttgttttagggaattcttttttataaaacattgtaaggatcttctgcttttgccgtaaaatttcagtgcccacatttgcagtggtacaaagcaattacctgctcaaatggtagcattataccttaaatacagaatttctcaaagtcagaggagattcctgtagtttgacaagcgctccaggtggttttcataacattctctcccaagttggggcatccgctcacaaattttccagtgtctaggtttatacataaaatgagaccactttttattgttataccccgtcctatgttagggactctctgaacaatatgaggtggcgggtgagggacgagagaaaggtcatttgttaaagcaatctctgatattcgaaacactgagtgttagttttcaaacaagaaaagctggaaaatgtttttttttctcttttgcttgcacaggttctagaactctacttgaaggcatctgtggctacagaattattattattattattattattatttttagacagagtttcactcttgttgcccagtctggagtgcaatggtgccatctcggctcactgcaacctctgcctcctgggttcaagtgatcctcctgcctcagcctcctgagtagctgggattacaggcgcccaccaccacacccagctaatttttgtatttttagtagaggtggggtttcaccatgttggccaggctggtcttgaactcctgacctcaggtgatccacctgcctcagcctcccaaagtgttgggattacaggtatgagccactgtgcctgcccagaattatttttatggtcagaagcattccaaacatttcccccctactaaaatagcttttaaatgatcaaatgcacatgttcatgtggccaaatgatcttgtttttctcagtataacagtaaaaggaaacgtaactgtgcttagctgtggcatggaattgtgatattaccaggtcaaattcaggaaaaccatatttcctctttggattccaaatgatctcagcttttttttgttgggggcggggtggggagatctcattttttgtgtcagaattgtggctgagttacacacctcagataatccaggttgatctgtattggattttgcaatcagaccagcctttggaagtgtgtaaaggacagtctctaagcaacacagatgtttccacaccagggctcagtgaggctgcattatctgcaactgcaattgcaaaagaccttatcacagaaataaattacttacccaccattggaaaagggcctgaacacccctcagccaaaacggaaaggttctaaattcttacagtctctctggggaaacacaaataaccttgcctttgaggggcattctgggctttgtctttgatagctttcatagaaatgtaagcagtatagctggcctacacatatcctgagagatctcacaactgtcaggaaatccgttctcagcacagcaatcagcatacaacattgagtctaaaggaaaccacacctgaacttactctttaacaaaaaagcaaaaaaagaactttcagatgtttgctgctagtatttgccagagtggtgttaaactaatgtccaggtcccatttaagtatgtgcgtgtgtatgtgtgtgatgtactaaacatctaataaacttttagaaagtataatgaatttccgtaattgcttctggaatcacatcttagccctttattcctcctggtaggatgctgtcaagacatgagtttctggcctggcagggtggctcatgcctgtaatcccagcactttgggaggccaaggcaagcagatcacctgaggtcaggagtttgagaccagcctggccaacatggtgaaacccatctctgttaaaaatacaaaaattagctggatgtggtggcatgagcctgtaatcccagctactcaggaggctgaggcaggagaatggcttgaatggaggtggaggttgctttgagctgagattgcactactgcactctagcctgggagacagagtgagagactccatctcaaaataataataataataataataataataatagctgaattgtgattttttgtttcagaaaattctttttcttttaaaatatcaaatataaaattctttcgaaacattttcccctcatttctttggtgtccctcttttgctggcttcctaagcagtatcatttaaagctgtgacttagagttcagtggttaataacatagactttggcatcagattgtaccagctctgccattaattagctttgtgaccttcggcaagttactggaatttctttgtgcctcaattatttcatctttaaaatgtggattataataatatctacttattcagttgttgtgctgttaatatacagcaagcactgtccctgttgcatagagttatatatatatttggtatctggtattaatatagattgtatacagatttgcttggtaatgcctcttcccctacattcctgagcaacttgagggcagatgctgttatatcttatttatcagtgcaaaacctagtgcctactggccatgcagataacatttgagtgagtggataatcaataggcaagtaaatgtaactctattgattctcttgtagacctccctaagtttcctggcatttctagagaaacaaggtaaaatagatgaagataatctgacatgcctggaggacctctgcaaaacagttgtacctaaacttttgagaaacatagagaaatacaaaagagagaaaggtaagtagcttgtgattgctaacttggaccagaccatggaaattcttaaaccaattggccatgcatgatgttttgattatttgttttgttttgttttgttttgaggcagagtctcactcactctgtcacccaggctggagtgcagtggtgtgatcttggctcactgaaacctccgcctcccgggttcaagtgattcttctgcctcaacctcccgagtagctgggattacaggagcctgccaccacgcctggctaatttttgtatttttagtagcgacagggtttcactatgttggccaggctggtctcgaactcctgacctcaagtgatccacccacctcggcctttcaaaatgctgggattataggtgtaagccaccatgcctggcccgtgcatgatgtttactcatcattctgataatattctgctaggaaagccagaaatcttccccttcgttcattcaacacatattggttgagttcatattttgtaccaggcactgttttagaagttgaggatatagcaaagtacagagcaaagctcctgccctcttgcaacttatattccagtgcagggaagtagttttagacaaacgtctttttctgattctaatatgggagtgagagtatagggaattattttaaatgaaataacatgaaaaagaaggcaggatagcatggggtaagagtggactctatagagtcggattgccaggactccacttactagtggtgcagtggtacttttttggcttttctatgtgtcactttccctatctgtaaagtgggcataataattgtacctacctcctaggtttttgtgaggattgaatgagataatttctgtaaaatgcatgtctggcatggagtaagccttctatacatgtggctattatggctctctcagagagaaaagtcataaagacttcacattctcagaaactactatcaaaaaagaactttattttcttgtgtgtgtgtgtgtgtgtgtgtgtgtgtgtgtgttttaagtctgtctgataaaggtagttctgctgtgatattttatacagatagaagcacagggcaaaagtcaaacctggctgccttaccacgtgtcagtacgctaaatatctgtgtttttctgagttcatttctccactgttaagcaagcgctatacataaaaactcatgagtgtattcatgaaacttttatgccacacccttaatttagttcagtgagtgactctagtgtgcaaatttcttggttgaaaatgaaactagctaagaggaaatgtctgtctaagaatttggttaacacagaatgagttgaggagcaaaatatactgttgtcaaactgataaaatctcaaacaataaaatgatgaataaatgcataatttaagttatgaagaataaaaacagttctttctatcatcaaattatcaaatgagaaataaaaagcagaaggttgatatggaaagaatatttgaaatcctcacatgagctctgagtttttttctaaacacattgtcatttttctgtaatgccatatcccatataaagtaaacatagggcaagtggtcatattattctggatatttaaattctaaagaagacacactagtttctatgtagttgattacatttgcctcagtgagtcttgaagactgagctttgttttttttatttttattttttgagatggagtctcgctctgttgcccaggctgcagtgcagtagtgtgatcttggctcactgcaagatctgcctcccaggttcacaccattcttccgcctcagcctcccaagtagctgggactacaagcgcctgccaccacgctcagctaatttttgtatttttagtagagatgggatttcaccatgttagccaggatggtctcgatcacctgacctcatgatcagcctgcctcggcctcccaaagtgctgggattacaggtgtgagccaccgcgcccggcttgagctttgttatttttatttttatttttatttgagctggagtcttgctctgtcgcccaggctggagtgcagtggcatgatcttggctcactgaaacctccacctcccaagttcaagcgattcttctgcctcagcctcctgagtagctgggattacagatgcccgccaccatgcccagctaatttttgtatttttagtagagatggggtttcaccactttggccaggctggtctcaaactcttgacctcaagtgatctgtgtggggattacaggcgtgagccactgcgcctggtccaggactgagctttatatcagcagagttctagttttgatttttcttttctacaacctacctgtgtgtgatctcttttgggtgtcaatcattattgatattttaatattgactttctttagttctaagagtttgagcctaattctgctgttaagatgaaagactaaaggactaaagagtaggtgtgcagactttagacttttctgtaagtgtgtgtgatccaaagtccaagctaggatactggctttatttaaggaccacctggctaactttctaagttgtcttgagccttggtgtttgcttcagtattttttttttcttttttttgagacggactcctactctgtccccaggctgcagtgcagtggggcaatcttggctcactgcaacctccgcctcctgggttcaagcaattctcctgctgctagtcagaaggtgatttttatttttctgtctgtgattttattttcagctatccagatagtgacacctcctgtagacaaggaagccgagtcgtatcaaggagaggaagaactagtttcccaaacagatgttaagacattcttggaagccttaccggtaggttcagtggtgtgctggtcaatgcttaacaaccggctccaccctccaacctcccctccctgccaccccaaaaaagaaaaagagagagaggccccggtttgtaccatttattgtaaatggtctcaccatggtgattgcaagtaaacaacatgatatcaaccagagtgcacattttctgaaaatttaacagttggctgacactagctgactagtgagagctagttagtttgagttctcgctagttagtttgagctgactccccacacccctgagttgctctgaaatggttcctctgttcttatctgtgggatgcaattagagccagctttagggacatataatctatggagcacagggcgtctgatagtaattccacagttcaagtacagagcttttgtttaatgctctgctgttactgctttgaaattcttaatgtattgaacaagaggtttgccaagcatgtagctggccaacccagagggcaagggtttctggtttctgtggtgctcagctctgaaaggatgggtggaaggggaaacgttgggagaatttgcagtctgttcctcaccatgtgatcatgatccttgggagatatgtgacagtcttccctgggatttgtggttcttccagcagacttgggtaatttctttgccaacatctgtcagcatcaatgaagttagcttggtctgggaaatgttttgtttttgttttcaactgtgataaaatacacataacaaaatttaccatcttaatcaattttaagtatacagttcagtaatgttaaataccttcacattgttgtgcagacattaccaccatccatctccagaactttttcatcttcttttagtaaaactttgtacccattaaacaataacttctcattttctccttccctccaacccctggaaaccaccattctactttctctctctataaatttgacttttcagggtacctcatataagtagaaccatacaatatttgttcgtttgtgactagcttatttcacttagtgtaaagtcttcagggttcatccaagttgtagcatatctcagaatttccttcctttttaaaggctgaataatattccactgtgtgtatatacagtaagtcctcacttaaaaggttgatagatttttggaaactgaatttaagtgacagcatactgtataatgtatttatttttatttaaaatttttttttatagagataaggttttgctatgttgcccaggctggtctcaaattcttgggctcaagcaatcctcccgccttatcctcccaaagtgctgagattacagccatgtaccaccacgcccagccacataccatataatgaaaccaattttaccataggctcattgatataaacaagagttggccaggcatggtggcccacacctccaatcccagcactttgagaggccaaggcaggcggcttacttgaggccaggagttcgagaccagcctggccaacatagcgaaaccccatctctactaaaaataccaaaattagctgggcgtggtggtgcatgcctataatcccagctactcgggaggctgaggcacaagaatagcttgaacctgggaggtggaggttgcagtgagctgagattgcatcactgcactccagcttgggcaacagagtgagaccctgtctcaaaaaacgataacaaaaagccctaagagttaagtttctatagcatacagttcgttgtttcacttaaaggcggagttaccaagaacctactgatgactctgagtgaggactcactgtattacattttgttgtccactcatccattgatggactcttgggctgctgccaccttttgactatttttaataacgctgctgtgaatgttggtgtaaaaatatctctttgaaatgctgctttcaattcttttgggtttgtatccataagtggaaatggtggattatatagtcattctattttcaattttttgaggaaccttcattctattttccacagtgactataccattttacatttccaccagctgtgcacacatcctcagcaacacttcctcaccaagacgtattattctctttcatttttgatagtaggcatcctaatggaagtgaggtcctatttccctgtggttttgatttgctttccttaatgactagggctgtcgagcatcttctcatgtgcttttggcgatttgtatatcttctttagagaaatgtctgtccaagtcctttgttcattttctaattcggttgtttgtagaagttttatttttaattcttttttttttttttttgagacggagtctcactctgtcgcccaggctggagtgcagtggcagggtcatggctcactgcaacctctaactcccaggttcaagcgattctcctgcctcagcctcccaagtagctgggattacaggcgcgcatcaacacacctggctaatttttgtattttttaatagagacagggtttcactatgttggccaggctgatctcgaactcctgacctcaagtgatctgcctaccttggcctcccaaagtgctgggattataggtgtgagccaccgtacccggcctttattttttaattctttttttttttttttttttgagactgagtcttgctctgtctcccaggctggagtgcagtggctcaatctcagctcactgcaagctccgcctcccgtgttcacaccattctcctgcctcatccttccaagtagctgggaccacaggcgcccgccaccacgcctggctaattttttgtatttttagtagagacggggtttcaccgtgttagccaggatggtctcaatctcctgacctcgtgatccacccgcctcagcctcccaaagtgctgggattacaggcgtgagccaccgcgcccggcctatattttattcttaaaaattcttttatggcttctttactattgtcatggtctgatatttttacagttacaatttttagatttaaaaataatttcaattttatagaaaagttgcaagaatgtgaataatataaagaatacctatgtactgttttcctagatttacctacctgttgttgatgttttaccccatttgctttattatttttgtgcatttactcacacttgctctctttctccctttctctccacacacacataatttttttctgaactttttgagagtaagttgcatacatcatggccttttactcctaaatattttcgtgtgtatttcctaataataaggatattcttttacagaactataacacaattatcaatgccagtaaagttatgttaatataatacttttatcaaatcaatggtccatattccaattttgtctgttgaacccaataatgtccttgacagtttttaaaccatctagtacaaaattccacataggatcctatataaatgcaacacaaggctgggtatgttggctcacacctgtaatcccagcactttgggaggccgaggtgggaggaccacttgaggccaggagttcaaggtgagcctgggcaacatagtgagaccctctctaaaagaaaataataaaaattaaaaatacaatataatacaatacaatattgtatttagttgtcatgatcctttagtctcctttaatctttttttttttttttttttttttgaaactgagtctcaccctgtcacccaggctgaagtacagtggcatgatctcggctcactataacctccacctcccaggttaaagcaattcttgtgcctcagcctcccaagtatctgagattacaggcatgcaccaccacattcggctaatttttgtatttttagtagagatggcatttcaccatgttggccaggctggtctcgtactcctgacctaagttatctgcctgccccagcctcccaaagtgctgggattacaggcgtgagccaccatgcttggcatagtctcctttaatcttgaacatttccacaacttttatgacatttaatttcctcttttatgccattgagacttttgaagaatgcagtcactcctcccacctttcattaaatagaattttccttatctttggtacatgtggtatttcctcataattagattcaagctgtacgttctggccagaatatcacagaagtgatgtgtctttctcagggcatcccatctggaaatacgtcatgtccatctgcccccctattcgtgatgctaattttgattatttggtcaagatattttctgatattatcactctgcagttaattttatatagttactattttttccccacgcaattaataagcaagtgctggagagacattttaagattctgtaaatatcctgctgcacatgaaaagtttccccctagattgagcgtctgctgatgattcttgtgtgatccagcatttactatgttggttgtaaaacaatgcttttctgactccagtattctctccacattcgtaagttggctctcagcattctactgtaaagaaggaccctcctttctccccaggaaggtgtttttgtttttttaaatgaaggagaccgtggaaactcgccagatgacctgtagctcctggagcttggcaaaggctgggcaaacgcccacctgaagactatgcaggcaatcaggacatgacacagagccgggagaggcctgctcttcggctctgccctgaacctcattcggcaggtggaggtatttaggcatttgagggaatctcagctttgggaggccactttgtaagtgatcttaagagattaagtacatccttaattaaaagaaatggtaacacctccgcctgcttgctgtgagtttattcatttgaattccccatctcccccaatgggaaataacacagaattgcaattatttataaaatcttaaattggcttcttttctctaggaaaatagcccttgattcaattaattccaatcctagaaaagcgcctagatatctgattgaggtattgagggagagaggctgctccccttgattcttttactataatccaattaaagcaacatttatgggccaactccctggccatgggcacagctttgtttagagagttgcaaatccattcccacctccccgctcccccagaagctctttattattttattttatttatttatttttttgagatggagtctcgctctgtcacccaggctggagtgcaatctcagctcaatgcaacctcagcctcccgggttcaaatgattctcatgcctcagcttccctagtagctgggattacaggcacccgccaccatgcctggctaattttttttgtatttttagtagatacaggatttcaccatgttgacttaaggtgatccaccctcctgagtctcccaaagtgctgggattacaggcatgagctattgtgcatggccatcccagaagctctttaaaatgtggttttccagcactgacattttaggattccctaattctaagttaaattgtctgctaaatgtaactcttcccacccactttttcaacttgttttgtgctcagatactgacatgcatgtagaaacacacacacacacacacacacgattctgctcgttgtctttgagaaattcagtggtttctaaaggggcatggctcagctgtggcctctgaagcgctgtggttccgctgacgtgggatgataacttggccacggcacatgcagtagggggatagtcgtggcagtactagaagtgcaaaggggactggggcacagcatctcacgtgttttcacagacttttaaggttggaaggtgtcttaaaagttatctgggcagccctttccctctccatcaaatgatgaataaaataaaacttggtgaaacatctcatgtttcttaagcacctgaggattttttttttaaatttaaaagaacactgccaataattgggctcaatgagaaggaactctcatcgaattttaagcaacatctcctaatatgtttaaaaattaaatttatttttttctcagccccctgcaacttcagcctcccaggttcaagtgattttcctgcctcagcctcctgagtagctgggattacaggcacgtgccaccgcacccagcaaattttttgtatttttagtagagatggggtttcgccatgttggccaggctggtctcgaactcctgacctcaggtgatccacctgcttcagctcccaaagtgctgggattacaggcgtgagccaccgtacccggccaaatcgatttttttgagtgtggcataaggttttcttaaggagaggcatgtctctctatggaggagacctaacacctgcttctttataaggccttattggacccctcttgaaaactatcaaaagaagttgaaagatgattcagtgtggccaggctgtgggacattcactcattcattcattcattcctctctgacatagagacttgagaggtgtcaacagaggatgcaacattctcgggagaagaaaggcagattagaccttaaagcttttttctagtccctgttctggctgactttatcagccaagggaagaacaaatcaaggaaagccagggcctggaggggctgggcagagcctgctgctgtgtctgcattgcccctaatcccagaagactcactcaactgctggacaaaaccagaaggcagtctggccaggcccttgtctgcctcttagaagaaatctaggattctacaggaagggaacagtggcttatgaaaagaaaggcaggaagccttttggaaagtgaagctaagcctcctttgcatttgttcctgcagagctgggggaacagctcttccccaacaccttggtcaggtccccttgggggctttctgctgaaggctgacggctgagagtcatagggggaagggggtgatggtgaatggggaggagggtacagaaaagacagggtcttagactttgttttaattttgtatttaattatataaaacattaatgtatgcccaaggtagtgcatccttgcctctcctccccacctcgattgccatttttatttgttttttgatttatcttattacttttgaaaaaaatccaacgtatatcttccctttattacaaaagaggtagtgcactcaaataccatttcattttgctttctccatatgacagcatcccctggagaagggtatagaggctgtccttggcatcttactccactatgtggacataccacagctttttcaatcacttcctattggtggacattaggctatttccagtccttagtgtaaataatgctgcaatgagtaagtacccttgagcatatgtcacactgtatttttgccagtgcgtctttgtgaaccttctcctttggatggagagagttggttctcttcccatttcctgccaatgaactttcttttttttttttttttgagacagagtcttgctctgtcacccaggctggagtgcagttgcgcaatctcggcccactgcaacctctgcctcccaggttcaagtgattctcctgcctcagcctcctgagtagctgggattactggcatgcgctaccacacccggctaatttttttatttttagtagaggtggggtttcaccatgttagtcaggctggtctcgaactcctgacctcaggtgatccacctgccttggcctcccaaagtgctgggattacaggcatgagccaccgcaaccggcccaatgaccttttctgtggctgtggattagatatctgtccttccctgcatcaagtctagtttttgttcctcatcctaactgtgtgaaattcctatgtttcatgccctcctttcttttttctcagcaggagtcctggcaaaataagcatgcaggtagtaatggtaggtatttctaatgtactttttacaacttagatcggtatggtagggatagacatatttgatatataccaaggaattcaaggtgacttggaagagaagctttataaataatgaataattcattttttattccaattcaaggcaagacattgaatgcatggattgtactaggcttttctatggcagtatggagagggctgggtggtttctgctctgaatgcctagtatagcagattctagggactgcaggcggctgttcttcctccacccttcagaattaggccaccctctgtgcagcagaaacagcccccgcagggctgaagccttcaggccagtagtgacagcagaatgtgcagtctgggtgcgtgtcctctatggagtggttccagatgttgcttcagagggagagaagaagcaagaggagggacttgaggatggtgtgtttagttccctgaatccctgcccagaaaccataaccttaggaaaatattccagaatctgccatcaggttaaactgcttatgaacaaacaggctttggcgaagtctttctgtggtatgtaaagtttgtcacagaccattcctcatttttttttctggaaaattatccttcagagtccaagacacacagctttgctagcaatttgtctttttgcctaacacggaggttgtgtgctatgatgttggtgacattgaccaggtcaccattattaagcacttgtcacatactaggcactgttcagagagatttcagggattatatcatttattcctccattcactggaggtaggtaatactgttattctcactaatgatgaggaaactgagacccatgaaatctagtgctttgcactgcagctaaaaggcaccgcagctaaaaagaagtgaagctgggatttgaacccagctgtctgattccagagcttactctcctaaggccaggctatcccagtgtctatttatgtgagctcaggtgactgcttcacccctctgaagaataaagcagtttctttcagctttacaattctgcggttccaacatttagacgtgacttcccgtggagcattaccttctctcatggtgaggaggaatttataggtgctctgagccactgaagcgtggatcccttttgctgtattttctggtctggggaatatggacttgctcagcctgaggactgacccttagcagtagttaataactaactcatgccccagagacaaggacagagtttggtgggttctactacaaacttcctgtgagtggaaaaagaaaactgtttgatgttacattttcctgttagtgccatgtgacaaataatgcattgctgactttctctctgtgatagagtcttttccagaggaatcagggagttggcaggaacacttcaaagcagtgtgatcctcagtcgatgcccaactggaactttctttttcccctcttttttcttttcttttcttttcttttttttttttttgagacagggcctcactctgttgcctaggctggagtgcagtggtgtaatcacagctcactgcagccttgacccctcggactcaggtgatcctcccacctcaacgtcccaggaagctgggactacaggcaatgtgtcaccatgcccagctaattttttgtattttttttttctagagatggggtctcactaagttgtccaggctggtcttgaactcctgggctcaagcgatcagcccgtcttggcctcccaaagtgctgggattacaggcatgagccaccacgcccagcctccctctttttccttctctagggaagaggtccacctagcctctttatatccagtgacataaatgctgactcaatccaaccatacttgagctggaagccttgagctgatccatgggatcttaattaattccccacccaatccctgccagcagcatagtttccaacccagacaaagcaaaaaagaatgcgaagacacatcagtctctcccatcaggaagggcatggtggctgaatttgtctcaggagggccttgagagaagcataattctccagaattagatgcgaaaattatcagtgaagaaatctaagtgcttggggaagatatttggagtctgagtacctctctttctaggtaacagagccacaaatggtgcaccaagcctggtctccagggggatgcaaggagcatctgctaacactctaaactctgaaaccagcacaaaggtctggatggtttcttttattccttttttaataaaaaaattttttttccaaatttaatcaaaaggacggtttctttaggggctctctccctagggtccagccttcgatgattttaagggctccgagctgtttgtttcagacttgtttctccctctctctgtaattatctctgttcttcccacctttttctgtatcaatcagaagtgactgatccctttgactgtggaggaaatgctgttacactttgagtcatgcataccctttgggttatttctggagaggggtagtttcttttcttatccattgaagccacttgttttctgcttggataaagatgtaccacgatttcaaggatgattttagctgcccagaggctctgctaaagccagctcagctaatttgcaatcacatgctgtttacaatagccttaaaaaataattgcacatgtttttaaattcctactgtgaatatatatatatattgaattttaaaaattgaatatacagccatctttatatacatatgaatatatatcagccatctttatatatatatgaatatatatgtgtatatatatactttatttataagtatactttatatatatatacttatatattaagtgtatatatatatatacacacactcatatatatattcacatatatataaagatggcggtctcactgtgttgcccaggcttgtcctgaactctcaggctcaaggaattctcctgcctcagccacccaagtaccaccatgccagcttgtatattatttttatattcagaaataaaattacaaaagatttcccttttttgaaggcattagatcactccagaaatgaaccatctgaaaaaaatctttgatatttatgttgtctcatgaaatccttgtgtatgctttcttcattcatgttgctaatatgaaagtgaagatgcttttgcataaaccctgggtttgacaatattaaaatatatattccattttcttaactgtcatgattgagcttctccagccaaaccaggtgaagtctgaattttaatcaggatctggcatttcaccttggaattaattagctaattccacactagggccaggatcttgagaactctctgcctctgatactgggagtggcatcctgaaagaaaggaactgtctaatctttagtgcaaatgagatttatcctttgtcctgggctctaggacttaaaaaagaatctttgaaattttattcagatcacaattgtgcagtaaaagtgagttgcagagtagtcagaatccccagtttttcaatatgtgacttcagaaataatgtggcataaataccccaaggggtttagactagagtataaaaacatggttttggacaggcatggtggctcatgcctgtaatcctagcactttgggaggctgaggtgggcgaatcacttgaggtcaggagttcaagaccagcctggccaacatggtgaaactctacctcaaccaaaaatacaaaaattatcggctgggcgcggtggctcatgcctgtaatcccagcactttgggaggacgaggtgggcggatcacaaggtcaagagatcaagaccatcctggccaacatagtgaaaccccgtctctactaaaaatacaaaaattacctgggcatggtggcgggcgcctgtagtcccagctactcgggaggctgaggcagaagactcgcttgaacccaggaggtggaggttgcagtgagctgagatcacgccattgcactccagcctgggtgacagagcgagatgctgtctcaaaaaaaaaaaaaaattatctgggggtgttggtgggcacctgaggcaggtggatcccttgaatccgggaggcagaggttgcagtgagccgagatcgcgtcactcactccagcctgggcaacaagagtgagactccatctcaaaacaacaacaacagcaacaacaaaataacaacaacaacaaaaacatggtttaaacaactggcatggggagatacatcctgctcttcctcacagtggatccattggagtggttggttagaaacatttaaggccctaagataaggattcctactaagtggctctatctattcttcaagagggcagctgtgtacaggatgaatcggaaccacagaggcctctgtgtcattgtcaacaaccacagctttacctccctgaaggacagacaaggaacccataaagatgctggtaagaaagtctggaacagtttatcaaatgcaaattggggatcttaaaattattttttattttcacattttctttctgtgacttttatcttccatatacgtgtaaggatgatatcatgtttctgagcctcttatatatccctggggagtcatcagtctgctaaagagtggcaagaatctttgactattcacaattctgaatagaggagagcatgtactgggggagagcctgctggattggcacgagacaacttgggcgtgagctccagctccaccactaactaggtgtgtgatcatgggagagtcaagagaccttggcttcttcaactgtgaaacaggatgaaacactggccactgccgattctcaggactgttgtgacaacactgggtattacgtgataggagattcattgtaagattttatggttatgaaaataaaaataatccaaagctttaggctatttgctgtgcaaattttgtaactattagcattgtttcagttttttttttctttgagacagagtcttgctctgttgcccaggctggagtgcagtggtgcagtcccagctcactgcaacctctgcctcccaggctcaagccattctcgtgcctcagcctcccgagtagcagggattacaggcgtgagccaccacacctggctattttttgtattttcagtagagatggggttttgccatctggccagactgttctcaaactcctgacctcaagtgatccgcctgcttcggccttccaaagtgctgagattataggtgtgagccactgtgcccggccttgtttcagttcttcattttgttttgcatcattttattatttcccctttctctctctctctctcttttttttttttttttgtttttaaacagagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaaggtgagagctcttttttttcttccatttgtaattaattagttttatttattttttattttactctcattcaacacctttggtaagggtgagagttctacgttgttctatccatgtacctgttcaaccatctgcctaccctcctgtttatctatttatccatctatccacccattcatctatccatccatctatccacccattcatctatccatccatccatctgtccatccatccatccatccagcaaccttgtattgagtaccagcctggacctggaaaggaagatacagagttaaaaaaagacagagtccttgccctcaggttgcttacaagctagagggatagacaaacaaatagacggggaagggcatccccagctggtaagtgcacattgtgaagtataggtgttatgggaacatgcagaatgagtaccttgcccagatttgaaggatcagaggaggcttctagaaatgacaaatagatgttaggtaaagaatcaggtgaaagatgtgctgggcagagggaatagcatgaacaaaagcatgggggccttttatttgttcgtttatttatcactcactcttacgtcctgagcacctatgtgctatctttggacttctatttgccactgctctgacagcttcccttctgtctctgccacatgctgtcctcttggcacctttagccatacctagaggccatgggctcctccatgaaaacgtctccaaagttgccatctctggcccactcatctctgaattcctgggggcagagaccctgtttcattcaactttatatcctcagcccctgacctgatatattgtgagcttgttaaacatttgctgggccaatgaatgacttgcttgagcctgtctcattaacatcccgctagatatcctacctctgtttagcccttggacctcacattcagcatgcatgtttctgagctcatcttcccagctctctccaggagctcctactcctgaatttccatttgaaggaatggccatagtgctcttctgggaattcaggattggaaccttgagtcaactttgcttttctctcttctttaccagcccctccattctcatcacagacatcagaggctaatgtctatggcttcaggaacaaggcaatatttattgagagcgtactatgtgcttactgtactgggtaccgaactggggacagggggtgcaactgtgtacaagagagacaaaatctgctctccagggagctaaaagtccagtgaaggaaggacagataataaaaatataagtgaatatttaaattattattattttaaaaattcaacaatattaaaaggagacagtatacatgcatgattaagcaatgtgtggttttttttggtactccagaaatttctgttatttttaattgatacttcataactacatatttcagggttataatttgatgtttcaatacatatatgtgttgtataatgatcaaatcagggtagttagtgtatccatcacctcatgcatttatcatttctttgtggtgagaacctctaaaagcctctcttgtagctattttgtaatatacaacaccttactgattgatcgattgatttaaatatgggatctcaccatgttgccgaggctggccttgaactcctaggctcaagcaatcttcctgccttagccttgtaagtagctaggattatatgctcaaaccacagtgcccagctcagaatgccttactgttaaccatagtcaccccactgtgcagcagaacaccagaggttatttctcctatctaattgtaactttgtacccattgactaacctctcatcttcccttccctccttctctctctcatctttgtaattgctgttctaatcactgcttctatgacatcaactttttaaacaaagattccacatgagtgagaacaagcagattttttctgtgtcttgcttatttcactctgggctcattcatgttgtcagacatgtcaggattttctttttttatggctgaatggtattctgtcacgtataaatatcacattttctttatccatatatccatttttggacccttaggttgattccatatcttggctattgtaaataatgctgcagtaaactgggagtgcagatatctctctgacatattgattgcattttctttgtttatatacttagtatggggattgctggatcatatagtatttttatttttcattttatgaggaactggcatactattttccataatggctgtactaattttcaataccaccaacagtgtgtaagtgttcccttttctccagatctttgccaatatgtgttttcttttgtttcctcgataatagccattctaacttgagtgaagtagcatctcactgtgggttttttatttttatttttatttttttttagacaacatcttgctctgtcaggctggagtgcagtggcgcaatctcagctcactgcagcctctgcctcctaggttcaagcaattcttctgcctcagtctcccgagtagctgggatcacaggcatgtgccaccacgcctggctaatttttgtatttttagtagagacagggttttaccacgttggccaggctggtctggaactcctgatctcaagtgatccacccacctcagcctcccaaagtgctggtattacaggcgtgagccacggcgcccagctgtcactgtggttttgatttgcatttccgtgatgattagtgatgttgaggggtggaagcgggtaagtaggaaaactcccaccacaactatagtgctagagtgaagtagggctgagactggggttgggccttccaaggcggaaggaagtcaggggtggaggccaagttgggctgattttcctgctgctgctaagagaaaaccaattaatggaagaaggttgggggtagggttaaggataagtatttgttgaggctctcatgtattggatgatgagaggaatcatgctatagctaaaataaagccaatgtcaccaatgcgattgtatagaattgcttggagggctgctgtgttagcatctgcttggccatgtcatcagccaattagtagaaaagatataattcctacaccctctcatctgataaagagttggaaaatgttgttggcagtaactagaattaatattgtggtgaggaaaataagtaggtatttgaaaaactgattaatgttcagatctgccttcatatatcatattgagaattctataatagatcaagtgataaatagtgctactagaataaacattatggagaattagtctagtttgaagcttaatgagagttttagggtttggattgttattcaatatcagtttgagatgatggtttcttggtctgtacacataaatgttgtgggaatgaggctaatggtgaaagtgcatgcgacagctatttttacatagtatggatatgagttctttttgtgagggttgataaaggtaataataattggtaaggttaaggagattaaggttattatagtaatggaaaaatacatgattattacttttatttggagttgcaccaatatttttggttcctaagaccaatggataactctcatcctctaaaagttgagaaaactatgttgttaggcatggaggcatgagttagcagttcttgcaaactttatcggtaaataagaagttgcggacttctattattagaccacaatctaacattttgattaaactatatttacaaggtataagtcctataataattttaggatttagagatagtaagagaattggtgaaaggtgtatgagtattagtatgttttctcgtgtaaaggaaggtttaatgctgttaatatagtatgttagtgttccttgttgtgttgtgacaagtatatagagggaataaagggctgtgattaatatattaagtcctataagcatgatggtagtgtttgatcaggagaatgaagccgttgttacaaggagttctcctactagattaatagtggggggtagggcaaggttggtgagatttgctgtaagtcatcaaaaggttactagtggaagtaatgtttgacgtcctcgagagagtaatatgattcagctgtggattcacttgtagtttgaatttgctaggcagaatagtagggacgaagtaagtccatggggaattatgaggataattgcactggtaaaacttcagggggtttgaatgaggatagccacagtaacaagtaccatgtggcttacggaggaatgtgcaataagtgactttagatcagtttgtcgtagacagatggagcttgtcataatatgcctcataaggataatatcaggaaaggataggctatatgttctgtcagagggctgaggatgagggtaagtcgcattttgtgtagccgcccaattttaggagcactgctgcaagtactattgagccagccttaggtgcttatacatgggctttgggaagtcataggtgaagtcagtataggggtatttttactatgaaggccattatacatgccaatcacatgagattgttggatcaggagattggtagttcttgatattaaatgttattattatcatgctcagtgagcctaggatattttgggcataaataagtgtaataagtagggggagggatcccactagtgtgtaaaataagagatatgtacctgcattgaggcgttctggttggttaccccatcgggtgataataattaagatagggataagtgtagcttcaaagagaatataaaatataattagttctgtggctgtaaatgctatgattagaaaaatttgtagggaaattaatatggaaatacagggttttttccataggggtgattcactggagaggtggtactggcttgctatagttataagaggtagtagtcaggctgttaagattagaaggggtgatgttagcggatcagaggagaaagttaatgagaagttgaatagattgtcgttgaattagttaaagaataatagggcaatgaagctggtgattaggctgtgggtagccatattgattcaaattgtataatttttagagagtcatgttattggtagtagtataattgtaggaatagttatttttagcattgaagtaaatttaggttatgtatgtagtctaagccatatatgttggaaattgaaagtagcaaagcaaggcctaccctggctttgcaggcagcaaatactggtagagtaatgggtattacatttgctagggtgaagtgtatatttaaagctataagggtatttactatgaataatgataatattattccttctaggcataggagggatgatattaggtgggactgatagactaatacccccagaagtgatatgataaatgctaatatgatacttatgtaaatagagggcatttggtaagtatgttctatcataatctaatgaaatcatttattttgccttaaactacttatttttttcttatacctgtggaccatttgtatgtcttcttttgagaaatgtctgttaaagtcttttgcccatttttaaatggggttatttgtttttttgctgttgagttatttaagttccttatgtattctaaatattaactccttgtgagatgtataatttgcaaatttttttcctattttgtaggttgtctcttccctcggtttttttttttttttttttttttttgccgtgcaaaagggttttaatttgatgtaaactcatttgtctatttttgcttttgttgtctgtgcttttgaagtcttgttttaaaaatccttgcccaacccaatgtcatgatatgtttgccctgttttcttgcagcagcttcatagtttcaggttttacatttaagtcttacacattttgagttggtttttgtttatggtgagaggtaagtggttagtctcatttttctgtgtatggatattcaattttcccagcaccgttttttgaagagattctcttttacctattgtgtgttctgggcacctttgtcaaaaatcagttggctgtaggtgtgtgaatttatttctgggatctatattctgttctattgatctatgtgtctgtttttataccactaccatgctgttttggtaactctagatttgtagtatattttgaagtcaggtggtgggatgcctccagttttgttctttttgctcagcattgctttcactatttggggtcttttgtggttccatatacattttagggtttttttccctatttatgtgaagaatgtaatttttttgtttgtttttgttttgttttgttttagagatggggtcttgttatgttgtccaggctagacttgaactcctgggctcaagcaatcctcccacctcagactcctgagtagctaggactacaggcatttgccactgcacttggcttgtcactggtattttgatagggactgcattaaatctgtaggtcaccttgggtagtatggtcattttaacaagattattcttctaacccatgaacacgagatatctttccatttatttgtgtcctcttcactttctttcatcaatgttttatagttttcagtgtttaatatttaagttaatgatattttaattgtttaatatttatttaataattttattattcaattattatttaatattaatttaaataatatttaaattaataagaaaaaattagccaggtgtggtggcatgcacctgtagtcctagctattagggagtctgaagtgggaggattgcttaagcccagaagtttgaggctgtagtgaactacaatcgcattaccgcattctagcctgggcaacagagcgagatcctgtctctaacaaaaagaggcaatttcaggaagtgatccctgccatgaacaaatcaaaacaggataatggtagtttcttggtggaggtaatatttcaggtgagactaaatgataagaaggaaacagacacaggaagatttgggaatagagagcaggtgcaaagcaagatgcagggattgagagcaggtaagggcctgcatcccttccctgaaaaatagtgatagttaaggatgaggggatgagagtagtcatactaatactaaaaatgatggtcagcagaacagtgtagccagtgttctaagtgcttgacccaatatacatcctttaatgctctcggcaacccctaagatggggactgttatggttcctattttagagctgggaaaaccgaggcatggagcagtgagtaaccagcctaagagcacacaatgaatgaatgatggagccacaatttaaaattgaatgtgttttcagaacctgtgcttgcttccagtgatatgtattgcctaccctgagaacgttctgctaaatgctatatgtcctgcaagcccaggctcaaatgctaccatctgcatgaagccttctctctccctcccaaccagaaatgcattctcctctgaacttgcagtggaaccttgacctttcatttggtgttgaccacattctgccttgtgttatgaatattgtgtatatgccatcctcggtaaatgtttcatatctgcattctaagtggttaacttcaggaattgtgtcatgtctatctttgtatctctcccaagactacagatagagagggcattgttggtatctgtggcatctgctgcatatttgttgatctaagacctggtacatggtacctggtgtcttttctaagacctggtgtgtggtttctacctcctgactgaaaaaagtttcttctctgggccaggcacagtggctcatgcctgtaatcccagcactttgggaggccgaggtgggtggatcacctgaggtcaggggttcgagaccagcctgggcaagcaatatggtgaaaccccatctttactaattagccaattgtggtggcaggcacctgtaatcccagctactcgggaggctgaggcatgagaatcacttgaatccaggaggtggaggctgcagtgagctgagatcacaccactgcactccagcctgggcgacagagtgagactccgtaaaaaaaaattttgttttcttctttgttgcagacatgaagacatcttatccatcctcactgctgtcaacgatgatgtgagtcgaagagtggacaaacagggaacaaagaaacagatgccccagcctgctttcacactaaggaaaaaactagtattccctgtgcccctggatgcactttcattatagcagagagtttttgttggttcttagacctcaaacgaatcattggctataacctccagcctcctgcccagcacaggaatcggtggtctccacctgtcattctagaaacaggaaacaccgtgttttctgacacagtcaattctgattttctttttcttttgcaagtctaaatgttagaaaactttcttttttttggagatagtctcattctgtcacccagactggagtgcaggggggcaatcacggctcactgtagtctcgacctcccaggctcaagctgtcctcccgcctcagcttcccaagtagctgggaccacaggtgtgtaccaccgtgcccggattttttttattctttattttttgtagagatggagggatctcactttgttgcacaggctggtttcaaactcctaggcccaagtgatcctcccacctctgtccccaaaatactgggattataggcacgagccaccacacctggccagaaaactttcattattgaagacttggattgtagccttggttttggatgtctattctgaagacagagtaattggctttggtttgtgcaggtactttttctttgagacagagtcactccgtcacctgggctggagtgcagtggtgggatcactgttcactgcagccttgacctcccaggttcaagcgatcctcccacctcagcctcccaagtagctgagactacaggtgtgtgtccatgcacagctaactttttattttttttgtggagatggggtttcactatgttgcctaagctggtctcaaactcctgggctcaagcgatcctcccacctcagcttctcaaagttctgggactacaggcatgaaatactgtgcctggcctggggaccaggtgcattttaaggttccttggtgttcaaaaaccacgttcttagcctagattgagcttagattgcctctctagacaactaccccttagttataattctgtgtcccctctgcatgcccttaaacattggacagtgaggtcacagtccacccaccctctctctgatctcccccttcctaagacttctcttttgcacatctagtgaggtgaaaatttggtctatgccaggcccatttcctgcttttgtgtaaggaaggtgctcacataggaagtttttatttggttagagacaggtttccctgtaggaagatgatggctcatttacactcagctgctctgcaagcagaaactttacaacctgatgtcatattccattttggactgggtgcggtgactcatgcctgtaatcccagtactctgggaagccaaggcaggcagatcacttgaggtcaggagttcgagaccagcctggccaatacggcaaaacctcatcattactaaaaacacaaaaattagccaggtgtggcggcgagcacctgtaatcccagctactcgggaggctgagacaggagaatctcttgaatccaggaggcagaggctgtggtgagccaagatgacacaactgcactccagcttgggcaacagggcgagaccttgtttaaaaaaaaaattcaatattggggttggaacatttcagttgccattgacagaacacccaattcaaattgactgaagcaaagaagggaatttattgcctctttcacattgaaacccaggagtggataacactggcttcaggcaaagcttgaatcaggactcaatctacaggccagcacctttctcttggccggatgtcctcagggctggcagatgcagtagactgcagtggacagtccccaccttgttactgctactacactttgctcctctggcccaaggcatgaggagagaggctgtgtcagaaactgaagctgttctcaggatcactgggctcttcttggcagaggggatgtctggcttgcctgaagggagtggctctgtaaggacgccttgatgctttcttcattaagattttgagcatttttacgtacttgagcttttttttttttttttttcaatttctagaggaactttttctctgttaattcctggaactgtattttgaatccttaaaggtgagccctcatagggagatccaaagtcctgtggttaacgccttcatttatagatgaggcagctgaggcctggggatgtgaacaacctgctcacagtcctcatttactggatttgacttcagccaggtgaactggaatgccttggggcgtggaagggcattaggagtgtttcatttgatatgtgaatgctcataaaaaaatgtcaaggaatgaagaacaacaactctcagtggtgcctgcatttataattatttatgtgaaagtcaaattcatgtacagtaaatttgttataagaatattcacaagaacactgttctgatatctctgattgtcatgtggatttgaatgtagcttgacagagggaatgtctaatctatattgacagggcaggaacaccgtcatcttagacaaacaccgccactttaagttccagttccctttctagcctcatgcatttcaaggaaatcacttcttttctaacagcgagcagccagaaagagaagagagtaaaatacagataagacagctctggcatagagggaggtgggggggtgggggaagtctcttgggtaactgccaaactttgccttcatacaatgggttccaggaaaacaatgagccttaataagcacattcctttcccttcaggtgcactaagtggggaagctaaaagcagactggaggggggtggggtgtacctacagctgcagaaatattgtatgggaacggacacacaactctccctcccagataagcacagcaaagagacatagaagcaatccaagcctctgataaactctcccaccctaaatccttaaaaactcttagtctgtaagtgagtgggctctgacctaactcggccagaagcccctttcaaatttgttttctctaaaataaacctgtccttggctgtcaagccacctttcatgtttctttcctctttctttaattcttacacatgtgtcaggatgatctcccaaaaccgtgttcataacagtcagggccaaaagctagtggtcacagtccttgtccagttggcagaactgacatgtgaaggcaagtgaaggatggtgagatactgaggaaagagcaaaggatctggagatcaaagccctgcatttccattttgtcctgattcctttgctcagagacactaactaaatcaagctagcttttttcagccttgtctgtaaagtagagaaaacattagctgttgggaagacgaaaaagaatgtgtcctatgtgtgcatctatttaaatctaactgtgctgaggtgcatataaatgcctttaggtggtagggtcttccggttgtaactgcaacagaaatagcaggacttaagttcctttgtgcgtaattccagctgactttattagcggcaactcagcactagcattacccctgacatactctgagtaagatctaattcttccctcactggttcgtgatgtctaccgcagcagaaggccagctcttgactctgagttcagttggacaaaatgctgttgataaaacctcctgtcaggcctctgagcccaagctaagccatcatatcccttgtgacctgcacatatatatccagatggcctgaagtaactgaagaatcacaaaagaagtgaaaatggcctgttcctgccttaactgatgacattaccttgtgaaattccttctcctggctcatcctggctcaaaagctcccccagtgagcaccttgtgacccccatccctgccagccagagaacaaccccctttgactgtaattttccactacttacccaaatcctataaaacggccccacccctatctcccttcactgactttcttttcggactcagcccacctgcacccaggtgattaaaaagctttattgctcac

SEQ ID NO: 1768 - DNA, 38764 bp, Homo sapiens; identical to SEQ ID NO: 1767

SEQ ID NO: 1769 - DNA, 38764 bp, Homo sapiens; identical to SEQ ID NO: 1767

SEQ ID NO: 1770 - DNA, 38764 bp, Homo sapiens; identical to SEQ ID NO: 1767

SEQ ID NO: 1771 - DNA, 46510 bp, Homo sapiens; identical to SEQ ID NO: 1766

SEQ ID NO: 1772 - DNA, 288889 bp, Homo sapiens
ggggaagggatgtgtgtcggtgtgtgtggagagggtgctccttcgctcctgctttcccggctcggtggggtcccttcgcggccacccggggagacgtcttagacagtcgtggttcctgtgatctgtgtcctctttgcagaaggtactattgggctgggttttagacgggcaccttgcgagcggatcggcgagttttaattttccggaatgcgctgctgggggctgcggtggcaggcctccggtcttttggtctattttaggcctttctggtgttgagagcttccgaggcctgattcctttgcctgttgcccgtgctgctcactttgaaaacaagagtgtttcggtggaaggatttgagaacaaaatgctggggcaaatggacattcgtaagaatcactctcctcaggccccagctgttcgctaataatttttaaaaatgtgtttagaatcatgagttaatctccactgtgaatctttgcccgcagacgtcagggtttatatttttcctcaactaccagtaatttctgcttcactggtgttcagttatggtcggggaagagccaggcttcccctttcgtgttaacaacgctgttgagtcgaaatgttaattttaatgttcttttttaaactgcaaattaagcatgtatgagtgttgggggaagggcaatggaagttcatggctgaaggtttcaatttcatgccaccttccttgagctctgtctgagggaaggtgtcttatctggcaccccggatagcaggcatttctctgaatgaagaagattcacaggtcccagtggccccatagtggggcagaagggggctatgctttgacatggagctctctcccaggagaggagaagacctcaccagctacaggcctctgggctgctgccttcctgcagcttttccatggaggaggccaggagtggggaggcccggaatggggagcccagtcggctcccagtcggctccaagctgtccagtctggcctcaacccgcaagtgtggggatctgggcttctatcctgtagggcctggaatacgacgaggctgttactttcactttgtggctgtccaaaaagatgctgcctcattcagtgcaccagctcatggaggctgagtgtcccactagggcttctagactccaacaaggataatggtggccttgggtgctgtatccattgctgacctaagttgtattctcctatgcctgggtaccatgtccagtgtgtaccttgggagcagaaaagagaggggtctatatactcttaggctatggatgagttctagaaaataatagtggagaggagagagagaaaagaaggaagaggaggaggagaaggagaagaagagaaggaggaggaggaaaaaagcaggaggagaaagagaagaaggaggagaagaataatagcaaaggaaaaggccaaaagaaaaggccaagtgggtggaggagggaggagaaggaggaagaggaggaggagagggagtctcctggtctcctggcttttgaagggctgcatgttaccaatcaacaaatatttgatgtcacctgcctccaggcctggtcaccttgaatatcctggtgtgggctctgtaaccttggatgagtactctccccagtcggaacttagtttctccttctaaaacctgagggggttgggctagaccacctctgggatctttcctaggattcagcatccaggaaggtttttcttgaagtgacggtcgttgacgacctacccatcagactcatgtggggcaggaggcggggggctgttttaaaatgcagattcctgggttcatcctagaccttttgaacagtcttgggggaaggggcccagaaatccacagattttaaacctcacaggtggttctggtgcccacccaaattggagaagagcttttcctttcacttgagctaacaaaaccacagaaggctgttgctcagcacctgccctgtcaaaactcatggaatttccatgtttcacaaacatggaaaacgtgcacagcactttattagggtctaactatcgcaaagattttattgggcaggtgttcctccaggggtaagatcaagactttctatggcattttgaggtgggaatggagggcccccaaactgagcagaaccacttccagctgccaaaagatagggacctggggctgtgagcctacaaggctatggggagatggcccttcactgggtcctgctagatacaaacaactgtctgaatggcccatttgaagcacatggtcagctgctgtggtgtgtggcatatctttaatatttaaacaaagtggccgggcgcgggggctcacgcctttaatcccagcactttgggaggccgaggtgggcagatcacgaggtcaggagatcgagaccatcctggctaacacggtgaaaccccgtctctactaaaaacacaaaaaaaaattagccgggcgtggtggtgggtgcctgtagtcccagctacttgggaggctgaggcaggagaatggcatgaacctgggaggtggagcttgcagtgagccgagatcacgccattgcactccagcctggggacagagagagactccgtctcaaaaataaaaataaaaataaaaataaacaaaatgaaattaaattttctgaaaaatggaggaggtgggtttgagaccagggaggatccccctcccctccagagtgctgccaaatccaacccctcctgttgagagatggtgcagctgaggcacagagagggaaagccacttgttcaaggacacacagccctgcagcaagagcattgggccaagatcagcccctgctgtcacggctggtgttcagggagcaaccacgagccccttatgttagaaataatagtcaaatccaccatatatattatccccccgcaccaagatcttaaggaaaggataaacctcagctctcatttgaatgggggcagcaaaaataaattgcgtcttattttatttttattttgaaacaagggctggctctatcacccaggctggtgtgcagtggcccaatctcggctcactgcaacctctgcctccgaggtttaagccatcctcccatctcaacctcctgagtagctgggactacaggagtgcaccaccacgcccggctaatttttatactttttgtagagatggggtttcaccatgttgcccagtctggtctcaaacttgggagctcaagtgatccacccacctcagcctcccaaagtgttgggattacaggcgtggaaccactgcgcctggcagaaaatgaactttatgacacaaacaagggccttggacatcaaggtagatttctctctctctgacacacacacacacacacacacacacacacgcacacacatctcattcagtctgaaggatccagagacaccattagcttcatatgaatctctcctctcccacagcctgactcatccagtttcataattttccctatctgcttcttttttactgtgtttctccctgatgctgatttacttttaagaattgtagtttctggcaacagaggaaagatcctcaagaatcggcaaagtgagtttaccccttggccagtgctcatgtgtagggtagcaagaatttcaaggttcagggtttcaagtgaatttttctctgcccataaaagatggaatgcattttcagctgtttcttgggtaccagctggggtttgagtttcaatttcatggagggcagctggattaactgttgcgttgaggtagagatggttgcttgatgggattaaatgtctcattcacgcttaatattccagtgagcttgggcgtgagttattagccccattttacaggccaggaagtgagatttggagcctggagtgaccccaggttatccagggtgaaataaaagcaggactgaataccttcctgccagagactggactgttcagcataatgtaataaacaacatccgttgagataataaattgtgtggcattgtttcacagagacagataagaaagctttttcacattcattacctcatttaatccactgatgatcaaggcaggtagtgatatagtcccagttttatagaagaggaaactcagcatcagagaggtttagtgacttgcttttctgcttgtttttctgccaacagtggatgactcattttttcagttctttccctgttacacctagttattattcaaagcaaagatgatattgccctcttcttctcttgatgctccttcccatttgtcatgattcttccagaccagggttctagaccagtgtcagcgtagacactattgacatttgggttgcatatctctttgttgtggacctgtcatgtgcttggaaaaatgtgtagcagcatccctgtccttgacccagtagatgcaggtagcacctcctctccagttgtgacaacccaaaatgtctctaggatgtttccaaaaatgtccattggcaggcacaatcaccacttggtgagttctgtcccacacaactttctgcgatgataggaatcctctgtatctgtgctgtccaacatggtagccatgaaccacgtggctcatacaactgagacgctaaatttttgatttaatttagttagaattcatctaaatttaacaagccacctgtggctagtggctactgtattagtacagctctaggtagcaacacagtagtggatagaaaattagccctttgaggctgggcgcagtggctcatgcctgtaatcccagcactttgggaggccaaggcaggcggatcacgaggtcaggagatcgagaccatcctggctaacacggtgaaaccccgtctctactaaaaatgcaaaaaaattagccaggcgtggtgatggacacctgtagtcccagctactcgggaggctgaggcaggagaatggcgtgaacccaggaggtggaccttgcagtgagccgagatggcaccactgtactccagcctgggcaacagagtgagactccgcttcaaaaaaagaaagaaagaaaataaaaaaagaaaattagccctttgatggagcactcaatccctaaaatcagtcaggggaacctgttaccaaaagtctaaccagcttcttgcttcatggtggccgggaaacactaggttggaaatggcaaatacttggcacaggttccatccctagccattcctatacccgtgccagacattgctagtcaatcacagcatgctgtcttgttcagcccaggcacagctcagaatgtttctcaatacaacactctgggcagcccccaactacagatcagttggtgctggcaggtgaaagaaacattattggccatcctggcactcagccacgaggcccatctgtgaggtccagcatctcatcagcctgtaggagtggcctgatgactcaccgggtggccaggagtgtgtggccagcctaggtcagtggagcaaccatgatacagagaggggagagccaatgggctggaggagctgagattttttttttctaatttctcatagaaacacccactgcatgatttagcaatggaggctggcagggtggggtgaggctactggctggtcagccactgatatgcaaagcatttgaagattttaatctgcctgggactgaatctgagtcaaccggggacatagctgctgccaaggacatggtaataacgtcagaaatggctcacaggcctacggagcatctagtactcaaaccgctccgtgaagtgggtgagaaaaactgcatccccatttgacagacagaggagttggtgacctgagaggtttgacaacaggcatagtgaggcccactcttagatctaagacttccagggctgctgtggacccatggaaatgcaggaagcctgctgtgtgtaccctcatcaaccctttgcagagtgaaatgtccacttctgcggcagaaggcaggttagagaagtcccaggagactgagcattgttctgaagaaactaggagccatgtcccctgagaaaaggctgaaggtgacagatgagaaaactgggggcggattccatcatttcagttggaaaaggggttaacctcgttgtctgttgttccagagagtggaactgaggccactgtgtgactgtcctggggaggtagctctctgagaaggaagaaaaagcatcagactttactcattgggacatgaggaccttagttctgctattgtcgctgtaggacctcgagaaagtcacttcccttccctggtctatggatgccaggatataggagaagtaggttttgtggcttctgagggcctttcggagctctggttccaaggaagaaacacaattagagcagactccaaatgtcctatgtattagtgacctccctgtcaatggacatgaccaagagggaactcattgactgtctatcctggaaattccttgtgaagtgagctgggtctctggggtttctccatgtgtaaaggccccaggttctgatgctgaggggcatttctggcagccttcacacctgctgctccctgcccgccattcttcttcatctcaccaccccatctgcttttctcttccttcctccctccctcttcaacatttcattttccctccatcaaccttcctgcccttgcttctcactcatccctctccctttctcaccttcatgtgtattgttgtgagcacggtctgaatccctggctatagctggctgtgagccacccttgccctgattagggagaggatctgtgtgctgggcaaagtcccttttcattattgcctggctctttggccatcaaactccaggcttgggtgaagtaggctggactttgtatggaatcatgagtctcttttgtccatttagcctgtggatggcaatagatagcacttatgccccattccctctttccacgcccagggcagacattaataaacaatcagagcacccttcttccactcagcccagataaaagctcacagtccttcccatgtaacccacgaggcagccactatccgtctatcaggattgatatgtgaattaaaacctacttccctactgactgtatcagtcaagggcccactagaaaacagcaccctcaactggtatcctggagagcctttttaatgaaagaactctcccaagaaatgtgtgcagggttaggggaaccaacaaagcatgttgaagccctcagagataagcagtggtgggaataccttactagccttggggctgtatgggacaagggagaggaggggtgatttaggaacacagagatagctggagttggtggacagggaccacttgaagggtgttgtggttgtagatggagaaacacagcatttctaaaattagggcctgatacagagagaggtgggtagagtgggaactaaataccttgaccactagttcctctcatatgcaggtcctcccagagccttccattggccaaacgaggggaagccagagagcaagagagcctgggggtagggagcacaatgcctagtggtcagctcctggggcacacagcagtgtggcctgaaggtggcccttggagagggcatgccacgtggatgtcagggcggtcgtcttgttccccattactcaatcctctcctgggacgttcttttccttcttggggtgaggcagctgtaaagtcagggctatagtagggtgcagagggctcactccagtggggccatttgaggagtttaggaaaaaaactgtttaccaaagtaggggcaggatgcaatggtagcattaaggttaacagtcagcaaatgacagcccacggccagatccaactctctgcctggttttaaaaataaagtcaaattgaaacagccatgcccattcatttacgtactaagtatggctgcttgtgagccgcaagggtggagctgagtcattgtaacagagaacctacaggcctcaaagctcagaagatttcctatctggcgctttacagaaaatatttgctgccgcctcctttaagggatgctgcagcactttgaggatagcaacagtgaagctgttacttttctgggcctgaactgtcagaggagggagctgctgccgcaacaggagaggggagagagtggagagaacagcctgaaggcgcctttgggagagggaggaaggcaaccatggtcatccaggagggagagtgagtgaagacacagatgccctctgatctcctactagtggatgattcccattagcttaacccacctggaagatggaaagtgagggagtccattggaagagtccacagggtcagcagccagacatagagcaaagtagaagagatggagggggaatctgaagatggtgtcttcagttctccagcatcctttttttccctcgctgtctggcctccgatatgaccatcacagaaaccaggtgtcaggcagtcagatcattcctgctgagcatctaagctccatgctggtgttctcactggccaacccctctgcctgcctccaggaaccttgtggaacagctgaggaattacatgcttacactcaccaaccagactatgggcaagacagaattctaaatgaagatccaattaataaagaaccaaatagtgacctaagccttgtggccagtggaggggagggcaggtgacagcgggtgtttgggtggaggctgcaggaggctgtcatagaatcctgcagggtgacattggctggcaccctcaggcatggtgtcatggaggaaggtgtccccacaggcacgtgaaggatggcggagtcagagccaggaaggggaaggaaacagcttttattgagaagctgctgtgtgccaggcacacgtggcagtccatgctgggaggccagtgtgctaaagtggctgtgagctcagcctctaaagtcagaccatctggtccacgaatcagccccaccacctcctggctgggtgcaagacacatcccctccctctgcctgagtgtcctgagataagagttactcagagaatccacctcttcggatggaaagagtaaatgatgtgatctacttaagtcctcagtattgagtaatgcagaaatcctagtggtaccattatccatagccctgattttgtcgtgtcccctcctgctagggaggaaggacagaaatctcagagtggaacagaaaaaatacagggatttaggcacttaggttatctttacctcctcctgtgtgaccttgatccaatttgttaacctttctgatcccaactaccacacgccctgtgctgtgactaacaccaaacagatgctaagtaaataccagtgccccctgcacactctgccctacccctgaatgtacctacttgagccagcttcctaggcttccacagcttgccaccacgacatagggcacgtctgaggcttggcctggcacccacagattggtcctctcttatcatcactgatgtggagctttgatgggaagctgagcatgtgtgggaggagtcaggcacaccttggggtaagtctcaccttggctttcttgctgggggacctcagacaagtgtctcgacctctctgagtctgtctgttctgtgggagtgatgccaaccatgtggtcctattgtgggaatgaaatgtgatcatggattttaatataatgaaattccaggtccagtaggaatataagggtcatgggggagtttaggagtaaggatctatatcggtgcttggcacacggttggttctccctaaatgttctgtgaattgtcttgtgctgggtgctgggctggggtcttcagtccggttttaaccgtggagtaaagggaaagtgaaaatctgattgagagaggttaccagggatccagcacatgcttgttatgtgggtgtcctctcactgcacggctaggaaaactgaggctcagagagctccctggggtgtcaaaggatgtgaactcaggccatgataaacatgctttcccattatgtgtggatgcagacagcacagggggacatcagaaatctctgcccacagacttgctgctctgtcccttctcaggctcatttctaactgttcattcattcacctacttattcatttgacaaatatttaacttttattttaattaatttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcacaaagtgctgggattacaggcgtgagccaccgcgcccggcctttaattaattttttaagagacagagtctattactgccacttggactggagagcagtggcgtgatcacagctcactgtagccttgaactcctgggctcaagtgatccttctgcctcagcctcctgcatagctgcaagccacagctatgcagctgccactacacctggctaattaaaaaaaaatttttttagacatggggttgagaggtgacaacatgctagcagcccttgctcgctctcggtgcctcctccgcctcggcgtccactctggccatgcttgaggagcccctctctaggctggccgaggccggagccggctccctctgcttgccgggaggtgtggagggagggacgcaggcgggaaccggggccagtgcgagttccgggtggtcggaggctccgtactcggagcggccggctcgcgccgctagccccggacagtgaggcgcttagcacccaggccagcagctgcggagggtgcgctgggtcccccagcactgctggcccgcccgcgctgcgctcgaattctcaccgtgcctcagccgcctccccgcggggcagggctcaggacctgcagcctgccatacccgagccccccaccactggttaggatcgcgcgcggccagagcctccacggcaccgcgtcccatggactgcccaagcgctgatcagtgcgggaagctcagcccgtggccccagcgcaagatccacaaggcgaccccagctggcctcccggtcggcaggggcgggtgtggggggggcgggggttgctggattggagaactttcatgtctagctaaaggactgtaaacgcaccaatcagcagtctggcactctgtgtctagctaaggatttgtaaacgcaccaatcagcaccctgtcaaaacagaccagtcagctctctgtaaaacggaccagtcagctctttgtaaaacggaccaatcagctctctgtaaaatggtccaatcggcaggatgtgggtggggtcagataagggaatgaaagcaggctgccagcaccagcactggtaacccgcccgggtctccttccgcgttgtggggtggttgtgttttcgctctttgcaataattcttgctgctggtcgattgttgggtctacgctgcgtgtgtgagctgtaacactcaccgcaaaagtctgtagcttcactcctgcagcaggcgagaccacgaacccatcaggaggaacgaccaactccagacgcggtgcctttaagagctgtaacattcaccgcgaaggcctgcagctttactcctgaagtcagtgagaccgcgaacccatgagaaggaagaaactccagacccgtccgaaagtcagaaggaacaaactctggatataccgtctttaagaactgttaacactcactgcgagggtccacggctttattcttgaagttagcgagaccaagaacccgccaattccagacacagggtctttatgttgcccaggctcttttggaactattggcttttaagtgatgctcctgtcttggcttctggaagtgctggtgtttcaggtgtgatctgctgtgcctgaactaacaaatgttgattgaaagctaagtatgtgctaggcactaaggactacagtaagtgaagagaacgcgttgagaattctggccttcataggggctgctctggaggaggagtagggtgggattgggagttaagctgcaatttaaatagggagtgagcacaggcacattgagaagactttaggtgacgatgtgagccatgcagcaggaaaagcatttgaggcagagagaacagcatgtgcaaagttcttgaggtgagaatgtgcttggaagggcgtatcctggaggtcagtgtaattgacagggaggatagaaagggagggtcgctaggacaggtggttatggcgggggcgctacaaagacttgggaatgtattctatgagacaggtgctatgttacaactggacattgtggggtagtgggggaaagccttgagggtcccatggaaccactactcagatccagtatgtgtacgcggaaaacagtttcaagtcatctcctggctttggggttgcgttttctctccccagcctctctcccctttaaggggagactcgcgattttataccgtgaattccaaatgtctatggccacctcatgggcttaaaacagcagctgacgaggcaggtgtatgttttgggcccggaccggagtatggcgataagaacacttgcttaaattaagtcttgacaaaacctccccggcgggattggctcctggccctgggtcagtggagctggcgcaggacctctgagggggcaggacatgaggggtgaggccccacatggggttccctcgcattgtccctttctgctaaggccctctgggaaggctggcagcctcagggctaaggacagcccctacgacagccaggattccccctggagcccgaagctgagggtgattcttgggaagcggctgctgacgtggccaggcctgggctggagaggaaggcgggtagtggcggccaaggcagccacctgacgtcaggcctatttataattcgggctttgctccttaggcatggagtctgtgagtcactcgggggcctcgccagtgtctcccaaggggacgacgggaggggagggtgtctttccttctcttctttcccccatcccctctccccttttgtccaccctcccagcttcttgtgtctttttaaattaaattttattttattttttttttgagacagagtttcactcttgttacccaggctggagtgcaatggctcgatctcggctcaccgcaacctccgcctcccaggttcaagcgattctcctgcctcagcctctccagtagctgagattacaggcatgcgctggcacgcccatctaattttgtatttttagtagagacgagctttctccatgttggtcagtctggtcttgaactcctgacctcaggtgatccgcctgcctcggcctcccaaagtgttggagttacaggcgtgagccaccgcgcccagccactttcctgtgcctttgtaagctggagatctgatacaatttgaatgtctgttccctccaaatctcatgttgacgtgtcatccgcagtgttggaggtgggacctagtgggaggtgtttgggtcatgggggcagatgcctcctgaatgtcttggtgcccaccctgggttaatcagcgagttcttgctctatttgttcacgggacagctgcttgttcaaaaccagtctggtacttccctcctccctctctctgtctctcgctccctctctcatcacgtgatgccagctccccttctcctgcggttattggaagctccctgaggcctcagcagatgcaggtgcaggtgcagtgcttcttgtacagcctgcagagctgtgagccagttgaacttttttctttctttcttttttttttctttccccccacccccgttgcccaggctggagtgcagtggcacgatgtcagctcactgcaagctctgcctcctgggttcacgccatacttttgcctcagcctccccagtagctgggactacaggggcctgccaccacgcctagctaattttttgtatttttagtagagatggggtttcaccgtgttagccaggatggtcttgatctgacctcgtgatccgcctgcctcagcctcccaaagtgctgggattacaggcatgaggcactgtgcctggccaaacttttttctttataacttactcagccctagatattcctttatagcaacacaaagcagactaatgcaaaagcccacactgtgggaaactttttcttaaggtaaagacttcgctgttggcacttggacgtgtatttgtggcctcccattgggcatgtgacctcattagagccgaaatgctccttggatttttggatcctgggatttcactcctgcagggctgcgtaggcatgctgaggtctcagctagtgacatgctgataggcgtggaatggccagctcccagaataaaagacctgatttgtagcatttgccaatttccgtggtgtaaacactcccatggctgccgttaagttatgaattaggctttgctgaatgcagacttggaaagagatgttcacaatggactctcagaagatgaatagtgggggcttcagcacagcagcagggaccagccaactcttgggctcaccagcttccaggatgtgaaactgcctaagcagccttcatcttttcatctcaaaaatgtaccatttctctgttttgggaacattccatgtccttctatttgaaactatatattgttggctggatgcagtggctcacgcctgtaatcccagcactttgggaggccgaggcaggtggatcactttaggccaggagtttgagaccagcctggtcaatatggcaaaaccccgtctctactgaaaatacaaaaattagccaggcatggtggcatgtgcctgtaatcccagctactcaggaggctgagacaggagaatcacttgaacccaggagatggaggttgcagtgagccgagatcgtgccactgctctccgacttgggcaacagagcaggactgtctcaaaagaaaagaaaatatataatattattgttaactatagtcatatagtgctatagaacactagtacttacaaaagctttacatacgcctcttatatggcatactattctactctaggtatcaggcagggaatgaaaatgcatgtccattcaatacttttgcataaaaattcatagcagttttatttataatagccaccttctagttaagtcactgaagggcagctacttccaggcttacaaggccttgaagtcctggtcaggccaggtgcagtggctcacgcctgttatcccagcactttgggagccgagggtcggatcacaaggtcaggagttcgagactagcctggccaacatgacgaaaccccatctctacaaaaaattagcgggcgtggtggcacgtgcctgtagtcccagctactcaggaggctgaggcaggagaattgcttgaactcaggaggtggaggttgcagtgagccgagaccgtgccattatactccagcctgggcaacagagcaagactgcatatcaaaaaaaaaaaagccaacaaaaaaataaaactgctggtcagtggttactctggcagctgggatggagggtgggtgtctctcaggaggggtcagtgaagcacattgctcagagggcccggccaaccagagctagaagtgagaaaagccaaaggcagaagagacaccttcctccactcaagaccgcttctactaagaccttggtatatttcctcccacttgattttctacaggaagtgttttgttcattttggacagctctggtgtgtgcaacattgtactcaatcttactttacaagctgagacaagcacctttcaatgattctgcaaatgtttcccaaacaactctcacacactgcaggggtggggatgtggaaaaagatatagtcactttggaaaacagttggaaagtttctttgttgttttgtttgttcgtttgtttgtttttgagaccaagtctcactccattgcctaggctggagtgcagtggcaccatcttggcttactgcaacctccgcctcccggattcaagcaattctcccacatcagcatcccgaatagctgggattacaggtgcctgccaccacaccaggctaatatttgtatttttagtagagacagggtttccccatgttggccagcctggtctcgaactcctgacctcgggatccacgcacctcggcctcccaaaaggttgggattacagatgtgagccaccacaactggcaggaaagttttttttttttttttgaattaaacataaaattattatactacccagcagtttcactcagaagaacctatgtgactttgtagcgacattattcgtagtgcccctaaagtggaaacagtctagctgctcatcacctgttgcatggattaagaagaaaaaaaaaaagcaaaaacatgtctatccatgcaacaggaatgcaattgagcaacaaagtaatgaggggccgacgcacacaggagcgtggatgaatgtcaaaaacatgcaaagtgaaagcggccaggggtaaatgaccaaatactttatgattccgttatagcgaatgtccaaaaagggcaaatttatagggatagagagtagatttgtggttgcctggggctgagagagggaacaactagtgacagtaaatgggcatgaaaagaagagtttttttgggggtgatgagaattttttttttttttggagacagagtctcactctgttgcccagactggagtgcagtggcatgatttctgctcactgcaaactcctcctcccaggttcacaccattctgcctcagcctcctgagtagctgggactataggcacccgccaccatgcccggctaattttttgtatttttagtagagacggagtttcaccttgttagccaggatggtctcgatatcctgactttgtgatctgcctgccttggcctcccaaagtactgggattacaggcgtgagccaccgcgcctggctggggtgatgagaatttctaaagttagattgtggtgacaattgcacagctctgtaaatttattaaaaatcaagttgaaacttagctgaatgttatgacatacaaataataccccaatataactttaaaaacaaatacccaaaggattataaatcatactactataaagacatatacacatgtatgtttattgtggcactattcacaatagcaaagacttggaacgaaccccaatgtccatcagtgatagactagataaagaaaatgtggcacatgtaatactatgcagccgtaagagagaatgagttcatgtcctttgcagggacatggatgaagctggaaaccatcattctcagtaaactaacacagaaacaaaaccaaacactgcacgttctcactcaaataggagttgaacaatgagaacacatggacacagggaggggaacatcacacactggggcctgtcgaggggtgggggactaggggagggagagcattaggagaaatacctaatgtagatgatgggttgatgggtgcagcaaaccaccatggcacgtgtatacctatgtaacaaacctgcatgttctacacatatatcccagaacttaaagtataataaaaataaagttacaactttggctgggaagtaacaggtgtaaataaacaaggaaatatagtaattgtatggagatatggcaagtaaaaacaatgcttgctaaacactctttttttgatggtttcatactgttactgcgaattggaggtactctaatttatttgacattctctagttatcggacttcatgtctgctctttcaatgctacagtcaacatggtgatgaaattttctggtttaggattacttcctcaaacttgtttcccagaaaagggctttctgggtcaaaagttatcaaaattttctaaggctctcaatatgatgacaaatgatttctccaagcgtgggacagattgagagctacagtttcctgcccttacctcatcttccaactatggaaccaagtattcccttcacaaagaaaacccatgattcatggtgttagaagtcagaatagtggtttcctggctgggcgtggtggctcatgcctgtaattccagcactttgggaggctgaagcaggcggatcatgaggtcaggagttcgagtccagcctggccaatatgatgaaaacccttctctacccaaaatataaaaaattagccgggtgtggtggcatacacctgtaatcccagctactcgggtggctgaggcagaattgctggaactggggaggtggaggttgcagtgagctgagattacactactgcattccagcctgggcatcagagcaagactccatctcaaaaaaaaaaaaaaaaaaaaaaacacaaaaacaaataatagtggtttcccttcaggaaatattgaccagaagggagcatgagggaagttctaggtctctgtttactttttgatcaagctacaaggcttttcctaagcaccagaaggttccctcatgcttcttcccaaccaaaagcgaatggctcctctgacttcctttaccatagattagatttgcctgttcttgaacttcttataaataaaattataacttttaaatcttgatcagggtgctagttatattggtgtgttctttctgtaagagccactgagctgtaccttatgatatatttttctggttgtataaacgtgtggggccaagaggaagaatatttcagggcactgttcactccgcggcctgcagggtcctgcctgaccatcctccttgcagaggtagctgacagtgtctgtacctgactgtgcccattcccccatgtggtcttggtttatggcgttggtgggggtgggagtagggctgtgcccatgagctaacctgtctctctcttctctccccactgtgtccctgtgtgtcagttctgtgtccatctcatgtgctgcgtgtgtctgtaaagcctcattccgtgctgtctggcaggaagctccatctcatctcatcatctcacggccctggcactgcctcagcatggccatctcatcacgcctcgccctgtgggagcagaaggaaagtgacactcatggctggggctgcagccatctgcagggactgactcgaccctcgggagacaagtccgacctttcccaccttgagtggggagtctgacatccagccctcctagtagcatgtgcaatcccaccttcaaccttctcccagccagctcggttagccttggcctttccaacccagctggacactgatggccatacccttgacgcccccccgagggctgcctggttgtttcctgttccacaggtggtggtggtggtggtggggggtggtagaccagctgtcccagctggatcctcatggcagctctgatgagcactggagtttgggtgggaggaggggcacatgggggacagaggcagggctgtcagctgccaggtttatgccacaggggtgggtttctgtggtccctgccttcgggcaccatagagaaccggaaacgggctctcctccccagatattcctttctcccctttagtatttttcatgatacgctacgaagggctgcctctttctaagatgcctgttacttcctgcaccctcactccaccttgtgcatgtgatttgatgagttggaggtgggagggtgagaaacttctttctggctgcctcctgcctgcccctgcccctgcccctcccagcctgatctgggggtagcagctaaaatggcattggaagctgcagagggtgccttaagactgtctcttggccaggcgtggtggctcacgcctgtaatcccagtactttgggaggccgaagcaggtgaatcatgaggtcaggagttcgagaccagtctggccaacatagtgaaaccacgtctctactaaaaatacaaaaaattaactgggtgtggtggtgtgtgcctgtcatcccagctactcaggaggctgaggcaggagacagaggttgcagtgagccaagatcgcgccattgcactccagcccgagcgacagtgcgagactccgtctcaaaaaagaaaaaaaaaaaaaagactgtctctcacttatgaagtgtctttcagtcccacatcaggaaggaaagaagggaaatgatgttgatgtgggccctgcagtgctgcccctgcttctctgtccctgggcagaggtctgcattcaccagctttatcccatggccttgtctcctggcctttgctatctcctttgaattcctcccttatcagttgggctacacacagcaagtctttaccatacatgcacagaggttcttgataaggaggctattttagaccagtatggagctcttccgtataaagcactggtgacttttttttcttctcatgggctgtcactgatgcaggctaaagacacacttcagtcggccacagccggtctcatgcctcagcctccaagtcgctgtagccaacagcggggtctcagctgcaccacaagtccagccagtgctggcctaggccgtatttctggggggtaaaatatcagggtccaacctgcctgttctaggacccagtgttagagagctcctggctgaccaagtcctggtttaaggactgtcaggaagccacagcactgtgtcagttgaatgggttggagccacaaggtcaggtccttatataagtcatggctgtaagcccttccctatcttaccatgttcctggtgcatagtaagtgattaattggttcatctattatattaactataagctgagggggaccaggagagcgtggatgattccctgtgatccatccccttctggaaactgggaaacctcctttcagagcaggtccttctagaaatgggcatgtcccatggcaaggaagggaaccagcagccttgaccatacaagtgactgttcatatcacaaggagagtggatccaggcagaaatcacattgacccgcataattcctggctgcccctgtgttccattttcatgcgctgtctcagggacccccctgagtcgtgctgggcctcacctgcttggctgtggcttctcatacatgggcttggtcatgtatgtctcctccgccccctcccaggctccatcacaaactttgaagggcagcttgctcctgctggttgactcactgagctctctctttccttgcttctgcaaaacagattcgggaagaggacaagagccctccaccatcctcgccccctcctcttttctctgtcatcccagggggcttcattaagcaactggtccgggggactgaaaaagaggccaaggaagcgagacagaggaagcagttagctgtcgcctctccagaacgagaggtaagtggttcctaagaaggaggaccgtatgcgtttccatacccatcattctgtcttgtgagcttcctctgagtcatttgtcatcctgcctttgctcctgctgtcctggttttgaggaatgtcctttattcaacttgatctattgagctcttatgtacccttcaaaacccagctcaaacagcacatctctggaaagttcttccattgcctgccttcctctgaatcctgctgcaccttctatgcctgtcttaactgtggttggttggcatagtacttatttgattatatgacttatttgactagaaattccttaagagcaacaatgatttctctcattcaattctgtatcttaagcagccctcatagtacttggtcagtagtgagtgcttaacagtttgtttagtgaatgaataaatgatattcattgatgcatggttggtggggattacttgaacactatttttatagaaaaggaaacctagatactggctaagatgtatagttggttcactttaagcagaaagctattgagttggtactaactggtgtagttgcattgattgttaaaatattgaatccttcataccaggtggtaaatggttgtaacccttggccccccaagtgccctcagctgccatgtttacccaggtccctctcctgagtcccttggaatggctacaatccaataattacagggttaatgcttggcacaggtaggaacctcagtaccttcctccagctggtgtccgtcctgattggttgatgtccactaaaaatccttagctattctgaatagcgctgctgcattgaagcaatagttgaatgcaatgtggcccttacactttaaggatttgtaaacttgtcgctggtggtggccagtgctatttctctcttgtcctctttagccatggaacctgggcaggatgacaaggtggaccatgagggaggcaggcttggaatgcaatgcatcttgggagtatccctgtgttaggtagaaagggcatctctttgtgtctccagcgcccccttcagacaaggtgaatgctgcaatgcttgggctgagaggtctggtggcctcagggcctggtgctggcttgagcccagtgacccatcctgactcttccttcccctccccttcagctttggtttgcccggctagtcccacatgtgcctgcacctgtctgatgaacgactttgatgcattagagaggtcttccagcaactgaacagtagcagctgctgaaatacctcggccaagtctttgttggggaggttgacagggaggacaggctctgttcccactcttgcctgacctaaggcataagtgggggccaaagttgaccccggcaggctgttgttaggttatgatgaaatgttactgtgtgctgtttatctccagacaatgctgctttgctgctcatgggctcatttaataccccgtgcagcaatgcaggtggatgggattctacccatttatcacaggtggagactgaggccaaaagaggtcaagtgattttcccaaggtcatcagaccagatagaggcagagcgagggggagagcctgtgtgttctctgctctcacaagatgcctggaaaaggaccagtctggtgagtgaggtggccggggtggtgccacagagacctgggggaaagggttccatgagattgacaccagcagcgctggtgtcactgtgagcaagtaaagaggcagagttaagccatggatggggacaaactgtcactgctgtgcctggatggagactcagagccaagatgcaggatggctctgagcctcagcccacagcaggtggctggaccatgggccaagatattcctggggctggagcaagggagcctcaggacatgtttccacaaggcagcaagctctggctggttcctgccaatttaattttcttgtcccaatcaataaataactccgtactctcttgccttgtcccagcacaactgtttcatttgatcctcatctaatccttgcaagaagccattagaatccatcccattttgcaggaatggaaaacaaggcttggggaagtgacctggttctcctagggctacccagtcagtgaggaacagggagaggctggaataacactggagtggaaagtaacccgtattgaatgtcaaggagacctagattctagctctggccctgccgctttttgtggtcctggctaaaccccttcccctttcttggcctcagtttactcatctgtaaaaatgtgctattagtttctattggccccagttattctagaggtgctgtttccctctatatgctaaaaagggtggcagggtggggggaccaaaggctttgatgactttgaaggtccaaaggaagagaatccatgggcatatgagggtggggtgggaggaggctggcactggttatcttgtttggcccaccccatgttactgtctcctctgtggtggttggttaaaaataaggcactgacttacttttcaatatggtgtagacagtggtgagatttgccaagtgcagtcaatcccccttccaaggctatgtcctgccttcccccagaaggtcaggagaagctactcggccttgggccccagagccatgatgctgagcaccagctgaacctcgtaatcacccgggcagtcacaacccaggcagactcaatcagagtctctgggaataaggccaaggagttaaggtttttaaaagtgccccaggagattccagagagccctagagagaaaaggaagggcatctaatatgccgcagttcaaggcactggctttggagtcagagagaactggctttacatttcacctttgtagctgggtcaccttacatctttacatctagttctttgcttgtagaatggggagaagttcagaatctactccagttgttccttcggaggattaaataggagattgcatgatggtgatatagggctcattgcaaggaagatataaatgatagatactattattattgtgattattacaaagatgaaaacagagactttgctgtggcattggtcacctaaaacaggagagagacacaaaagccagaatggaacgcagaaggtggccacgctgtgactggtgtactagcatagtgctctggaactttgtgcaagcttggaacaatttctgattgaggtcttcaggcaaagatttgtagagaggagatagaagagatatttgagctgggtatagaagatgagtagaccatggacaagtgaagaggggaaagggcacgccaggcagcaagctcagcatgggcaacagcctggaagcagggactggtcaggtaggagaaggtgaccagtacagttcatgcatgggaacaagtagggacaatatggtcagattggaggctggggttccttgttgaggaatttgaaagaccaatggtggtgccaaatgattttcctttaggctgtgggcagctacccaaatcttttgatctggtataaaatggctggcagcaaattgaagggacagcagttcacgggctgtggcaatggcccaagtgagggatagcggacatgagtttggaaaaagagacatagatgtgaagcttggcagggtggaatcaacatgcccctgggactggtttgaatgcaagaggagggggagaatcccagattcccaggcatgggtgtctgtgaggctgtgctggcattgtccaagatggaagaacccaggctagggctggtggtgaagcgagacattagggtagaacttgcttatgaggttgaggtctttttctgcagagatggaggcacagctggacctgtgagctcttcaggccatagccaggctggtttgaggatgaagctctgcacaaggctaaaatcacaaggcagtaacaaggcctgggaagggagcaggcagtggaaaccccttgggtgttatgcagtcacaaatgtctgggtcaggcaagagtgggggaccccaggggcagaaaccagggccctcagctggtatgggaagtgtgatatggggatcagggcagtggaagtagcagcagctcggtttattcttctctctctgatctccaaagtgcatttctacatctcatcctataaaagatctggatggtcaggtggtatctgcctgtactggggaaacccgaagcccagagagaagagatggtagcccagatagacatagaaggaagcctagctggagagtgttagagccaaggtgagaacaggtcctctagtgacaggccctgagtcctttcctggatcccctactcgcctaggaaaaatccaggcagaaataacaacagtagtagcagcagctactgttgttgaggacacactatgcgctgggctcagtttctacatattgtcacacattctcacacctaccctgcaaggtaggcttttatcattctcattttattgattaaaaaacagactcagagaggagaagtcatttagctaaggtcacacagctatagagtgtcagagtcaggagttgaacttggttctgttgggctccaaagtccactccttccactccatcactcaactttgaggggctaggccaaggtcaagggtgctaggcttggccatgcctgttggatttggaggtgctcgagcatctgtggaaggatgaatggagaagtgaacaatgaaatgaatgaacgaacacgagtgaatgacaaagctgtcaggtcagcaagcagctatgtaggcatggttgtgttctttctcccagatcccagaaatttccatcagccaacccaacagcaagtccagcagtggcaccagatctggaagccagcagatctctcaggacgaccagtcaagctctcctgggagctcagacattctgggcaaggagagcgaggggtcccgcagccccgaccctgagcagatgacaagcatcaatggtgagaaggcccaggagctgggctccagtgcgacaccaaccaaaaagactgtccccttcaagaggggcgtgaggaggggtgatgtgttgttgatggtggccaagctggacccggactcagccaagccagagaagactcatccccatgacgcccccccttgcaagacctctccccccgccacagatactggaaaggaaaagaaaggggagacctctaggactccttgtggctcccaggccagcaccgagatcttggccccgaaagctgagaagacccggactgggggtcttggggacccaggccaaggaactgtggcactgaaaaaaggcgaggagggtcaaagcatagtggggaaggggcttgggacccccaagaccacagagctgaaagaggctgagccccagggcaaagacaggcaggggaccaggccccaagcccaagggcccggcgagggggtgcgaccagggaaagcagagaaggagggagcagagcccacaaacacggtggaaaaggggaatgtctctaaggacgtagggagtgaagggaagcacgtaaggccccaaatccctgggagaaagtggggaggtttcctgggaagaaggagtaagtgggacggtccccagaataagaaggacaaagaaggggtgctcttaagtaaggcagagaagacaggtgagcctcagacccagatggagaagacaagccaagtgcagggcgagttgggggacgatctgagaatgggggagaaagcaggtgagcttcggagcacgactgggaaggcaggtgagtcctgggataagaaggaaaagatggggcaaccccagggtaagtccgggaacgcaggtgaagctcggagtcagacagagaagggctgtgaagccccaaaggaggtgagcacaatggtggagtcgccagcagctcctgggaagggaggctggccaggaagccgtgggcaggaagcagaggagccctgctcaagagcaggtgatggggctggtgccctggagacagagctggaaggacccagccagcctgctctggagaaggatgcagaaaggcctcggatacggaaggagaaccaagacgggccagccccgcaggaggagggcaaaggaggccagagcagagactcagaccaggtgagggggctgcggccctgggagcgggaagcggcagacaggcctctccagagatgcagggatgggaaagatctgccccagggatggacaaggggtggacggggggtgggcagggaattggagaggggtggctggaactgcaaggcacccagaggaggggacgagcacttcctccatgagcagaagtcttgaagtttccattgcacctgccctggggtgggaattccccacagagtgagggaaggtccccaaagtgtgaggtgtctcctcacggctgacatggtagagcttgcttatgatgtcacacgacagctttcaaacgggatggcataacgagtagattgttaaaaatgcagattcctggggccagccatggagtctctcatttcaaaggccaggagtggggcccaggaatctgcatttatgtagtattttttttttttttgagacggagtcttgctctgtcacccaggctagatggtgcagtggtgtgatctcggctccacctcccgggtccgcaacgggaatctgcatttaaataagcacactccctctcctgttctcccccaggagattctggtttagatggctccagagcacactgtgagaaacccccgtgtaaggtagaagatgggcagcggtgccatttgctggtttaatttacgtgatgttggttctcaggctcctgaggacagatggtatgaggcagagaaagtctggctggctcagaaggatggatttactcttggtaagtaggggtgttagcacctttggagggtctgagtcttctcctgtgccccctactgctgccagccatatgttccaggtcctgattatactttggtggtcaggagggaagaggagcagtggagactgtctttcaaaggcatttgtgtcttgataatgagttatttacctactgtaactcactaatgcaacaagcatgctttcttcctacggcgttcttcgaggaagccagagtctggtacaagtgggccaatagatttgatctcatgagcctacttttgtcgattggttgtggctgatcactgcactctactgagaagtgatgctgagtctcagtctgaacatggctgggaagagtggttgattagtgatgtctgccatgggcactggagggggaaatggcagtctgtgtgtgagataggccagtgtacccaactgtctgggtgcctgctctgtgcctggcactgtgacagctggtaaaagcctaaggtgagtcagacttagcctgaccttaaaggatttggggtcacaactcagctccaagtgaatagaccccaaatggagacctgtcccaagccttctcccaagcttgctggcccggcttagagcctctcttatctcctgccctcgcctctttcccctcttcccctcccatctcctccccgttccccttctctctctgggatgtccaaccagctacggtgctaaagccagatgagggaacagcagacctgccagcaggaagggtgagactttggattgatgctgacaaaaccatcactgaggtggatgaggagcatgtccatcgggtgagtcccctgtcccgccgtcccccagcatgagtcccctgtcccacttcaccccagctccataccctccttccccagtcctgcaagagatttccttgttcctgactaccaataccattttggcttgatgccctggagggagttatagtgaagaaccccactgaactcattgctctactggaggggtactattagggggtcattcaccctttcctgtggtttcccttaatgaggacacatcaaagaacatgtttgtcaggtcttggccctgggagttcttctgatggacccaagaaaatgactgcttttaatttatagatattggatattgcaaatcatactacacagcatgtttctgttttcactctggccgccagggaactcagagccaaatttgctgcttgccattaaccatagcataggttctaatggcctatattttggcatcaaactttctttcagctttgctctttaaattgctttgaatacatttttgttgtgcaccataaatccttttgaggacaagtcccagtgtagtgatagaaaagaaaggttctgtcatgccctttccccccgcccctcacagcctgctatcttaggagttttcctccttgctcatctgcattcctttctgctcctcctctgcccacctcaggctttctctcccgcgttgggcatttacagaggctcagtggccttgcaagaaaggctgatccatgagagggctcaagcttggcccaaacctgagactaccaggttcagaaaactcactgaagctggagagaataataggacgcctcttagaacagatgttttaagaagcagcttcacataacccttgcttctaagggtttgggtggtttcctaggaatcaatgcatgatgggctatgagaccagtgaggtggtttggccattggcctccactcctgggtatcatggagcatattgagagcttcctcgtaagacccagaagaggaggaaatggcagcggatgctcgcacacactggagcatcacctgtctttttgtggtgtttgagatccagaaagtgttttgaattttgtcaagtctgccttgggagcgtctcccctcatggtgcatggagtgcaggaccacagcgaagagggggtgcctcataggttgcacagagggcaaggagaagggatggccctattttatttgtagggcttcattgctttccatccagagtccctgtgctctgttctggtctttggcacatagctctcaagaggagggcttagtgtgtgtttggttgcgggggggtggggtgggggcagggggccagaaggccagaaggccagaggagactctgtgtgatggtttcacaggccaaccctcctgagctggaccaggtcgaggacctggcctctctcatcagtgtcaacgaatccagtgtcctgaacacgcttctgcagcgctacaaagctcagctgctgcacacctgcacagggcctgatctgattgtcctccagccccgggggccctcggtgccttctgcagggaaggtgaggtgggaccattgtgggcagggctgaggggctgagggcaggggggcctggggggatccctctgcatctgaggtgacagtagaaccatcagagcccccagtcgacctgtctgcaagcagcatccttctcgcggcattgtggcatcctgtggcatggaccatgagattcccccattccctggagggaaagatcagtcaccattaggacagaaacagcagcattaaatatcacaagagtaacgaaagaaaatactgaatgagtgtgaactctaccagacactgctgtatgcaccttcttgtattaactcagttgagtctcacatatccacctgaaaacacaggtactgtgattagcccattttacagatgagaagagccggctgggccaggcgcaggctaaactctcaggtctagcgagcagagttgctgggagaaaacccaggatacagggctcctgtgtgctcttcatcccatgctgaactctcaggagtcctgagcacccacatcaacggggaaacagaagcttcagttgtactttagtttttttcctcggaagtgtagaaacggccaatttttgttgagatgggcaagagcaaaggaaatctctaagcgccaccttgtggacgcacgaggcacctcagccgagtcattgaagcgtgggccccttcattccttcaacccatagtgattgagctattgattgagggtctcctaccgggccacgcacaaagaacatcagggaaggtgccaggcgagcaaccctccccttgtggagttgctgttctaggaagaaaagacagtccatcaacaataaagataagagtggcccgagcagatgagtggaggaagaggtgggagaggttgggaaaaaccaggacagagccgtgtcagttctcagggtgatgattctggctttcactctgagtgggatggcagctactatgggtatttatttatttatttacttttgagacggagtctctctgtgtcgcccaggctggagtgcagtggcacgatctcggctcactgcaagcgccgcctcccgggttcacgccattctcctgcctcagccccccgagtagctgggactacaggcacccgccaccacgcccagctaattttttgtatttttagtagagatggggtttcaccgtgttagccaggatgggctcgatctcctgagctcgtgatccgcccgcctcggcctcccaaagtgctgggattacaggcatgagccactgcgcctggccgatttgtatctattttttatgaactgggcagcctcctgagccagagtaggcttagagagagtccctactggggtttttagcagagcaatgacatgctgtgacttaggttgtaaaaggatgcctttggctgctgggtggaggacagatgggaagaggctcagtggaggcagggaggcctgtcggaggtgagacatcttacctgtgtgctcttctggagactcactgggaagtcagaagcccctaggacacctggtgtctaggaaagatcatgatacctcttctggtttccatgttctcctctgccaactgggggtgaaaacacatcttgccctttggggccctgtgggacaaatccatccctagtccctgaggcaatgctaaatccattaaaggggatatagtgggcctgtacccctctctccaagatttttctcctccagagtgacccacaccacaccttcagtcactcccaggggctctcccaccaccgctgtccatggtcaagggcctgggaggacctcagaagctctgggtgggccagagcttggcacgtgccctctcccgtccttgtggtgagtgcttaggcttctgttgctgcagcccaaggcctctgagctgtccacattgccgagggactcctccggctccctggaaatccctggaagggacatttttatagacccagatagcaatcaggtcctcattggccatcctggattgaggcatcagaacttaggcaaaagcgccaaaagatgcaggcattggtacgcactctgaaggtagatccccctacttcccttcctaaccctggggtggggtgcggcactggtccgcacccttccctcaagtcttccagcctcccacactcaaacccacagccacctcctgtccttaggccggatcaacctctgattccccaaatggccaccaggtgggagcacaggcctgcggtgaggctgagaccacctcgaggatgggctgggtggggtctggacacaccgggggactctctcactatggggctagccccaccaggcagctggggtctgggtgtgtgcctggggacatggaggtctaggtgaataagagggtgagtttgagcatgggtgcgaccccgtgggtagaggtggatcccatctctgtgtgcagagcccgccgcaactgttgcgtgcatgtgcctacaagcacacttctgtgcatgcgtgcaagggcacatgtacacagatgcaaaggcatgtgtgcatgcatgcatataggagggccttcaggaacctggatgtgcagaattcttccttctccccctaggcagtgggcctgagcaggctgatggacaggactgcccgttcattgaactttagttttcccagactgggggatggctctaggactgagaccccaggaccctctgactgccttaagccctaaggctgtgtccagccagtgtgggggcatatccctcctttgcctgcattaggttcctgctgagccctacatctggcatcaggatagggactcatgactgttcctcaggggcttggagcaggaagagccaacagtggattggagacagccccagccccaagctagacatctaggctgaggggagggccatcacaccagggtttgtgcccctagttcggccaaaggactgcgctagggagggcagatggggccttgccggacccagtggacaccctcagcatcttgggcttcagacatcctcctgcagcagggcccattcctcttttccttttggtgccctcctgctgacctcacagtaacctcctgccctcttccctcgctgccaaatccaatgtcaagtctctggtctcttactgaactcagcagcatttccctccctcttcctggaaacacacccttcctcggctctaagactccgctttcctggttttcattcccgcccactggccgcccagtcagtcttccttgtggtctccctgacctgtccctgtcaggatgctctgttctcacactcttccttggtgatctcatccaggcttgtggctttcaaacgcctcccgttcactgtaattgaattaatttctttcatcgatcatctctgtcttcccaccagaaggcaagctccaccaagcagggacttaaaaaaaaaaaaaatcaggcttacattatagtccaatgcacctttttagtgtacagttctgagcatttttgacaaaggtgtatagttgtataactgctttgacaatcaattacatgacagttcccgtcacccccaaaagttctctgggccccctgtggtcaactcagccccaagttctacccctggtagccactgatctgtttttttgtccctatagttttaccttaaaaaacccatataaatggcattgtatggtatgtaaccttttgaattggcttcttccaggcagcacaatgcattggagattcacccatgtggttttatttatctacagtttgttcctttattttatttcattgatgcactactgtgcttatttgttcatagggtgacctcttgtcctggttttcctgggactaaaacgttttctgggacatgagactttcaatgccaaaaccaggatagcaatttgggaggccgaggctggcggatcacttgaggtcaggagtttgagacaagcctggctaacatggtgaaaccccatttctactaaaaatacaaaaattagccaggcatggtggtgcacgccttaatcccagctactcagaaggctgaggcgggagattcgcttgaacctgggaggtggaggttgcagtgagctgagatcgtgccattgtactccagcctgggcaacaagagcaaaactctgtctcaaaacaaaaaacaaaaacaaaaacaaaaaaacaacaggttgggtgattatcctagttcactagttgaaggacatttgtgttgtttttagtttttggtgattttgaatatatagtcaatataaccaatgacatagaggggttttttgtgaacatacattttgatttctttagggtaaacacctagagaggggttgtggggttgtggagaggggtaatgagtgtgtatctcactgtagaagaaactgccaggctgttttccatagaggctgtatcattcagcattcccattggcattgtatgagaattccagttgctcctcatcttcaccaaaacttggtagtgactgttaaatgtttttttcagccattgtaataggcatttaatggtatctctttgcgattggctggaatttcctttatccattttgtgttatgctgtgcccgagtgcctgctgcatagtagacactcaatggattattttactgaatgaagtatgaatgaatggatgaagcagatacggttttagttatcacctaaatctgttatggcaaatatatagcacacataccactaactcccccatgtgccattccctgtgtccatagcagacatcactaatcgtaatggataattatgctatcgatccagctgcctcgcttcaggcagataccattcgatgctttgagtaaccagtgagatgaatctcatggatgaatgcagctctcattcaagcctctaactaaagaggagaactaggttcagaaaacaggcatgggttgtccaaggactcacagggagccaggggcaggactagacatacaggcttggctcctcctagtcgagtaggaagggagtcagggatctggaggcagatctggaggcagggacacagatctggaccctaggcctggggcggggcgctgtcttagaatgctccctaggcagtggctggatgggatggctgatacctgtgatcttcctgcaggtgcccaagggccgccgggatggcctgcctgcccacattggctccatggcacagcgggcatactgggcgctgctgaaccagcggagagaccagagcattgtggccctgggctggagtggcgctgggaagaccacctgctgtgagcaggtcctggaacacctggtggggatggcaggcagtgtggatggcagggtctcaggtatggtggtctctaggtgacatggagagttggggtcagcacggggagagttggaaggggatgctgagctgctttcttatattcattcagctagcattcactgagcaccagatatgtgcagaccccatgcttgctactgggcagggctatccctaggtcattgggatgcatttgttgaaattagaataaggtactccttcctcaagacattgacggccgtttgcagaacaatcatcatacatggacattgttagaaccggatacttgactgccatctgctgggaaatcgtcctaatagacgtacacaaatctaggagagtgtgatgtgaatgatgcacccctgggatgtggtgtctttgggcagtgcacaacttgcggaactgaacagaggactcgaagagtgaagcttcaagggcagagtctacactcatgagaagctaatagccagagaggaaattgaactgtacctacgttcaaaacttgaatgttcttcaaaaagtgctggcagggcaggctagggaagaaactcagggagcgcagaggagggctgcaggagggctttttttaggatgtgatatttgatctgggccttaaaaaagagtaccaattaataataacaactacaatattaataaccatcagagtaaatgcttgctgaagcctaatgtaccaggccctattctaaggatactaactttattattattattattattgagacggggtctcactctctcacccaggctggagtgcagtggtgtgatcccagcttactgcagccttgacctccaaggcttaagtgatcctcccacctcagcctcctgagtagctgggactacaggtacacgccaccacccttggctattttatttttattttttgtatttttttgtagagatggggcttcaccatgttgtccaggctggtttagaactcctgggctcaagtgatccacccaccttggccttcaaaagtgctgggattataggtgtgagtcactgtgcccaacctgaacttttttttttttaatctaaaacagccctataaggtaggtattattattttatattttatagattgaaggcattgagattcagagacgttaactagcttgcctgatgtcacacagcaaatactcctagcgctgagattcaaacccaggcctactggctgtagaactctaaccattgtggcagtgttctcagctttttttcattattgcacactctgaaaagccttttaagacatttattccccttaatcatttcccctatgatgaaatgttaataccacagataagctatatattcctttatgtgtatttgtgctttatacataaaaagagtaaaattttttttaccaccacttctaagaatcagtttttgctcttctcaggggcaatatcctccccactgagaatatatgatgcagggaatattgtgtttctaataataataactataataacagttccacttttggaatattttctaagcatgtgacattattaaatcttttggtcctcatgacagccacatgaggactagatttaattagttaattattaatgaattaactagttaattaatttgccccaaatcaggtaaccaggaaagggcagatcctcaatctcttttaactgctgggctatactgcttctccactggggttattccagtgttttgctgaacacctactctacatctggctcatgctaaaagctagagatacagtgggaagaggcacagtctctcacaatgtagttgtgctgtgaatcgcatgtgtctgagggtggaagtcaggtcaggctgtatcgaggtgcttagcacagtgcttgttgcattgtaggtatgcaatgaatagtagtggggagattataggattttgcaagcctgcctctaagctgtgagtgcaggccctagaatgttatcctcacctcttcctaggctccattaggtctgggaagccctagggcagcctctgttacccagattgtgcctagccctggcccttctagattgagtcttgtttcccctacactagagctggtagtacaggttcagcccagcaatcggtgctcagtgaaatgtatgtggtttatagttgggttgggcagggagtgggtggcaggaagctcacaggaagcccaccgggggctgaggccaggatggggactggcccaagcaggggccgtggaaaaggtggacctgtgtgaggtggcagtggcagcacctgggccatcagtgacatgtggccccatgctgcccccaacagtggagaagatccgagccaccttcactgtcctccgggccttcggctctgtgtccatggcccacagccgcagtgccacccggttctccatggtgatgtcgctggacttcaacgctacaggccgcatcacagctgctcagctccaggtgaggcctctcgggggatgtgcaagggggcccttggggctgctgtgtctctaaccccgggactcagcagagcccacgcctccagctgggactctaggatgtgtctgaaatggtcatggcggtggctcaggcctgtaatcccagcactttgggaggctgaggtgggtggatcacctgaggtctggggtttgagaccagcctgaccaacatggtaaaaccccgtctctactaagatgcaaaaattagccaagtgtggtggcaggtgcctgtaatctcagctactcgggaggctgaggcaggagaatcccttgaacccaggaggcggaggttgtagtgagccgagattgtgccactgcactccagcctgggcagcaagagcgaaactccatctcaaaaaaaaaaaaaaaaaaaaaaaaaaaaaaaaaaaagaaagaaagaaaatagtaataataataataaaataatgaaatggtcatggatcccctagctggggccagttgctccccacctcgctaggtgccctggaacgtccccttctggagcaagccagcccgtctgtgcttcagactttcaggcggatgaaatattcatgagcaaatagagaattcaggctgtcattagccgggtcttaaaagcgcaagttgaaattaaacagacgcttgccagccttctgcagcagtccgcgtgtgacgaacacatggcctgtttgttcctatctccaaaatcacccatactcctccccgtctccctcaaacatcctgtttgaacagaaaataggattaggttattagaagggttgtttgtaacatggagctggtataatatccagactcaaggaaaaccccttcatgccaaataagtcccttttctgtcctggccctgaaatcctacccttaatcactatttgggttaaggtattaaaggcttctattaaaaagggaatatgttggaaggtggcctcatttgattgttattacctttgataccttaattgaaatgaatctattgcattagttaatttcctaggtggactctgaattagtgagacaaaggattgagaagttctgacgtggaggttgccagcaaaattaatttggacctgagatgttgtctcgaagagtggatcagaggctgggcgtggtggctcacgcctgtaatcccagcactttgggaggctgagacgggtggatcatgaggtcaggagattgacactatcctggctaatgcggtgaaaccccgtctctactaaaaaaacaaaaaaattagccgggcgtggtggtgggcgcctgtggtcccagctactcgggaggctgaggcaggagaatagcgtgaagctgggaggcggagcttgcagtgagccgagatcacgccaccgcactccagcctgggcaacagagcgagactccgtctcaaaaaaaaaaaaaaaagagtggatcagagtggggcaccccaatggggcttctgggtagctgcacttcaggcatgtgcagatgtacccaaagcactgactgggtgcccctcttctctccctgcagacaatgcttttggagaagagccgcgtggcacggcagccggaaggggaaagtaacttcctggttttctcccagatgctggctggattggacttggatctcaggtgagcacttggggcaggaagagacagctgagggcagtgcgacaaagggcacatgttctttgggggcccagccttagcttctgcccagcactgagaggccgtgggacccagggattaggaacatggcgtccgattccagctgtctgggtacacgcagctcatgggctgggtgactttggtcacatgtcatccaccctgagccgcggtttcttcctttgtaatgtggaaacaacaccttgcatagaccttataggattaagagagataatttacattcagctctttataggtcacatgtcatccaccctgagcctcggtttcttcctttgtaatgtggaaacaacaccttgcatagaccttataggattaagagagataatttacattcagctctttataaatgctgggagtcaaggctgtctgctgtgatagtggcatgtcagtactggccctggcagcggtatgggaagagggagagggacagcagacccccatgtcttccagaagtttctaaacttttgtgggagctttgggtgtatggtagggtatgcctacatgaggttcctcaggatggacctggagctgagtggagcagtgagctgggtagtcaggcaagcctcatcttggagggcctcctggaggaggtggcctaaaaagccatctctgcccttccccaaatctacagggcatccttaggcatgtggctcatgtggcttcctctcccagagccttggtttcctcctctgttggatggatgggcatggtcctagtgaagtgtcggggagaggaaaaagtgggttttcccacatgaggggtgataatttgtggttactgtgctctaacctcaccattgtttgttccccaaccttccctccccatctgaaggacagcctcaacctgtctggagtgtcctggctaaggctggagggacagctgtaacctgcagagagaaggcagagtagagagggaactcccagtttttagagtgattgtaactgagcagcagggaaacttctagaagatcttgagaatctgtagaagaacttggagtggggtggtatagcagagtgacaggtaccacagactcgaggacaaggctgtgtggatttgtatgttggcttctccacttgttggctgtgtgaccttgagctaatgacttcacctctctgagcctgactttccttatctacaaaaatagatgtgactgtatcccagtgttgtggtgaggattaaaatatgatcaggcagacaatacttcttaaaatagtgcccggacatagcaaatgctttgtgtgtgtgtgttcttgtttttggaggatttgatctgccttgatacccctgacaggccctgaccaggccctgaccaggtcatccaaagaaatgactttggattcagagagacatgggtttgatctgggctttgccccacatgggcttctctgagccttggtttctcctcctgtaaaatgggttcctactagtgccaaccccgtaggcatttaaatgagatcgcatgtcaaggcagcaggggccatgtgcggtgcatagtaatggtgtaatgtgggaaggagtaggtaggtgggccctgaacataggaatcccactttcagccccgtggcctcacctcttgggacctccattttctcacctctcagaacatctctcagacacacacatcacccttgttccagccctggagttccacactggggctctctcttctgtaccccatgggtggggcttggctctggggatagaagcattgcctcctggagagggggatttggaggcttaccctggggtgggcccaggaaggatgaggctcaactgtggctagcagaggatgccagacgttcattccaagccaggcctaggccaggggccctccatgctggtggcatccttattgagtttggcatccttaggagctgggccaaagctgcctctgagaggaagaggtggcccagatgagtttcagggaccctaagagagtgagtaaagtgcttggagcaactcagccccctcagggagtcattgtcattctgaagcctcattggtgatcccccaattacttccctttctctacctctgctgctgccaacttggtccgtcacccatatggaagcttccaaaggtcaaaaacgggttctcacttgcacaaatgtcctttctcccatgcactcatgtgggaaactcctattcatccttcaaaaccctactccagatcccttttttagaggagcactgcctgattcttgctcctcagtttctcctttatactgttttggtgcctggtatgtgcttctggttcaaaaacctgccagcgcagtctcccttcctcaccagatggactgggagatctttgaattggggccctgtcattgttctttctgctttcccagtacctagcccagggcttggcaccaggtagatgcttcttaattatttgtcagatttaatttccagtgaatggaagagagtgtgaggaaaacagagcacttactccatgccagcctggcagtgtgagtttatgtataatatctcatttaatcctgggaggcaagtagagtagggggcccattttacagataagaaaaagtgagttgcagagaagagaattaccttgtctgccacatggcagcactggggttggacttgaagcctagctggtaagactccttcaaagtcacgaggcagagaggggtgtggggtctgtagagaatccagggagaggacactgaaggcctcagaaccagacaagctggctggagactgatgagtaatccccactttccaggaaccaatttgaaccaacgtgggattggggatcctaggctgggctctacaatgcttttgtgagtagagagtgtgattcgaaggggcagggggcatagctgtgcccaccccgcctttggcttgcattcctcaagcctgcaaaagtgggtggcccatctgctggtctcactctcgaggaacctgcaggttgaacacgggaaggagccttaaacattgtgttgcttcataaagtgcagactgaggccgggagaggtgcacgtggcaggatagcgcggagtctgggctcgaggggccaacagacctcagctcagcttctggttgcatgcttgctagctgtgaagtcttggggcaggtacccactctcagtgcctctgttttgtcaactgtaaaatggaaataatatttgtacccatggagtggggctgtcatgagtcatcttaggacttagcatgcagtaagggctcgttcatgttgactgttttaatattatccttgagtgaggtcgctcagctgattagaagatctggggttagtccctgctctcctgattttcctctacaaccctttctcctgggatttcctggcctttaggaagggccaagtgagggctgtgcgtgaggaatatttgggagattgaagatatcccagggcagagttagtggggccaaggccagggacagggacagcccctggggtgtccgggcagttgtgtggagcctcacactgtgacgaccacctgccctgccagggctggtgtggacagcccccctgactcctggttccttctgtgcttccaggacggagctgaacctgcaccagatggcagatagcagctcctttggcatgggcgtgtggtccaaggtaaggaggaggtccctcacgggtgggatgtgagtctgtgtctggggctagatgggagggtgatgagtcgccgtgcaacttgtctcttttggtactggggttcatagttggcaagggttggtcatgtggaagagttggcactgcctttgtagggtctcggcttattgggtaaagaagactcagacaaataaaggaaaccagacatagtatacgtagaggtaggattagggccctggaatcagtctagttcaagccccagctctgacacttgttacgtaggtgaacctcaggcatggaccttaacctcctggtaggtctgtctcttcttcagtacagtaatgatagtagcagtatctgcctcatagggttgttgtgagggtgaaatgacatgatgtgtataacgtgcttagaacagggcttggcctaaatcaatcaatagggtgctctttgtcagtactagtggtggttaacttgggtaggggcactcagcgatggtttcctgatgaatatagtctatgagtggggctgagagttaggtatttcattgcttaaaaaagcaaatggttcactggtttgatattttattattcaattattttaaccattgttttctcccttctctcgcaaataccttcatcaccacctatgctgggcctgtgttgtgttaggtgtatgttcctgctgagtgctaggagtatgatcctcatccatggattttcactttagcaggagacacagacttggaaattaatgcaatcatgtgagataagaatatgtcagaggttgcatgaaatgctgcgggcaccacaagatagctgatagagctacttggactttgccagggaagacttcttagccaagggaacatttggcctgggttttgaaggatgaataggagttcaccagatggagggaagtagataatttccactccaaagcctcttttcaaatatacatgtctgggaaacaaatagtgctggaataattggatatcctggtgcaaaaaaaaaaaaaatccatatttcacatgatatactaaaattaacaaaaaatgagtcacagatctaattgcaaaacttcaaaccacaaaatttctagaagaaaggtgagaaaaatctctgtaaccctgagctgggcaaagatttcttaaatgagacatcaaaatcccagtccataagagaacaaattaactttatcaaaaggaacagcatctgctctcttaaagtcactattagtatgaagaagcaagccaccgactgggagaaaatatttgcaaatcacttatctgataaaggatttttatctagaatataaaagtaattctcaaaactcaacccaacaaaaaagatgggcaaaatatggaacatacaaaaaaaatgtaaatggatggcaactaagcacatgaaaatatgctcaacatcattggtcattaaagaaattcagccagtgcggtggctcacgcctgtaatcccagcactttgggaggccgaggtgggcagatcacctgaggtgaggagtttgagaccagcctggccaacatggtgaaaccccatctctactaaaaatactaaaaattagctgagcgtggtggcacatgcctgtagttccagctgcttgggaggctgagtcaggagaattgcttgaatccaggaggtggaggttgcaatgagcagagattgtgccactgcactccagcgtgggagacagagcgagactctgtctcagaaaaaaaaagaaaaaagaaaaaaaaattgctaagcctgtgtgcgtgcaggcgcgcgcacacacacacacacacacacacacacacacacacacagtctgtcttacacagtgctgagtattatctgcagagtttctaattcagtagctctgggtgaggcctgagaatgtgcctttctcacaagttcacagcaatgctgatgctgctggtccagggaccccgctttgagaaccactgttgtagagtctgtttctgcactgggtgaggtgatgtgtctgccccgtctttgaactctgggggctaatctacttgtcaccttataagtatgtcccaaatattgtatgggcaagcctggagagttgggggcatatcagagaggctgcttggaagaggtgaccaagagctggccatgagaatgagaatgaaatttctttcattctcaaaactcatgcatgaaacaagctggaatgagaatgaaatgaacagatgcaacgaggctggcattcttgctaaaccaaatactaggggggcagcttctttacttgggggactcagcagtgtgttcttttttcataccctttaccccgtgatctggggtcatgaggagcccagacctccaccttgaaggcaagagatgagaaattacctcagcactgatttttctcattcatttaatgagctttggcccaaaatatccgtatgaatcagcagaagagtagttgtttattttcctactgtttttgagaaggaaaaggacccaagctggggtcctctgagctttcccccaacctgacctgtttgttaacagtctgcataaagccattggtcacagcgtgaatttgtgtcaaagaagcatttgaagtggtttgctttttttcctctttatttctgtggggcattttttagaccaattgatttgcaggaactggtagggtgtttctttgttctctctctgctacctggcaggtatcaagagaatgttttctctgttctttcagaagaaaaataaagtctgaaaattcattggtctttgatacaagcctgggctagttactggggtcgggcaggccaggtacagcttcattaagggaatctggtgatcaggatatgtcccccaataatgggagttgctaagtccccaaggctgtcaggcttagcaaatcatacaggatgcccagttaaatgtgaatttcagataaacattgaataatgttttagtataagcatgtcccaaatattgcacagggaagcctgaagggttgggagcctatcagggcaggctgcctggaggagtggaccacaagctggtcctggagtgagagtgaaagtagtcagatgcagtgaggccagcattcttgctgtaccaaatattgtgggggacatatttatgaaaaaaattatccattgtttatctgaaattcagatttgactggatggcttgcattttctttggcaactctacaacccaacttcaacccaacttcatccctggctgagccctcctccttccttctcctcctagccagcccccgtactatgattaattctgcttctgtttcatctgtaacagctggttccatctccactgaaaactcactggcgacagtggagtctgacgtagtgatgttcgaatcccagtaccagcggttaagctgggtggccttaagcaagtgacctcatctccttgggcctcgattttttccttttcgaaaactaggagagcaagagtccaccttgacctcaaatgaaatgagataaagccaatgaagtacttcggcagtgcctgacacttccaatgtcagcccttcttcttcttctttcttccttctttctttttcttctctttctcctcctcctcctccttcttcttcctcctccttcttcttcctcctcctcctcctcctcctcctcttcctcctcctcctcctcctccatcatcaaggatggcagcattgggcaagttgggagggcttagcctgctccccaacagcaagacacgctacctagccactcagttcccaatccatgttccttggcagcacgtcttgttttccctcttactgaatttatctctattctcttctaattcatatttttaatgaagcatctgtttaaaaaaaaaacaaaaaactaaattatggctgggctcagtggctcacacctgtaatcccagcacgttgggaggctgaggcgggcggatcacctgaggtcaggagttcgagaccagcctggccaacatggtgaaaccccatctctactaaaaatacaaaaattagccaggtgtggtggcacgtgcctgtaatcccatctacttgggaggctgaggcaggagaatcactgggacctgggaggcagaggctgcagtgagctgagatcacaccactgcaccccagcctaagtgacagagcgagactgtctcaagaaaaaaaaaataacgaaattactacatacttcctatggagaaatcagaaaaaacacaagggcaaaaccaaaaaccagaatacacacacacactcgagcaaaccagaaaacaagcgccattcacctcaccaccctgagaaacccactggtcctatacctgcaggtgttcttccagtatttttcctgcaaatattttacataattcataacaaactgtatatcattaaaactttctggccgggcatggtggctcatgcctgtaatcccagcactttgggaggccaaggcaggcggatcacctgaggtcaggagtttgagaccaggcagaccattatggtgaaaccctgtctctactaaaaatacaaaaattagccggacgtggtggcgggtgcctgtaatctcagctactcaggaggctgaggcaggagaatcgcctgaatccaggaggcggaggttgcagtgagccgagattgcgccactgcactccagcctgggcgacagcgtgagactccgtctcaaaaaaaaacaacaaactttcacaaatattatttttaatgaccagacattcatggaggggacgtggttcaccgaactgctgtttccctaatgtccatttacatggttttatttatttttattttttaattatactttaagttttagggtacatgtgcacaacgcgcaggttagttacatacatttacatggttttaaacctttttgtggttcttagtgataaggtgggcgtctggcttgtattaccatctccgactcccaaacctccgtctaaggagatgtctccagttatcgtctttcctgttgtctccttgctaacagtctcccatctctgatcacactgtttgtttatgatttgtctcccctcggccctaagttccatgagggtgggagtcttacttgtcttgatcactcctgaatagacaaggcctagcactcagccaggcatacagcaagtgctcagtaaaggtatgttgagtaaataaatgaacgagcatgcccaactcaccaccacttaactaaaatcacatcttttcaattttcgaatcgtttgctactgtggtcagcagagatcggttaattaaactttattttctccccagtatcatttcactaggtctttggggatctcatgtctgcctttggacccactccttgggtcctgggagctggggcagttgctgggaatctctgaggacccagagaaggggattagaaagcctgggggtcccatccctcagtcattgtgggcagcctggggtcctcaaatctgggctgagtagtactgtggacccagctcagtgggtgaactcactcaaccccaccatcagtggctcttatttggggatggtcgctagaagctcattgtcaatggatatttattgatcttattagatgccaggtattggcacacagaaataactcaactgggtctcacccatcaagtgactcacttttgggaggtggtgatgggctgccatgtctacatcaacagatcattccaagctggagagatatgtgcctgagtggaggtgtatgtaggctgaggccaagctgggaggaggagaggcatatcagggagagctgcctggcggaggcaaccatgagctggagctggactgagaatgaattagacaggtgcagggaggccagtgttctggctacactgagcacctgatgcaaaggtaaacatgaatggccagccaaagcaaggaccccagggtaaaagtgtggagatccccagtgtggcgctggccgggtcctcagaggctgtgtgtacccggtgactgccagtttctcctcttagtcctcacactgtgcccttgctgcctgccacattgcagcttgtaaatggaacttacttgagatctgccaagcaccaggatacatctgaaatcacaaagctttcatattattttcgtcttctctataatttcttttttgcaacctagcctaattttttttttaaatgtgcccagcagcagtggtaataataataataatccttgccacccagcagtttgcttctggctgtcacattccaggccttggcccgaggcacatttattttttatgacccagttgtcaactgttagggaatggtgcccaaatggaaggatgagggatcactcactcgtgccaggggctctgccaggagcttgcttttacttaattctcccaacggttctttaaataaggaattatgatcatatctgtttttcagaagaagtagccaggctcagagaggtgaagctacttgcccaaaggcacacagcttttaagtggtggagtcgggactgggatccaggttggcctgactttaaatttggtactttcgttcttcccactgtcatctcagatcacgattcagatcgtggctgaagacaatgtgctctaaggtctggtccacgttcactcttgggtcacttctcccagcctcagtttttcacctgtgggatgggtaaagcaacacccttggatgacaccaaggattgggggctcagtgacacttactgaccgtgcccttccccaaatgggtggccttgggcaagtaacttcacctctctgagtctccattgcctcctctgttggttggagagacctatgcctgcctcgtggggaaaaagcacccagtacaacagaatacgtgctcagtgaacactttctctcctctccacttaaatggactcttgatgctgagataagaagtggattggtgagatgctgagcgacgggtagggcagctcctggctgtggactgacacctgtcctgccctccctgcagtctccatgaggttcactggcctgtgcgggcacctatgtgatgtttcttttttttttcttttcttttttttttttttttgagacagagtctggctctgtgcccaggctggagtgcaatggcgcggtctcggctcactgcaacctccacctcctgggttcaagccattcgcctgccttagcctccctaggagctgggactataggtgcgcgccaccatgcccagctaatttttttatttttagtagagacggggtttcaccatttttgccaggatggtttcaatctcgacctcgtgatctctctgcctcggcctcccaaagtgctgggattacaggcgtgagatgcattgaatcagtgtccagcattttcctccccaagttagctcccgttccgggaggcagaggggtgggaatccttgggcaggttggttgtagaaacatccttccattcagttcctttacccctgcccaatgtctcccagcccatggtgtgtgctctgtgtgtcatctctttgcacacctgtccccttcagtggactgggagccccttgagggcagggtcatacccgattaacttgttatagagtatggggcatcaacttgggcagcaatggggaacggtgtctctggaaggtggaacagcctgggtgaaggcatggaaggagagaggcagcagtaagtggaaaccaccgtttattgagtaccactgtgtgctggcctctgtgctgggtgctttacacacataaactcatttagtcctcatagcagccctgggaggatgctaagatatgatttccattttatttatgtattttgtttgagacagggtcttattctgtcatccaggatggagtgcagtagtgggatcatagctcactgcagccgtgaactccttggctcaagtaattctcctggctcagcctcccaagtagctggggctacaaggacatatcaccatgcctggataatttttatatattttttatagatacgagaggtcttgctatgttgcccaggctggtctcgaactcctagacataagcgatccttccaccctggcctctcaaagcactaggatgacaggcatgagccaccacacctggccttatttcttctttgaagaagtgcaaactgagcctccatgcacggggcaagggacttttgcaaagtcacatggttgggagtgcagagtctagagggcgtccagctctgactccaaatccaaacctggcctctctctggattgtaggaatctcctgggcgctctaagcccagcctggtttaatggagagagaatattttggattttattttcttttaccaaattacctgaagactttgattgaccttgagactttacctcagacaaaccctgggcatcttacaatttgaattttatccattgatttttaaaaattgaggtaaaacataaaagtgtataacgtatactaattttaagtgtacaactcgatgtttatattctctctcccatattctttgtctctctcttttttttttgagacggagtcttgctctgtcgcccaggctggagtgctgtggcgcgatctcggctcactgcaaactccgcctcctgggttcacgccattctcccgcctcagcctcctgagtagctgggactatgggcacccgccaccacgccaggctaattttttgtatttttggtagagacggggtttcactggttaaccaggatggtctcgatctcctgacctcgtgatccacccacctcagcctcccaaaatgctgggattacaggtgtgagccaccgcacctggcctttctctctctttcacccaggctggagtgcagtggtgtgatcgtggttcactgcaaccttgatttcgtaggctcaagcaatcgtcccgcctcagcttcctaagtagctgggactacaggctcatgccaccatgcctggcagatttttaattttattgtagagacagggtctcactcttgctcaggctagtcaactcctcccacctcagcctcccaaagtgctgggattacaggcatgagccaccacagctggccatgttattattattgtttattatttatttatttttttgagatggagtctcactctgtcacccaggctggagtgaggtggtgcaatcttgtctcactgcaagctctgcctcccaggttcacgccattctcctgcctcagcctcccgagtagctgggactacaggtgcccgccacttcgcccggctaagtttttgtatttttagtagagatggggtttcaccgtgttagccaggatggtcacgatctcctgacctcatgatccatccatctcggcctcccaaagtgctgggattacaggcgtgagccactgcacccagccaatgttaatattattaaacacacatcagcaactatctgccagatcaagatacagaacattcctccttccatgaaaggctcctttgagccccctcccaggcaatctccatcagaggtacccatctcactccagactaattgtctcaacttctcttaccatgttagtttctcccattcttgaactttgcataaacagaagcacatgggatgcaggcttttgtgcctggcttctttgactccacactgggtctgtgagatgcctatatgtggctgcgtgtctcagtggcttgttctttttcattgctgtgtagtgctccatcgctgtgctctgggtataccactctttgtggctccattctcctgctgatagacatttgggttgtcagttgacttattctgttcacttgacttctttctgttttcatgattttgatccaaagagtttcttttgtcagggcactctgcagaggtgtttgaagaacaattggctctctggaaatttaagaaactatgactgttttcatgatcctaatcattttgaatcagaaacatatatatttattgatccatgtcttctgttcagaaaaaagacattgggaggggacaaggaagagaaaggagcaaatgagctttagtggaagttttctcattcttctcttcacacaagctacctggtagatggtggaatccttctgtaatttaaagtcaaatgctcataggccacagtgggagccataataaatgtgtgggcactgtccttttggcgccctttttctgctactttgagatctcataaataacagagtatgttgctaagatgccttccgtccctctgtttgctccagctgcagttgctaggttgagctcctggttgctagggattttgtgatcctgtggcggcccagaaatatgatggatcaatggaacatgcttttgctattaactgaaatgtttcccaagcaaatctcttaatgtcactgtatgctttgacgtcgtcccaattggttgatgattcttgcaagtttcccagttagaggaagtggcttgagtggaggggacaagtatcttggactgggaatcagttcaagaatcagaaaagcctgcttctagtcttgtatctgatactaatttgctgtgtgaccttgagcaagtgttacccgctctctgggcactggttgctgcaaaattcaaagacttgctggctttaacagcttacagttcatcacccaagttctctaagcaggccaagtgcaaatcagtttctcattatcggctggtggattattgacaaaagaattcccattcccggctcacttcctttccacccagcaggcttctgggctgagtgtccttggccagatggtgtgtgcatagtagcttcagactaattttaatattcaatcaaacataattggaatcataaatcttaaaaaaaaatcctataatccataaacatctgatcatgtcattttctgtttccttctgttaaaatctttggcaggctgggtgcagtggctcacgcctgtaatcccagcactttcagaggccatggtgggaggattgcttgagtccaggagttcaagactagcctgggcaacatagcgagaccccatctgtaaaaaaaatgataataataaaataaaatcatctgggcatggcagtgtgcacctgtagtcccagccacttgggaagctgaggtggaaggatcgtttgagcccaggagtttgagactgcagtgggctataatcacaccactacactccagtctgggccgtagagtgagaccctgtctaaaaaaaaaaaaaaaaaaaaattagcagttttctattgctgcacggaagacagaaaacaagtgccatttcctttagtgggaaagctcagttggtggtggctacaagaagcagtatcctgaaaggaatctggactcactggcttgctgtaggatcttgattgattaatgatgtctgttatgagctcaggaatatcgtgggggcacgtatcagtatttaccaatcatgactggagtttaaagcccacgccctttagtatcatggttgaggccttcaagggtggcccatgctggcttctccagctttatcttctccccatctctatctgacccacctccaaaaataactgcttccagacggcgtggtggctcacgcctgtaatcccagcactttgggaggctgaggtgggcagatcacttgaggtcaggagttcaagaccagcctggccaacgtggtgaaacccttctctactaaaactatgaaaattagctgggtgtggtggcgggtgcctgtaagcccagctactcaggaggctgaggtgagagaatcgcttgagcccgggggcgcggaggttgcagtgagctgagattgtgccgttgcactccagcctgggcaacagagcgagactctgtctcaaaaataaacaaaacaaaaataactgcttccgtcgaccacctattgtctccccaaatcccctttgctcatgtggttccctttgcctgttgggacttctattatattaaattggccaactctgcctatttatctttcaaactgctatcacaatttgatctgctctatgctattccctttggctgtcttgggtgggattaattaccccttcttcctctgatgtcccatgattctctgcatagacctatagcacaacttaccctacagagcctacctctaggccctacctatagaccctatatggcctatgtatcaacctgtacccatagcctacctaccacttagcccttttcatacttagttgcttttatgtctctttccagttctaccttgagagggcctcaaagtcaaggtctgggctttgctcatctttgcatccccagaccagagccccgcatagagcagagcttccataaatctgtaatgcgtgcacacatgaaggaataaaagccacactgcatttcaaagtcagagaaaaatgatttggataactttcccagtcgcctgagtttgtctgtcagtactcctcagcttaattgtgggtaatttattgtggcaataaaatgacccccgcattccttcgagacggagctcagcttcaagttgtgagcttgtgttttctccatcgcgatggccttgttttcttcctctctccctttgcccgcagcctgaagataaacagaaggcggcagctgcctttgcccagctccagggtgccatggagatgctcggcatctcagagagcgagcagcgggctgtttggcgggtcctggcagccatctaccacctgggtgcggcgggggcctgcaaaggtacgtccttcctgccgggctcacctgggagggcagctgtctcctttggcaggtgcctgacaaggcccttctctcggagcggtgggaacagggtcaatctgtcaccttctatgtctctgggacttcccttggggaggctgctgaaactaggcgtcgtgaggaggacacagggctggcttttcaagcaaaccttctagaccagctctgtccacaagaactttctgcaatgatggagattactgcggttcagtgcagtaaccactagccacaggctgctactgaacacttatatatagtagtgcgactgaggaattgaatttttaattgtatttaattctacttaatttaaatttaagtagtcataggtagccagtggctactgtactggcagtacagtagggcagctctagaatatgcaagggaaggttgggtctctgcagtaaaggtgctgtgtttttttctttttctttttaaaattttcattgagatagggtcttgcattgttgttcagggcagtagtggtgcgatcatagctcactgcagcttccacctccttggctcaagcaatcctcccgcctcagcctcctgagtagctgggactacagctgtgcacccccatgcctggttaatatatatttttttatttttttgtagataggggtctcactttttgcccaggctggtctcaaactcctaggctcaagcaatcttcctgccttgacctcccaaagtggtgggattacaggcatgagccactgtgcccagccaaggtgctgtgtttctagttagacatcctggagatgttccctgccacatgccctgaaactgatcttgtatccttgtccccatccttaagtgtctgcttgcgattttccccattttgacctggtcttccaagtggttcctgccatccccctagttcttaccctctccgtatccaatcattcactatgttccagagatagtctctgtgacatcatttctgtcctagtttctctatccttactgttatcaccttatgcggtgtttacgtttgtgtgtgtgtgtgtgtgtgtgtgtgtgtgcttggataggtgcagtagcctccttgctgatacctgcattcctcctcctacccattctcatcatgaccatcaggttcctttctacaacatagacccgtaatgtcattctccgcttagaatcctctggaggctctcccttgcctccaagtcaaataaaattccttggcttggcattcaaagctcctcacctcctcacctcaaaagctgctcccttttttggcaatatagaaggttctggggagagagtggggatgaagagcaagggtttctgccttcatggggcctttggtgcattgtattatgattgtgactttgtctagctcttatcagtggctggtggcttcctttgggcccagagcatagaactggaagttgcttattgaatgaacatgtgtgtgaattgaggtctgtcctgggactgtgcatggattctggctgacattctgggctgttaccttggcgggggcagtagaatcttcgagaaggtgctggtgcatcctttccgtcatccccacattcccgggccctgtggcctattcctttgattctcatccatttgagccacatacattaacccattgttttgattttggaaatttgtagaagtcatactgagtcaggagtaagtaagatggggattcaacagttgatccaagccaaggacagacatgctgggctggggcaaatatgaaaataccaaatgccacttgtttttccaaaaatcatccatggacattcacaatggcaaagatatggaaccaatctaagtgcccatccaccaatgagtggataaagaaaatgtgagatatatatatatacacacacaccatggaatactactcagccataaagatgagatgaaataatgtcttttgcagcaacttggatggagctggaggccattattctaagtaacttgagaatggaacaccaaatatcatacattctcacttacaagtgggagctaagctatgaggatgcaaaggcataagaatgatataatagactttggggactcaggagggggaggttaagagggggtgaaggataaaacactacatatttggtacagtgtacaccgctaggggggttgggtatactaaaatctgatcaatcaccactaaagaacttgaccaaaaaccacctgtacccccaaaatgattggaaaaaaaatcagccgtgggccatgctcagcgcttggctgtttgggcatcaccactactttgttcagggaactgtaatgtctctcactcaacgtcctggtcactgaggccaacctgagtcagaaacagacccttagacagagatgtgggaacatgttgcatatttggggaaggaccccagaaggctgtggcagggaaatgggaaaatgacacaggagagggaaggcaggtagtataaggtgcatgaaggagtggcttacccctgggaaactgaggctcagtccagctggggacccctgggagactctgaggaatatgcctcctggttgtcctatccaagagacaaggaagttgagatatttatccagagactaagggggagccccctggcttattagcctgtcaccagggaagtgtaggagctcaattttattcctgagtttctcctcctggggcagagtgggggggcccccgccccctgatgtgggctcaaggacctgacccatcacatcagtgcatctgatgataagagaaagtcacttttataaatattttactaatacttgatgatggcaataatttctgccagtcctccccctatcccacgttataaattattttaagaagagctgccgtcagtctgcctgggaggcctgcccgatgatttacttacttatatattctgctttgaaagatttcataataggttgctctaaaatcagctattaagaatttcaaagtcgtacataaatgtctttgctttgtgtcataacagatcattttgaaatatattaagaatcattttcattaatcaggtttttttttcattaaaatgatactcccttctcagtgtgcctggcttcctaactaattctgagagccccaatcctgtttttaaaaatcaataatagttccctttggggagaatttgggccttataactggacacagggtttttgaactgttatagcaatgacaatcaccactaatattggcctggtgtttgacagtttcaaaagcacttatacctctattatgcccttggattggattagatgtatgtgctaacttaatgggcaagagtcaggagtcagcctgctggatatgaatcctggctcagcctctctgagcctcagtctcttcctctgtaaaatggggctaatgatggtacccactttgtaggcttctcgtgagaactgaaggagtcagtggcaaaaactgtggtacacaggacttggctcctggcggggtgtttcataagggttcattttcatccgtctcattttatagacaagcaaacagaggctcagagaaggtatgccactgatctggtatcacacagccagtaccttccagagtggggtttgggccattctcattttcctggggccattgtgctgagtgtttatagacccgatgatgtcaccacctccttagaacagcctgggaggggtgaggactgttacgatgcccattttatagggaagaaactgatgcgcagcagagagtttcacgcatattcctcaggacatagagctaaagctagagatgggatttggacttaggtctgcctgagctctgagccctgagaccagcctctgggaccacacctcctacctcccacctcccaagtaccctgtgttcctgcctatggcaggcctacaattcacctcaattctgagactatcctgagttagcagagttaacacagaccctgcaggttaaggattcaatcctacaagactgtctccacttcagatgccagctgcaagtacccgacctcccatacttctagccaagtggcttttacatagtgagttctcatgacccccttctcttgtctaataattcactagaatgactcacaggattcaagaacacactttacttacaaccactgctctattataaaggatacaactcaggaacagggcaagggatggggagagggcagagactcctgtcctctctaggcatgacagccgacagcctcccagcactttgatgtgttggaagctctctgaaccccatcctttaggggtttccatggaggtttctctatgcaggcatgattgatcaaattattggcaattaactcaatctccagctcttctgtcacatcttaaaaagaaatcctatagctgggccaggcacggtggctcacgcctgtaatcccagcgctttgggaggctgaggcgggcagatcacaaggtcaggagatcgagaccatcctggctgatacaggaaacctcatctctactaaaaaaaaatacaaaaaattagccgggcatggtggcagacacctatggtcccagctactcaggaggctgaggcaggagaatggcgtgaacccgggaggcagagcttgcggtgagctgagatcgcgctgctgcactccagcctgggcgacagagcaagactctgtctcaaaaaaaaaaaaaaaaaaaaaaaacccctatagcctttagctattgccctctaaacacccatccctaagcaatgctttcccccagccataaacaaccatgaatctactttctgtctgtagatttccttgttatggatgtttgacatgaatgcaatcatgtaatatgtgcatatctttgttgtcttttatgactggctgctttcttttttctttctttttttttttttgagacagagtcttgctctgtcgcccaggctggagtgcagtggcgcgatctctgctcactgcaagctctgtgtcccaggctcatgccattctcctgcctcagcctcccgagtagctgggactacaggcatgtgccaccacacccggctatttttttttgtatttttagtagagacggggtttcactgtattagccaggatggtcttgatctcctgacctcgtgatccgcctgcctcagcctcccaaagtgctgggattacaggcgtgagccaccacgcctggctgtgactagctgctttcatgtggtgtagtgtttgcaagagtcatctattttgtaggatggatcagtattttagtcctttttattatggctgaattatattccatcatatggatataccacattttgtttacccatggaccagttttttttttcttttattcttcctgagagctgggtcatagtaactgctcagaaaattctagtagaatgtatgccccaaactggcttgcacaacaggtaaaattaggcccattttgtaaaggagagcccagaggcagagcggttctgtgatgggtcaagtatgtatgtgtatgccaagaagactagactttgcagtcagccacctccagccaagtttcagctctgccttttaatggatgtgtaatcttgaacaggtcacttcccgtatctaagcctcagttctctcatctataaaatggggacagctatgataccttctctatagggtgaggagtgatgaaacgcaacgatgttcataggaagccattagttcagggctttgtggttctggaaatgtgtctgttttgtttgtcctgcagatcccatggtagacataaaccagtcctctgggtctgtgtccccagtcctctcttaaacttctagccaattactctgaacttgttggggtttacactattttgacctcaacttacggtaagaaacattttacctcttgacccagtgaacacacacacacacacacacacacacacacacacacacacacatattttatagagactaaaccacagagggaatcttctgtattcgtgagtttgaaaaaagaaaaacaaaaacacgccaacactggcaggtagctacaaccatgcccagaaactcaccgtggtaaatccactttctctgcagctacaaatcccattttgggttttgtttcacctttattttgatttttaaccttatacagtctctccacctggccaccagagtggcccttttcacacaaaacccagcccacaccattcctctgtccccatgcctgcccaggttgctcagaggcaagctaaggcagccacaaagatctccaagcttccacggaataggggagcaatgattcccaagcagtctctgtgctgagttacttgctagatcaccggacctgaggaaatattcaagataatgccttaaggtgagtgtggtgcagttgtggctcagagaggtggtgtgacgtgcgcaagggcacacagctgggaagtgatggagcacaaagctgcttgaacctaaggctctcaggctttacacagggaccaggacccttcttagttacattagcatagttgaggttttcttctgtgtgtgtgtgtgagagagcactcctgaagtctaagcaattctcctgtgtgtggaaggtagcttttggcacaagccaggtgggctcaggtggacaccctccatataaacttcttggttgtccagggcaactgtactttgctcagcctggatgtcagggggtggccctgctctgtctggcaaggtcccggcagcgagaaggctcctgaacttgcattagatgttgcctgacagccttggcagatggggcactgtcaggactgtgagatcggatatgatggaagaccgtgggcatcacccatagacccctaattgtctggttcacctaggatgtccatgctgcgcaaaaggtgtggtgggcttgcctgctgaggagggctcagcgaagggcccatggctgtgatgggcaaggagatgctcatctctcagctcctctggtgtctggaggtcaagtatggcctcccctttccctcactcctcatgtacaggttctgagcgtgccctccctgtgcccagctctcagtggggatggaactgggcagccccatgttaaggcacccttcccatgccagccccacgttgtgatttagcacatggcatcccattcgctcctccagataaactcatctgcattctgcagatgaggaaactgaagctcctccaggagaaaccacttgcccagggcacacaatgaggctgcacccgagcttggactgggactcaggtctgtctggctccaaggcctcttccttccactgcagcatgcaaaaaggatggtcaaaggacaaatgttccctgtttggggactctcaggttggaccagggcaagatcgctgtggatttattcttggagcctcagctgggagccctagagctctctccagggatcctcgtcttatgatcacgtcacccaattggacataatctctgtcctggaagcctggaatggcttcccagctagtctcctggcttcccttcttccccatcctttctaccccgatctgttctcatgccgcagccagcaggaactcccaagttcacacgtttggttgggttacttcagtagagctaccgatgaccctgtatgagggcaattccagctggtctggtccctgcccacctctccagcctcagtttgcacccatgatgctgtggctcagctgcagaggatgtttccagtttgactctcttgctattccctgcaagagctgtggtatggcagtcttgtcctctcccgctgtccctacttccctttgtcaacccctcagctcttgattcgaaagtcactgcccccacaagccttccctggccctgagcaaggtctggttttcctgctctgtatgctccaggcattccctggccacctttatttatttttcatgtgggacgattgattattggattaatgtctgtctcccatgctgggctgtagctctgtgagtacagaggtcttgtctgattctgctcatcgttgcatccccagggcctagcacagggcctggtacatagtatgtgctcaataggtatttactgagccatgtgacttcttggcaactctcaaaggagggagaggttgccctggaatggaggtgcgatgagggatgtgaaggggttgtgcacttaatcacattggcaggtgaaggagagggaccatgcaggaggacagacagacaagggcactgaacgacaaccactcggctactgtgggcatcccctcttgccctgactctaggacacctcccatcacaggacaggtggctcctgggcttagtcagtttattacagatttgtctcgagaggctgggcacagctggcctttggatcttagaagcctgctcttgtggtggcaatgagactgcatccctccctctgcctgcatagtatccacacttcctttctgtctctctggcttgccatcactgatgggttcctggggaaggcagcgggagggggctctgagggctggcaccacatggcaggcagaaaacaccaggtgatttgacatcgtggttgatttgctgttcgccaaggctcatggctcaagccatcactccaggtccattagacaacaattcatccaagctcatgcttctctcctttggcaaaaagtggcctgtggaaccattagctggtgcttgtgtatttcgaatggcaggcaatggatgctctctggagctaaacttggtaaagagagagtagggaggaggggagagctggcttcccagaactggacagagaagcatttgagtccaggctccctgatctcctggcagtgtgattcaccctgtgtcagtgacttttcatctcgttggacctcagttttcttgtctgataataactccacctaccttctacaatcattgtacagtcagataataaatgtttagtacttggcacatacgaggtattcagtaagcagtaactctcttttctttgcaaagcattttggttgtcatttctttctgttggcattaaagcctgcctctgagatgggcttggtgagggttgttaaacccatttggtgagtgaagaacttgcacctctcagaggtgtggctcctcacctaaagtcataaaatgaaacttctgtgctagagaacagcaagttcagaaccagaatccagttctagactctcagctcagtgctctttacacagcttagcagaaggcccgagaggccaagggtagtgtagggcagtggttagagcacagtctagagtgacacagatctggactcagattgaagtaagaattccagcactggctggctttgtggctgttctgttacagtgctgctgaaggaatcagccccaaagcccatggcttgaacaatcactttattatttcccaaggcttctgtgtatctgtactttggaagggctcaactgggaggttttggcttggggtctctcatgtggctgcagtcaactggtggctgatgaagcgtaggaaggctggaatagcccatttcccaggcttcatgtggtctcaggtctctccctgtgggctagttgggcttccttatggcatggtggcttcaggactccaagtgcaagtttccaggaagcaagatggaaggtgcatcaccttttctgagtggcaacacttctgccatgttctgttggtaagaatcgtgtcacaatttcaaggatgagcgaaaccaaattccacccctagatgaaggagcagcaagattctaggacgtataggatgggagctattggcgtggccatatcttgccatagtggccttgagcaagtaacttaagctttctgaggctcagaaaactgaggctcagttttctgagcctcacaggtctgttttgcagatgaactgagatgctgtttgccaagagctttggggtacagtgccaggcatgtaagtaagagttagattttaaaaatcataatgttgcaaagtttccatagccaatgcatcccggtccctactgtggtggggatggaatggctcctgagacttttgctctctgttttattaccagtgcccccgaccattctctgagacccccaaaagaccttcttcctacagaagagtaaatcaaggatgaactctatgtcctctttgcagcaagatacgatttctctgtcttggggcctcttttcttgtatgagattaaaatcagacacaatcctcttcccaggaatgacctctgttaaaatcctctccaagttttccctgttctccacctcagccccaggctggggatcactttgcataaattctcacttttaattctcacagcaaccctgacaggtagggaaggagtcaccatttttgtggtccaagatgctgagtctcaggatcttgcaatctttgtcaaagtcaaacagcagcatgtgatggggccaaggtcagaactcagtacctgtctgcctccaaagttcttgctcttctccactacaaggccacccagctggccaagctggtgggtacattctgggtgctaggatctccaccctctctcctgagagcgcctcctcagctccatctaatctccatccagtccccaatttggaaggttgtccctctaagcagaattgaggagagctcagactcggggctaaaggcatggggtctggaaccaggctgaccagtgttcaaccctgtttctcctgcatggtccaggtgactcctttgacctgtgagactcaatgtcctcatctgtaaagtggggataatcagagtgcctgcctcctagggttcttgtgaggctgacattattgaacttgagtatttaaagctgtgtcattgctatcattggcattattgttattaacgaaaaatcagtccagggcccaggagagttttccccagcaacttttagaagaggctgacctgggcggttttttttgagacagagtcttgctctgtcacccaggctggagtgcagtggtgcaatcttggcttacagcaacctccgcctcctgggttcaagaaattctctgccttagcctcccgagtagctgggattacaggtacctgccaccacacccagctaatttttgtatttttagtagagatggggtttcaccatctcttggccagtctggtcttgaactcctgacctcatgatccacccacctcagcctcccaaagcgctgggattacaggagtgagccaccagcctgggctggtctttaaccttctctgatccctgtggtcctgtagctgtaagagttgatgtgcatctccctggagaatcagactattggtccacctgcctcctgtccctcaccacttgacagaaatgacagtaatgttcggaactcaaaatagtgacaaggatgagcaatgcttgtcttgatgggggctttgcttggtttcctttttctctgaaggcccatgggttatttagtttatttgtctctcacgaaatttgccagtctacttgctgctgacccattacttaatatacgacgcagtcagaaccaaatatatcccagcgaggtgccccatgatggggttatgaagggaggctgctatctagctggcacctcactccccgcctgctaccatcataaagttatcagtgctggaatggatggggctgtaactcagggagccaggaggtgctcatggggaggagagacaatatcaataatgacaagggcccagtcccacacagaactgggataccccgacaccagtagcaaggacggtccatccaggggtaggaagaagtggctggatgctcttcaagctgtggtaagacctgagtgtagatggtcagtgatagtaacagagggactgttaacataacacaatgaccatatattcaagagctttgggaagtgttttaccagtcttattttaaagcaatcatatgaggaatacgtcaatgttgtatgtctataaaaaatggaaatagtccagaagaatagaaagtttaaaaaaaaaaaaaaggtctttcctcacaccccagtgccaaatcccattgctatgaaaggtgaccactgtgaacagtttggggtatacccttccttcaggctttttttttttttttttgagacagagtcttgctctgttgcccaggctggaatgcagtggcaccatctcggctcactgcaagctccgcctcccgggttcatgccattctcctgcctcagcctcccaagtagctgggactacaggcgcccaccaccatgcccagatgttttttttgtatttttagtagagatggggtttcactgtgttagccaggatggtctcgagctcctgacctcgtgatccgcctgcctcagcctcccaaagtgctgggattacaggtgtgagccactgtgcctgtcctccttcaggcttttttttttttttaataggctataattttttttttttttttttgagatggtgtctctctgtgtcacccagggtggagtgcagtgacgtgatctcggctcactgcgacctctgcctcccagtttcaagcgattctcctacctcagcctcctgagtagctgggattacaggtgtgcgccaccatcccagctaatttttatttatttatttgtagaaacagggttttactatgttgctcaggttggtctcaaattcctggcctccagtgatcatcccgcctcagtctcccaaagtgctgggattacaggtgtgacccaccgtgcttggccgactttaattctgaaagcattttagatttacagaacaattgaacagaaagtacaaaattcctacataccgcttctccctgtccccacagctctccctattactgatatcttgtgatgaaccaatactgatactctattagcagcaaaggtccatctatactctttctgttgtgttccttgatgggttttgacaattatataatgtcatatatccgttgttagtatcatacaggataatttcactaccctaaactggctagttttgtttttttcttaaacttttttttttcttttgtgagactgagtctcgctgtgttgcccaggctggagtgcagtggtgtgatctcggctcactgcaacctctgcctcccgggttcaagggattctcctgcctcagcctcccgagtggctgggattacaggtggccgccactgtgcccggctatttttttttttttttgtagttttagtagagatgtggtttcaccatgttggtcaggttggtcttgaactcctgacctcaggtaatcctcccacttcggtctcccaaaatgctgggattacaggcatgagccaccgcgccaggcttttttcttaaacttttgatttgaaataattatgcaatcccaggaaattgtaaaaatcacacataacattccatgaaacctttcccagcagcccccagtgagggcgtcatgcatagccgcagtacatattgaaaccaggacatcgacagcggtgcattactgtaatccaagcagccgtatcttcaggcctcaaaactgagcatttaactacatctatgcatttaacacatatgtggattaagtggttggttattgctttttatgccagtgggttcacaccacctttgttctatgccctttgcttttttcacatgtcatatcttgccttgggcctctttccacattgcttcatagtgatattcctgattctcttcgtcagctgcaggggactgtccagaatgaatggacctctgtgtatatgacagttctgttcatgagcattcaggttgtttcttgccattttggtattataaataacagcacactgaacatccttgtgtacagacagttgtgcgcattttggaggcatggtttcctggcaggggaactgttaggtcaagggtgtgtccagtgttcaacatttcaatgaacccacccaattcacctccctggatgttaacacggacaggttgactcatttagccctcacaaatctatggggtaaatactatgaggttatcatttccatctgtaggtggggaagctgaggctcagagaggtgcagccactaattcagggtcacacagtcccaagtggcacaaagctggactctctgtctgccatgcactgtgtcattgggggtccaaggaaggcttggcatttttaaagggacttgctctttccactttaaggatgctacctctgtcctctcctccaagacaggcctggcctgtctgcatctctgggctcacatctattttcttaggtgaagaatgcggggctcagaagagcccgaccaggtgcccatctggtggcttctgactgcagctcataactctgcttggctctcctccaattctgagaggcttctcccttccttctccacctccatcccagctgcttccaccccttaatgaggtgagcttcaccctgtaatgaggtgctccaagcccagagtacatttacttcccctacatttttcctgagggtgctgattagagttggtatctgggacccagctggctgggacagctttcttcaattcttcaagctctgaattaaagggtgtgaagagtggtggagtcaggagaagcgggagagctgcagggctgggcctgggtggcttctctgtgcagagggccttggacaagcaagttcagcctcccatggcctcaacttgccagggctctgccagttcccatagagatctctctgcatggttgaaagagccaaggagtcacttgcccacttggccctaagagcatccctgatgggtggagagtccaagggctggaaagggacttggactgcagtcagcctaagccgctctttgaacagggcagggaccaaggctcagagaagggaagagactttctcagggtcacccaatgaggctacaggggactcgaatcatggtcacctgactcctgagccagtgttctgttgatcttgtttgactctgtccctccttccctcctttctcctctttctcttccttctctcctttcctcccacctctcttcatccttctcttccctcctcctttccttctttctcatctccttctctcttttctcttcccttccttctttctctcccctcccctcttccctcttctattctcctctttcctccacttctcccttccctctccctcctcctcctccttcttccttctcctcctcttcttcctcttcttcttcctttttttttttttttttgagacggagtttcgctcttgttgcccaggctggagtgcaatggtgcagtctcagctcaccgcaacctccacctcctgggttcaagcgattctcctgcctcagcctcccaagtagctgggattacaggcatgagccaccgcaccctgtccctctcccttcttttcttctcctctgtgcctattggatgataagccctcaccttccaagatgaaatttcagtggaattaagaaagataaacccaggctatcttggatggtggatgatgctgggggcaagaattctgggcaggagacaaccaaagttgagggtggtcagctccactcaagggtttctagaggcagagacccttgaactgaatcttgaaaacagaataaattaaggagcgtgctctaggcagaggaacctgaatggcaaagacacagtggcttgattcagcatggagcaggttcagggtcctccttctcaatgcaaggcctagggcctctgtcttcctgttcataaagcatcagcctaagggcccctgcactggtgctgtgaacctaagggctctaatggagacaggattgccatgtggcctagcatcctggagatttcattgatccatccttggacccagtaccctcgaggcctgtcacctcctctgccccattctgcccaaatgccttcccacggctgcagaccctgcatcctcctccctgccccagctggtgacttggctctcaacctgacagctactgcaaccaggtctattctgggctgcaggcagggatttattctgcattttctgagcatgtagaatttattcataaagctggaatgctgcttgggatgtaaacaattaaatattttttaaaaatacatgctcagaagtggcgatgctggaagacggagctcactggtagtcccacaccttgggaaggtggagtgaggagattaggacacctgcgggaccctgatttcagactggttgagccactcacttgttgagtggctctgtgaaagttcctacccttcttttgggtctctgtctctcctaaataataacagtagctcacatttaatcagtgcttgccatgctcccaggcaccgttctttttttttttttttttttttttttttttttttttttttttttgagacagagtttcactcttgttgccaggctgaagtgcaatggcacgatctcggccctctgcaacctctgcctcccaggtacaggtgattctcctgtctcagcctcccaggtagcttggatccagacactattctaagagctttggctacttcaacaatctcatggagtagatgctattatcttattttacagatgaagaaactgaggctcagaggggagaaagaacttgccaaatggggtggactaggtgctctccagggtccctttttccttgattaccagataccctattcacccctttttggaagggagatagtgatggctcagtgagaactccaatatgtatgagttctggactcatcattcagagacaaagcataacaatactagcaataacaatgacagtggcgatgatgatggaatgaattgttaatatttactcagaattcatcttctgccagacatgatttaagtgctttgtatggattattccatttaatcctcataactctgtggtagattatacccattttatggatgagtaagtgaaggctcagagaagtaaagtaagttacctaaggtcatggacatagggaggggaagagcccaatctgggaccaagaggttctgtctttaaatcctacacccttattctttacatcactgaattgcagggttcataccaataaatggaattcataatcatgcctttttgtatggttgttgcattgatgagattatgtgcttagcacaggctcagacgcatggtgagtactcagaaaatgccagctactcttgggcttcccttggacccaggaaatagctttaaaggggacagtttgatagattgaatggcccctgctcagcctgccttggcgaggggcatgtgaatgtggaaagagcattagaggggaccatctagatctgggcttggtcctggactctaccttgctagctgagtgatctcaggcaagtcgtgcatagacttgcagctggtccattctttgagcctttgcccctgcaggtgccccatgtgacatcttccagccaaggtctccctgacaactctgctcctcaggttgggtcacctgctctgggacacactcctaggtagcttgacacattcaatgtcttatttcattcttaaaacaaccagatgggagaggagctaccccattttacagataaggcaactgaggctcagagagctgatatctcctacttgagatcttgcagccaggttgaaattatctttggacaatcagcttccagttctttccacaattcccaccacctcaaagatgcctccttatccatctttctcctccagcttcttgatcaaattagtttgagagacaccccaccccctcaacaggctcccttcctcttgtaaattccgcatacatgttggcatattcaaggttctgacaagtcctgcaagagggaaacctgttttgctgagtttagtttgatgttgctccaactgatttgtccataaagccttcttttcccccaaacacctgctcatagtccccagaacactgggaatggtttgtgtgctgtgttctcagttgttaaggttcgggcaatgattcatgttggattatgcataactcagcatcaatttatagatggcacatcggccaggcctttggacaactttctccaaacccagtcaggtggaacaatatgtccaggtttgtggggctgcatggcacctgagggcagcaggacctggaaggagccctaagaaacaggaatggatttgaagttctagcctctaagaatgagaaggttacattttccatgttctcaaaaatagaacttttctggttgtccctgggcagaaagccacagctgcctgaattggattttctcccggggtttctctttctgacccatttgtcatttttaagggaggaaatctctgagtgggatcataatagagttgacatttactgagcaggttgcctgttatgcatcctgcccgtataacctcattcattcttcttttatttattattatactttaagttctagggtacaggtgcccaatgtgcaggtttgttacataggtatacatgttccacattggtttgctgcacacatcgacttgtcatttacattaggtttctcctactgctatccctcccccagccccccacccccagacaggccccaatgtgttgtgttccccgccctgtgtcaatgtgttctcattgttcatctcccacctatgagtgagaacatgtggtgtttggttttctgtccttgcgatagtttgcttagaatgatataacctcattcgttcttcacaagcactccatggagtgaattctgttcgtcattcccattttacagaggaggagactgaggctcaaagtgttgacatgactttgccaacatcacgcggctgtaagcagtggaggtgggatttgaactgaggcagtctgtctccagaacattgccttttcctgtagcagctacagccttttagacttatctcttctctacaggcagcctccttcctcacaggcctccgaattgtaaacctctgtgtgaggaaaagtgaaccagatgcagcaagattataaagaagtcacataatgttgagtaattcagcaacagcacagctattgttggaaggagaaataacttggttattaataaatgcaggaggccacagtaattgatagcaattgaactcatagtgggtggggaaaaacagctatgttatttctctctctcgctctcattttgtatcgacataaagggaaaaacctgcctttgcaggtggatttgagcaactcagaaacggcagtttcattactttcccttgttccttttcctcccttcctccctttttctttctttctttctttctttcgttctttctctctttctctctctttctttcttctttttctttttcttctctttgtctctctttctgtctctttctctctctttctttccctccttcttttcttttctttttcttttctctctttctttctttctctctctctccttccttctccctccctccctccctcccttccttccttcctccctccctcttttctttccctttcctttccctttctctttccccttcccttccccttccctttcctctttcttctttttctctcatttctcttttgtttgttctctcaattcaaatcccagcctgcctcttaccaaaggagtgacctgacaaatggctcaggtgaggcagtttgcctggggtcacctggttaggtaactactctttcagctaaatcactctttccaaaaccactgtctcatggatcattagatccgcaagagattctgtaaatgcattctgaggccaactaagtctgaacagaatttctccttcttacagattcataagatatactttaaaggctctgagaagtcctgcagttaagaaacttatttaaccaagcaatgaccaaattgatatgatacaatattcatttatttcccagtgatactgatgaccattccatagaacaaccactacaaggtgcacctttggggaactctgatccccacctgtgtggccggccactctgccctgcttcacacccattctccaggagggcagtgaggaagggaaatggggtaggaaggcaggaactgtgggcccatctgccatggggacctgtttctccctagcaacccgaaaaatggctgacaaccaaaagcacagaccagaaatgatctctgcacttagctttgggatttccttgtctcctaatctccttgcctcctggtgggtggagagaaaagtacctggatagagtgtgtgatcccctctggagtgggctgggggcaggggaaaatccacttcccccaatggggagttccctttgaggaataatttctgtcctttctctctgtttctctctctctgcctctccctctttgtgtctctctgcctctctcactttggttttatcttgtatcccatcttcccttgctgtggctttgcaaagagctgatggtctacatggatggttccttgagcatggagcctgagatcagccacagccgggcagaaatcacatcttgtacctctttgcacaagaattttgactttactgggtctgttctgcatttgtgcactgcctcagagggttttggtgagatgaggcatggaaagcctttagctcagtgcctggcacataggctatgctcaacactcgatggcttgagaagaagtgacctcagctgactcagaagctctggggtgtgacccacatcccaagtgcaccaatccattatccattccacatggcctctttaaaaagcagtgaatagacaagaacctgcaggggaagtctctgcagccagcaggacaggataatcccttctgggctgaagggtaccctccttggttttgcaggtggagaagggaattgcaattttttgagcaccttttctgggccaggcactctgctgggtatctcacatgtaaccatctcatctccttcttgcaaccctatgaagaggtgttgggggttttaagattccgtttcacagacaaactgagtctcaaaaaggccgtgtacctggctttgtgcgacaaactgggaatagcagaaacaggaattggacccagatccagtttgggccaacacccatgttattgcccagttccttttctccctgcctcaggtgccaactcagggttcttgacctcccctgggaagagactttggtcactacccatgtccaagcaaagatagaagaatccatgggattggattttgtgcaccggccagccttcggggagctgatagtagaagatgcttttcctggcaaagctccctgtgtgcccacctggattgcaccagcagcatgcatctcagctgcacctgcaaatatcccccctaggtcaggcaggatttagagagtccagccagcatccattaaccactcttcttttcagaaatatcaattgccaatttcctttatgacttctcccagctcgttgaggccagaaacagttgcaagtgtttagagagcaggcatggagtagagcaagaggaggggacaggacctcacctacctagaaagacatctcctatttagttcactctcaatccccagcacaggaagaagaaagtctcattcagtgctaatagcctttaatgcctctctctaatatttgcttcttaacaaagagagagcagatttcaggctcacaggtaacagtatttaattagaatctaatgacattattgtgcttgtgtaatatttgtttctactttctatttgtggcaggtgataatgaattctcatttaacatagtgtgataatatttctgtttacagtgtatttaagtgaagatgaaaagtgagtccatttaaaagtagagtcacaaagatatggcaaaaaagatgatatttgaaggactgattttggtgaaaatgtagttcttccacttagtatcagcctgttttctggtgacttctctcaattagatttttaatctataaaatgggattaataatagagctttttaggactcttgtgaagatttaataataacaataataacaaataactacaactaataagtactgagctttttccatgtgtcactcctggaacaataacccaggcttttcaactgtaaaagtcatgagctgaacaaagacgcaatgttgaataaaatcaggtaagtgaattagatcacaccatcatcaccatcatcatcactatcatcatcactgtcatcaccatcatcatcaccatcatcatctccatcattttttaaagtgacaggatttttaaaaattagccatgttacctgagtctcagtttcatcatctataaaacgagcatagtctgtaaaatgaggttaatacagtgatgctcttgtgaccagtgcagagtaattggcacattaggaggatgtcagtaagcaatatctatttgtaatgcccttagtgattggggccagacctcttccttgggtagggtcaaagtcctagataaagtccttttccaaatttctagttttgccataagccagattggttcttcaagctgtctacttgaagaattgggccctcacaatctctttctgattgattgaaaaatccctgttggtggctgtgattcttatttcaaagaaggaaacacatttataggaaaataagagatgaaagagagaactttttttagttttattttttaagttgacatataataagtgtacatatttatggggtacatagtggtgtttctaaacatgtacagttatcagggtaattagtgtatccatcatcttgaacaattatcatttatttgtgttaggaacattcaatatcctccttctagctatttgaaactatataatatattacagttaactacagtcatcctacaatgctatagaacactagaacgtatttctcctatctagctgtgattttgtgtcctttaacaactctctccctatccgcccacttacctccccacaaacccttcccagcctctagtatgctctattctgctttctacttttatgaaatctttttttttagcttccacatatgaataagaacatgtgatatttgtctttctgtgcctggctatttcacttaacgtcctccagttccacccatgttgccatgaatgacaagacttcatgcttttttatgtctgaatagtattccattgtgtatatataccacattttctttacccatttgtctgttttggacacctaggttgattccctctcctggctacggtgaatcatgctacagtaaacatggggtacagatgtctctttgatgcactgatttccttgggataaatgcccagtagtgggattgctggatcatacagtagttctatctatagttttttgaggaaagttcctactgctctccatagttgctgcactagtttacattcccaccaacaatgtctaagagttcctttttttttttttgcatccttgccagcacttttgctttttgtcaccccatcctactggagtgagacgatacttcattgtggttttgatttgcatttccctgatgattagagatgttgaacattttttcatgtatttgttagtgaaaatgttttaaggacgacactattatttgttttaagaagtcatttattggccgggagtgggggctcacgcctgtaatcccagcactttgggaggctgaggtgggcagatcatgaggtcgggagatggagaccatcctggctaacacagtgagaccctgtctctactaaaaatacaaaaaattagctgggcgtggtggtgggtgcctgtagttccagctacacgggaggctgaggcaggagaatggtgtgaacccaggaggcggagcttgcagtgagctgagattgtgccactgcactccagcctgggcgagagtgagactccatctcaaaaacaaaacagaacaaaacaaaacaaacaaaaaaaagaagtcatttatttttctatggattaaaaaagtagtgctcaaccatggtagaaaatttggaaaataaaaaatccctttacctagctgtgatggttaatatttagccatatttcccttttattactttttacagcagtttagaatgatttgcacagttgatatcactatgatatcattttctaatctgcttttcacttagcattcaggtgtaagcattgtccatggtatgcacagtcttcactgctaattttaaatggctttataatggtccaaagagtggctctccattgattctttaatcccgtctggttcctctccccaccccgttacattccagccacactggtttgcttggcattcctttaacacaccatgctcatttctaccccagggcctttgcactgcctccttcaacctctgaagcacttcgctggttctttatgtagtacctccttctcacctttcatagctcagttaatacatcacgtcttcagatagaacccactttgaccaccatagacaccaaacaactcctttggtctctcttgatctcagcaccctgctttagtttctgtttggcagagggcagagggaactttataattttatggctggaaatgatcttatctatttgtttacttgtctgttgtcacactccctcaatggactataagctccatgaggacaggcaccttgtctgtcttgctcattgattttggtggcagacacagtgcctgtcacatgaggggagctcagtcaacatgtacacagtaagcagatggctagttggatggttggatgtgtgattgtgtagcaggacgagtcacagacaaaactcctcagacaccggattaaagaaggaagaggtttatttggccgggagtgccggcagacttgcgtcttaagagccgaactccctgaaaaagaaattcttggcctttttaaaggcttacaactttaaggggtccgcatgaagaggtcgtgataaatcgagcaagctgggaaacgtgactggggggactacatgcatcagctaacagaatagaaagttttgcaatgctttcccatacaatgtgtggaatttacagataacacaagtagtttaggtcaggggttgatgttattattattacttttttaactcctagggccgggtggtggtgccaaggttgtctggctatttatcttacttctgtttgtttccaactttttgctttctctttcctactgtcttgtgaactaggcaaggttgggggaggagggcagcaggagtagtagtggtctccttccttaattggatgaggagttgaaaggataggtaggtggcttgcaggggatagtgcatgcctggatgggtaggtaaatggatatgtgggtgggtgaatcaatcataattttaccaaccatcccccaatttcacagttagagtgcttccccatgatatttttaatcgctttgaaaaagtaagcaatgcaaatggcgaggaagtcggataagcaagtctcttgggaaatccgactcctccagggccattgcctaggggcccaggcctgggcagttgtccaagctcccggctgaggaggctggcctggagattgggagggtgctgagattctccgaggtcctctcgggtgttcattcaccccatgcccaaggcctcactgccacgcctctgttttgtcccctttgcagtgggtcggaagcagttcatgaggtttgagtgggcaaactacgcagctgaggccctgggctgcgagtatgaggagctgaacacggccaccttcaagcaccaccttcgacagatcatccagcaaatgacgtttgggccaagccgatggggcctcgaggatgaggaaaccagctcaggtacatggctgctgcctctttgggtgagctgggcccccctctgggccagctcctggggatacaccagcattctttaacttttttatcaaagatttgttaagggcctatgctatgaaggcgtgtgttagatgcaggggaagccatcgtgggtggaaagggaccggtcaatgctaatgctcaaataactatctccattcagtggccatgaaggctgctgaaacctggcagggagccccgcgctgtggggaggggatgccgtgggcagggccgatggaccaatgcatttccatcggatttcgtgtttgttgagcacctactaagtaggggaaagactagtctttctgtttgagggatggaaatcccgagtggctgctgcgaggtggagggatgggagaagatgagggtggagagcaaggtgtggtccgctcactaagggtttataaacgagggttttcattctcaggcccttgggaagccgtggagtggcttaggcagggggatggcatgatttggctttaagaagctcagcctggatgaaggttggggagtgagtgggagacaggagacccactgggaacctataaaaatcaccaggtgataggtggtggtcggaagtgctagtggagacggggcgaggtggacagattcaggggctagtttacaagctgaggtgatagcatgggccctaagagaaagacagagaccagcagtggctgctaggattttggccccagcagctggaagaatgaggatgctttgaactgccgtgggggaaaaacaggaggactttgtactgtacttgcaaggatgtgatctgctgggtcccaagtctgcagcctctgtgcatctttgggagctctctaagagcagctgtccttgagacagcagagtttggggttaatgagtaggagtgttgtgagctgtgattttggggcccatctcttggagctcctttgcacctttggagctgcttccaccttccagggacttcggcgtgaggactgatgtcacttggaccccattggccctctatgtctcctttcaggtctgtgctctggtgtgaactgtggttttcttgaagattacctctcctcttcgacatgcacacacattcccagaagcatacacacacatgcttatgcacacatggtgtgcacaccatgtgtgcatcacacatgaacacaccacacatatgcacagcacaacttgtgtatgcacacatgtgcacagataccacggaatcacacacatgcacagacactggcacacatatactgcaagcatacacagcacacacacagatatgcgtggcacatgtatgtgtaaacatgtgcacagatatatatataacacatgcacataccatacaactacacacacacgcatagacacaagcacacacgtgcacacatatgcacaggcacaaacaccacacacatacttaaggatgggtgcatcacacacaggcacagacagatgcagtcaccactttgtgagtctgagttaacctctcaggctgaggtctcaagagtagacattaagcaggcaggggaccttcgggcttaggagagatgctgggaggctgtgggttgcctagcaacagcccaggttgggggtggattcagaggaggggtgggaaatgctttcggggctgcagtgggctgcctggaatgtacaagcagaattactcctccaggcactagtgcgcactgatttggaaactgtgttttcaattttttagatagaactgaaacttaagggacggaatttgtgatctgatcccctacactcctcactctgctttgttcaatgcaccctaatcaaggctggtgattttaatgggatgcatatacatgcgtgtgtgtgtgtattcgagcaaaatcaagtccacaactgtaattatagtttttgagcctttatattcctcctaacgttctaggtaggcacttttccaatctcattcagtattcttcatacctgactttaagcattcctttgtatgggtagactacaaattacctaacccattttctattgttggtcactcaagtcatttcaaaaagtgatttttgccaatttaatcaacaattggaagaacctgtgtccccagaaagctttatttctctcaatatttcattagaataaaagcctaggagtgaaattattaggtcccagtatacgaacattttatggcttctaatacaaaattgtcaaatttctctccagaaaaagggaatcataaacatttactgagtgtctgctatgtgccagacactggcaatttaaaggtcagcaaacccagggacagcgcctatcttcagggcacgcccagcctcatgaaggagacacaggttaataaaataactatactagaaagatgatgctatgggaagtgctattagaagcaacacagagctgggaattggcctagtggtggtgatggtggtagtcaaggaaggctttcctgaggaggtgtcatttgggctgaaccctgagtgatgagcagatcactctggggtgaaggtagggcaggttacataggacgctgtaggccctgaaaggacacttagactttgtcctaagaacctggggaaataattttagcagtggagggatgtggcaagaaaagaaggattttctaaattgagtggtccctactgctctgcagtgatgtccttggccccaggcaagatccctaaccaagaatgctgattctgtcctctttcccagggctcaagatgacaggagtggactgtgtggaggggatggcctcgggcctgtaccaggaactctttgcggctgtggtctcactcatcaacaggtaacggggccttttcctaggcacacagttggcctcttgcaggtgcacagatgaattcacataccgggcagttgaacaaagtggcagtttttgagctggcgagagggtttctaaggtggacagtgctgggtttaacttctaccttggccacccactggctgtgaggtcggcaaatcagttcacttctctgatctccctttcctcgtctgtacaatagctctcttcccaaggactgttgtgaggattaaaagaaataatgaatttaaataactcttcctggccaagcgtggtggctcatgcctgtaatcccagtactttgggaggctgaagtaggaggatcacctgagatcaggaattcaagaccagcctggccaacatgacgaaaacctgtctctactaaaaattacaaaaattagctgggcgtggtggtgggcgcctgtaatcccagctactcgggaggctgaggcagggagaattgcttgaacctgggaagcagaggtttcagtgagccgagatcgcgccaccacactctagcctgggtgacagagcgagactctctcaaaacaaaacaaaatgaaacaaattcttcctaacagtgattgtaaaaatgccaataataaaatctaagtacttttgagtggctactgagggccagggattgcactaattgtgtaacctgctttgcatcattgaatactcacatgggcccattgtacagaggaggagactaaagcttgaaggggtagaaccgagatgcaaacacaatgccaccttctcatgtcataccttcagttcccctgaatagcccaatacattgctctcatccatttatttttcaaaattgtcttgctggggatgggagcaacatggtagaaatttggagtgggctggggtgtgcctctgatgtgtgtctgcggggctgcaggcaccaggagcctctgttttccatcgttacgcacaatgcactgagcccatgcttggaaacccttttagcagttttttcagcagagctaattcagagcctaggcaaaggcttgccttcctcctctgtgaaagcagaaagcataattaggcttctgaaatcctgttaaagggatgaggctggcgcgtagcaacagagcagccgggtttctccaagttgtcgtggacacagaatcaactccctctgacgctgctgaagtaattaccatctgagcccacagacatattatctagaaaccaaggggatcatgcgtgcttagagagggagtactgggaatgggaaatgaactgctggcggaggaaactgccttcaccagtgaagggcagctgcttcaaggtttgggttctcagaggccacatctgtgaaatgccgcatggatgatcaaagtacctactacagcatttataagcacctagtaggtgtctgtcttgccaagaataaaccgacttcatcttcatgcatgtctgtgtggtggctgctcttattatccccattttatagttggaaaaccttggcaaacaacagaagaaccaaggttcaactaagggcctccaaagctcctagctgatcatactcgtggtgatgagagcaggtggcatttactgagcactaaccacatggcaaactttgctttcacagccatggaagcttatcacacccaaccctcacaacagccctctgagctagtcaccatcattaactgagacggtggctaagacggtggaggctcagagaggttgggcaactctcccaagacacacatcccctctgtcacagagcaaggattgaagcccacatgtgactggctccaaaatctcttaagtcctaaattttgatgtgaataatccctgttgtgtccacccctacagattcatcaggagaatacaaggaggtgatagcttgaaagaattttgtaaactgatgtattaaataaaatagttttttgattttaataggcctctgaagaaagaaaaggagggcctaggcttcatatggtagccaacttctgggtgaccttaagctagtcatttttttttttttttactttgggccagtgggaggcagtttaattcctttagtccttatagctatccctgggataagcctactcacccccatcctcatttaacagttggggaaacccctgctcagagaggttaagtagcttgcctgaggtcacacagcctgtaagaggtgagcttggttttgaaaccagttctgctggaggcttggatcagtgtgctcctagattccatgccatctcagacattccacctctctcttctctccctagatccttttcctcccaccatctctccatggcctccatcatggtggtggactctccaggcttccagaacccccggcaccagggcaaggaccgggcggccacctttgaggagctgtgccacaactacgcccatgagcgcctgcagctgctgttctaccagcggacctttgtctccacgctacagcgatatcaagaggtatgcctgggctggagcagggctttcaccagagctccgtggatggtgtaaggtcagatgggaaggggtgggattcccattccccaggagcctgcagcttcaccctgtttggttcaccagagaacaaagccctttccccaggcctggctccccagacctctgttgctccctccacagcccagcctccccctgccaccttctgaaccccgcagcccagaagcaccaaggaactcgggcttccccagtccttgcttccacggctgtcctttctttgggatgactgcttcattctctcccacttcacttaagcagaaggctcctccaagagtcagtctgcatctgcccagggggggaatgccctttgagtcctgtgggtgggtggcagcagtgggctccacacccctctgcagcacagcacggtgagtctcacaaagttgaaggtacatgcatcacaaaacccagcaattcctcttctaggaggcacctgagagaaactctgtgtgtgaaccaggaagcatgtacaggcatgatcctgccagcccttcttttttcataaaaaaaaaaaaaaagaggttaagttgaaatataaggccaggcacggtggctcatgccttaatcccagcactttgggagcccgaggcgggcggatcacctgaggtcaggagttcaagaccagcctgaccaacgtggcaaaccccatctctactaaaaatacaaaaattagccagactcagtggcgcacgcccataatcccagctactcgagaggctgaggcaggagaatcgcttgaacccgggaggtggaggtcgtggtgagctgagattgcgccactgcactccagcctgggtgacaaagagagactccatctcaaaaaataataataataatataaaataaaataaaataaataaaatttacaaagaaaagtgcataaaccagaagcatatagctcagtgaatttacccaaatgaacatacgtgtgtctctatcacccacgtgaaaatgagagtattttcagttccccatatgactcccaccttcttccctgaaggtgtgaccacttttattccaataagtaccactggcagaatattagaaatggccatattgttcaccagttgaataatatagaataataggtattgaagttccagtcatttttttggttggtaataaaaataaagcaccaacataaatgaatctcaaacagatgatgctgatgaaacctgaggtctgatcctaactctgtcgcttattggctgtgtggccttaggaaaggcactcaccctctctgaccctcaatttttttttttacgtggaaaacagagataataatacttttgtatcagttatgatttgccataataatgctgcgtaataaactacccccaagtgtagtggcttagaaaaaaatcttcggttgttgctcacaagtgtctggatggcctgggcagctctcttggtccaggatggttcttgagcttgtgttcagattcaggtgtaggttggggtagatggctctgatgatcttggcagggctcgctcatgcgtgggatcagctggccatgaacggatctaggcaggccttgtctggggtaaccttgtccctgttccacaaatgtcccatcctccagcaggctagcttgggctgtccttgtagtgctgggcagggttccaagagagcaaacagaagcgtgcaggggaccttgaggcctggacttgaggcctgcacagaatcacttccactgtgttcggtgagtcacaacaggtctaaggctgagcatggattcaaggggtaggaaaacaggctccacttcttgatggaggcactgcagtgtcactctgcagagagtatagatacagggaagtgcagagaaccagggttgttttagatcattgttaccagactccccaaaggggccgttttgaacatttaatgaacaagaataaagagtgtaacagctattttatttttcccataatatttcacttatttctgattatcaatgtaatacatttttaattaaaacgctggaaagttcatatgagtataaagaaactaaagatacaatctcctttggcgcttctatccagaggcaaccattgttactattctgtttcttttttgtttgttgtttgttgttgttaccattttccctttattatgttgtccgtggattttggatcttcctgtatatatgagtttgttgtctgtcattttcctcacagtattacattattcacataacctccctccacttacaaatcttagtaaacctgcttgcagtggttagatctgattgtattccctctcctatagacatcagggtagtttctaagttcaaggctttataaacaatactgcagtgaacatccttgtccacagcatttcctggacatttctagtgattttttaaaattttttgttttttagatggaggttcgctcttgtcgcccaggctggagtgcaatggagtgatctcagctcactgcaacctctgcctcccgggttcaagcgattctcttgcctcagcctcccaagtagctgggattacaggcacctgccaccacgcctggctaatttttgtatttttagtagcgatggggtttcaccatgttagccagcctagtctctaattcctgacctcaggtgatccgcctgcctcggcctcccaaagtgcttggattacaggcatgagccacagcatccggcttctggtgacatgattgtggcaactattattccccatagtttacatttgttacttccagcaccgaacactcagcctagcactcattaggttctcagtaaatattttaaaagtttggaccgagttatcagtttctgataaagctctcagcatgacggctgacacgctgcatgatgagcagaatgtcattggagtgtggatttacaatctttcttcctacacaaaggctaaaaggtgatgaataaacaaacaaccccattagcaactggaaaaattaattaaacagacatttctccagagatttacaaaagcacacaaaaagaagctcaccatcacaaatcgtaagagaaatgcaaatccaaaccacattgagacaccacctcccacacactacaatggctactattaaaaaaaatcagaaaataacaagtgttggggtgatgtggagaaacttgaacccttgtgcagtattggtgggaatgtaaaatagtgcagccgctgtggaaaacagaatggtggacctcaaaacctaaaaaaatagaattcccatgtgattcagcaattccatgtctgggtatgtactgaaaagaattgaaattagggactcaaacgggtatttgtgcaccagattgcaacattattcacaatagctgaaaggcagaagcaactcatatatagattgcaattgacaggcgatggacaagcaaaatgagatacgcatattacgagatacgcacttactaggaagtattattcagccttcaaaaggaaggacattctgataaaatggtacatgctggatgaaccctgaggacattatgctaagttacataagtcagacacaaaaggacaaatactgtatggtttcacttacataagctacttagaaaagttgagatcagaggcacagaaagtaggatgctgggggagaaggaaatagggagttaagtctcatgggtacagagattccgttttgaaagatgaagaaagttctggagatggttggtggtgatgggtgcacaacaacatgaatgtaccttataccactgaaatgtatacttaaaatgactaaaatggtaaattttctgctatgtatcttttgccaaaatttaaaaaaacgatttttttaaagggccaagaggtgatggaaatcctctccgctttttccttcttcagaagttttcttcccccttcagctcgctaaaagtgctaacttttaaatcctgttattttccaggaaggtgttcctgtgcagtttgacctcccggacccctccccagggaccaccgtggctgttgtggatcaaaatccctctcaggtaacacagggcccagccaatccaggctctcagatgccagttggccatattgaaatgctggtggatttgagtcttcagtctactagttgtcaatgccgtgtgcacctagagtcaccccgggatcattggcaacgtggatgcctgggacccaaccccagattctgtgtaaattgttctgagggtatggcctgaacagtggaaatttaagcatcatcaggttgagaactgctgctgtcctttatgtctgagtctatgtcttagaatagactcgtgcctgggagcctgaggcctgagccaaagtgagttcagggctcatggccagaggccaccagccactctggcctggaaaggtcagatgtttgaatgaaggtgctgtgcccagcagagactggggaccttgggcactggagaacaggggaccatgttgggttcagggccctgaactcatctgggggcagacaggcgttagtttgagggaaactgagtctttacctcactctctccacccctagaactcactttgctaccccagatctgcacctctgctcgactcagaactgcccttgacaatttcacttgatttttttgtcttcctcttcacattttattacaaaagtgcttgggccatgaaacctgccatgcttgggtccagtcttggtgaccttgggcatgttacttcacctctctgagcctcagtttcctcatttccagaatggggatgctactttttctgggttgctgtgaatatcaatgagatattgcacataaggcacctggcgtgatgcttggcacacaggaggtgccctgccggtggcatctctcctgccatctgacactgcaggctgcccctccccttttcttccttccttgtctcctgctgaccagagatggcttgcaggctttctcttggcacacagtgggctgtacccatcattgcaaagccctctcctgtgtaagcccagctgactgttgtcagtgtgttcttctggttggcatctgtctagttcatttccttccacactgtgcttcctcacctgtgcctctcctaggaaagggtgggcctgaagggctgatttagcagtgttggctgggaagggcggggtagtctccagggcctgtggctgcaaatagctaccttcttcttctttttttttttcttttttttttgagacagagtctcactctgtcacccaggctggagtgcagtggcacgatcttggctcattgcaacttctgcctcccggattcaagcgattctcgtgcctcagcctcctgagtagctgggattacaggcatgcaccaccacacccacccttaacaactattttctgaggaccttctgagcgtgggctggctatcagtttcagccccaataaagaaggccaaggtgaaggatgcctgggatccagttccagctctgcatctttgactgtccatccgggagaccctggatgtgccccttcccctctccaggcctctgaggggtgtggattcctcagggtgaccaactgtcctggtttgcataggactttcccagctttagcactgaaagtttcatgtcccgggcaaagtaggacagttggttactgtgcatgttgcatttcctctataacaagttggtggcctttttttggttgtgccaactccttatgggccctcagagaggccctttaaactccccaggcctctctcagtttcccatatgcaaaattacagggttgagtagatggtctctgaagcttgtggctagatttcaaattctacgtcagtgctattgactcgtgttcaccttcttctctgaaatgttctttgagtgctttttttctcctccccaagattttagtttaaaaaatacaaggacttcttagaggaaacgatacagacagaattaatcctttctcgtttgtgcacaaatagaccagctgcctgtatgtatctagaaatgtgtaatttccagagggttccccttgttaaatccccaccatggccctccaaggaaggtattttcagtctccattacacaggaggaaacaaggctcagagaagtgtagtaagttgcccaaggccacacaggaggtgagcacagaggcaggattcagacagtttgcaaatgagaggttgctatagcttcaacactgagagtctggggtgattgggagcatggttttgggtaggcacgttctgagtcctgacacttgggacttggatgctctcattccctatcggtgggaagagaagcccaagacaggcttctgatgggtatcagggcccttcagtgaatcctggttctcccagcaggtccgcttaccagctggaggaggtgcccaggatgccagaggccttttctgggtcttagatgaggaagtccatgtagagggctccagtgacagtgtggtgctcgagcgtctgtgtgctgctttcgagaagaaaggagctgggactgaaggtaaggaagcagggggctggggatggggcctgagtccagcctgggtattagaatctgttcttctctgctgcagggaaagccctgacaaggcctgcacagaggctccaacgtgcagaggtgaatgtgcatgagcctgtgtatgctttcattcattcaagtattcagtgaacgcattgagcagccactatgtgctgggtactgttccatgtgttagttaaccagcctggcgtgggccagtcctcatggggaaggcacaagctcacagccaagcacatgcgtgcacagtgagcctgcaactgcactctaatggggcgcatcagggcgtttctcatttttctggtagccagtgggagatgcgtgcagatgcatctaacagagagccaggaacacgatgcaggacaagtttggagatggcttctgggctcagactgcagaggctgttgctggtcatgcaaaggtcttaaccctagagcaacgagaagccatgaaggattccaggcagtgggaggcatgatgagcttcatgttctggaaagttccctgaggttgtagtgtgaagatatggtaggaaggcaggtggtcagggtgagagaggagctggcctgccccaggaggtagaaacctctggaagtgtttagcaggtaaagtccatagcacttggtgggagttggattggtggaagggggagcaagaggggagatgaaggcgtgaaaccagaacaaagtgatcatgagatttggtatccatgggctccaagttgaagtccagttatttctgctttcccctgcatgatgtggggcaaacctctcgtagtcttagttgatgtgcttttaaaattgggaaagaagtcacccctggcccttttttctctagaatttctgctacgatgattgggtaatattatgtgcatgcagagctttgtcaccggggtcaaggtgttgcaggtttattgatgaggatgaggatgctgatggtgatggagaacatgattctggggttggggagtgttgcatgtactgcactcagagcagcatacgcagctttatggatagctcctggtaggattctgtcccacacttggagatacatattcttattcaaaaactgagttccagaagtccttgtgcaaggtcacccagaggagagaagggtcaaaagacagattcaaaacatggtttgtctggatctgagactcagatccctacaacactaggcacttaagaaggcaaatgtagtggccgggcgcagtggctcacgcctgtaatcacagcactttgggaggccgaggtgggtggatcacttgaggtcaggagtttgagaccagcatggccaacgtggtgaaaccccatctctactaaaaatacaaaaaattagctgggtgtgatggcgcatgcctgtagtcccagctactcgggaggctgaggcaggagaattgcttgaacccaggaggtagagtttgcaatgagccaagatcgcaccagggcactccagcctggacaacaagagtgaaattccatctcaaaataataataataataataataataataataataataataataataaggcaaatgcacttagtgatcttatcagtcccaaccctctttgaggccaggatatgtgctcgcattcattcattccttggtcccttcagaaaatatggatggagcacctaatatgtggcagccactgtcctagcccaggagatgcatcttccagcagagaagagacagtaaggcaggtgcatccgaaaggagaagactgaggactgtgactctggttgaggtcactgagagaatgaggcttggtagagaagatgtccaaggactaggttctgggacattcctatgtcaaggtgtcagggacaaggcaaaaaaccagcacaggagactgaggtgtggccagggaggcaggagggaaagccaggagaatatgactccctggaagccacaggagggattgaccttatcaaatgcggctgaaaggtcaagtgaggtgtgtgctggggaatgaccattggatttggcctcgttgaagtcattggagacatagacagatgcatcttgatggaatgtttcgggtgattgtccaactggaacagtttataagaaattgggagaagagccaaccatccagtgagtgagcgccggcagaagcttccagcttatggtgaccagcagagacctctgtccgagacattcatggtagattcctgtgcccatatcaggacaggattgtctaaccagtgaagcagcaacagcatctgatgcctcctgcagctctctctggagcaagctcacagtgcaaattcctaaattattcccagagagctcggctctgccagtgactggcgcagagctgacttctctgcccatcatggaggcacagtgcccggtgttctgggggcccatgaaaatgttgtttttcatttttttaaattttaaggtcaggggtacatgtgcaggatgtggaggtttgttatataggtaaatgtgtgccatggtgatttactgcacagattgtcccatcactcaggtattaagcccagcatccagtagctcttcttcaagatgctctccctcctcaccctacgatgtgcccagtgtgtgttgttctctcccagaaaatgttttaatttctggaaagaaaaagaacttttaggccaagggcaattctttaatatatgcctatatattaaattatacacacacacaaatatatatataaatatatgtaaatataaatatatatatacatacatacagagagagagatggagtttcactcttgtggcccaggctagagtgcagtggcgcgatctcagctcactgcaacctccgcctcccgggttcaagcaattctcctgcctcagcttcccaagtagctgggattacaggcacctgccaccatgcctggctaattttttgtatttttaatagagatggggtgtcaccttgttggccaggctggtctggaactactgacctcaagtgatccacccgcctcggcctcccaaagtgctaggattacacacacacagtcatgcaccacatagcagtgtttcaggcaacggactgtgtatacaaatggtgattccataagatgataataccgtatttttactgcaccttttctatgtttagatacacgagtacttaccattgtgttatggtggcttacagtattcagtgtggtcacatgctgtacaggtttgtagtttggagccatgggctgtaccatacagcctatgtgtgtggtaggctctaccatctaggttggggttagcatgccctatggtattcccacaaggaccgaatcacctaacgatgcagttcttagaacatatctccattgtataactgtatgtgtgtgtgtatgtgtgtatgtctgtgtgtaaatatatgtgtatgtgtgtgaacatgtttgtgtatatatatatatatatctgtgtctatatgtgtatgtgtatatctgtgtgtgcctgtgtgtgtgcatgtgtgtgtatgtctagttgtttgtatatgtgagggtatgtatgtagtgcatgtgcctgtgtgtatatgtgtgtgtgcacctgtgtgtgtatgtatgagtgtatacatgtgtgtgcatgtgtgtatatgtatgtatatatgtattagtgtgtatacgtgtgtgcgtgtgtgtatatatgtatgagtgtttgtgtatatgtgtatgagtgtgtatatatgtgtgtgcatgtgtgtatatatgtatgagtgtgtttgtatatgtgtgcacgtgtgtatatgtgtgtgtatatatgtatgagtgtgtttgtatatatgtgtgtgcatgtgtgtatatgtgtgtgtgtatatatattttcatggaggaaggtgcccatgaaagcaaacgtgcctagggcccaggaagttgtgctgcggccctggccgtgctcaccctgcaggagtcctggcatttacttaatcctggcaatgatggaatcccctccacacaggctggggtgtgagatgtgtctgcccctttgctagctggggaaggagaatgaatgagtggcagaaactgctagttgtggagcccttggttggagccaggcctgtgggctttactgcaccccagctacagggaggtgactgagtccttgctgaggtccagtggcttcccagggccctataggcgccgagcacagggctagcgctgaacctgggttgccttactgcaaaggccagtcggacttgtgactttccgggctgtcaaagggacccctgtctctatgtatgatacgggctcaagagtggagattttggggagcaggggaggcatctcactcagatccaaaagaagccaagagaaagagctggggaagcccaggctttgggccccagagccctgagctggcttctgctcaccgctcaactgcactgttggcgactcctggaaagtcccctcctggttctgtaggatggcagtcctggtgaaacccgtgggctgtggcgaggatggaggtgctgtttgcacggagcatttccacctccccctccttcagctctctgctcagaggtcaccctttagataccttccctgccctgtctgaagctgtccccctggcagcctcgctaccccatcacaactccctgtttcttccttcagggcccttgccagctctgtgaagttgtggttgtttctctgcttgcttgcctgcttgttgccattctccccacaaccctgggcgctccccgaggacagttgctcctgttcactgtctccccagggccctgatcataacaaggccatatgtgcatgttcctctcctctctcctgtcaccatcacacagctctctttgctgctcttcaaacatagcatgcacattcccacctctgggccctggcttcagcagctccttctgcctggagggcccttccgccacattccagcccagtgctgctcatggactttccctgacctctttgtaaaaagcggtgacccctccctgcctgcgatcctggctccctccctggtttttctcttccccactgcattggtcaccagggcatgtcccacacttgctcatcagtcatttccccttggggaaggccagctgcatggtgacaggggcgaggctggtcacctctgtggggatgacgcctggcacagctggcgggatgaggtgcacagtgaatactttttacaaaactgatgaatatgtgaaaactcagtgatctagaatcaaggaaatgtattatcaaagggaatgttttctggatcctgccttgtaggtaaaagagacggaaagtagggttggaagcagaaggcatatggtagggtgaggctggagtgggcagaaggggatttggctagatttgtggcccctccccttttatccatgaggtctatggtgtcagtcccagatatccctagcagtgtgctataaagccctcagtacccaagggagagactctgtccatatcctttgccttaaaccccctgagaagacacattaattatgacattttggttaaaaagaaaaaatagttctcttcctctattgctttctggttggctctgagttaatgagaacattcaatcatccagaacacttggggcattccggctaacccagggctcgctgttcatgacctcatttccttacctcaggtacatttgctgagtgttcccacaagggccagcagggactgggatcaactctcatggagcccaggcacagtggacagtcaggtgacaggccctcatcaacctccgagtgtgacctgcagaggctgagggggccctctctggggggttcaggctgctgggggaggtgacagagtctgaagctgtgagagagatatgctggataaggctccatcttccagaagtatccatggggctcctgaaagccaaagacttcatgggaaatgctttcatggacaaaattgtggaataaaagtcaacttcaggataaaggagtgaatgaggggaacaagcaggcctggaagctgggtactgttttccaggacattgcctgagaaatgtggcatttccgtgtgctggacaccatcctggacagaggcaggcttttggaccagcagacctgtggcctcatcctgctgtgccccattagccaaattgcctcatgtctctgaacttcagtgtcatcttctagaaactagcccagagatgctaacattaccagccagagtgaaatcactcatgctagcatgtccagcagagagtgctaggagccggggcttagcaaacatcaacatcctttcttctttcttccctgtcccctactcggtcacgatcctcattcagagctcagccctgtactggctgctgagcctaacaatgagtcaaccagtccctgctctccagttgcttctaggacagtggaaggaggcagccaggtaaacagatacctgtagcattgtaaatgcagcacggacatttgcgccaaagcctggtgtgtgctttgtcaccttactccctgtgggtgctttactctcccattggaaggggactttcttgagggcagggactgcacagctctgaaagcgtcacaggacactcttgaaacagggaaacttcactttgctagaagggttctgtgctggtaacttccgttatcctggacaggggcaatctgggaagtgagcacacagtacctctaagcagccacacaggtggcagatgccacgccctttactcctacaaaggctcacgaaagccgcagactctcacactgctgtattttgcagagagttccaagaaatgcaggtcctttgtttcctagcttactggagtttagaggcagcaaattaggatttgaggggaagactcaggaccctagtgcatgcaagtacgttggcaatagcaggatgggaaagcaaagtaagatcgttccgaatagatccaagagtcatgataatctgaccactcttaataggaatccatctgggggccaggtgcggtggctcacgcctgtaatcccagcactttgagaggccaaggcaggcagatcacttgaggtcaggagttcgagaccagcctggccaacatggtgaaaccccatccctactaaaaatacaaaattagccaggcatgttggctcatgcctgtaatcccagctactgaggaggctgaggcaggagaatcacttgaacctgggaggtggaggttgcagtgtgccgagatcgctccattgcactccagcctgggtgacaagagtgaaactccgtctcaaaaaaaaaaaaaaaaaaaaaattcatctggggccattcagtatggagacagctatcccaaacctgtgactgcaacctgtgagcatcacaatagttagagtaatattataaatgaacagcaatccattaattaattaatccatgcattcattttgcaagcacttctggactctgcatgtgccaagcatgatgctgggcactggggatgtgaacataaacaacactttgtgattcgggaacatcagcaaaggtttaagtgcagtcaagggcagtgacaaccattactgctgactgagtgaccattatgtgcccggacactatactaaaatattttacatacattatctcctttaagccataagccactctgggaggtatgctttatttaatccacattttacagacgaggaaactgatgctcagagacttacggggcttggcacctttcacacagtaataaatggtaaagaacctaggatttctctagcccccaagatcaggcccatttttttctcccaccctgtctcttggaaccgatgtgcctgtatctcccaaaagtattccctgtatttatttggttgatggtattcaaaatgattttacgcggcataaaactaaatattttaaaaatatttcatcataatttccatgcatatcagaaaataaacatatcttgcacatcaaatcggcaatatgatgcttcttttaaaatgaatgtactgtacttgtgaaaatgtaagtcgatttaaagaaaacatcaagtaaatcacagtccaggtgatacgtggttatatatatagaaaaactcgaggagatcgagtgtacggatgatgtttgggaaaaacaggtgtcctagatttaagaaagcaagaaagaataaaatccactttggaaataatgtacacaaattcactacagcaggagaaatgtgggtgccttcgaccatgagcgttagctatctggaaacacgttaagatggatactgtgcgtttaagggatgccagctgattgcagagtgtcctcaacaggctccagcactcatgccaccatgtctgtttccagggtcctctgccctgcggacctgtgagcagcccctccagtgtgagattttccaccagttgggatgggaccctgtgcggtacgacctcacgggctggctccacagagccaagcccaacctctcggccctggatgcaccccaggtcctgcaccagtcaaaaaggtgagttgggtcagggttggggacggggatggagcattggaggcactgtgttttccttcccacctaaactaggcagtcactacaacacagtgtgggagggccagcccaggaatcccatccctccataatggagcaaagaaccataacttgaattggagcagtgcagtgtctccctggggccagagtgaatccagctgaggagaaaagctggcctcctggggaggtggaacaaaagctaaaaagctgtgacttcttattttggcactttgcctttcattaagtatctgagagatgatgtgactggaacaacttttatggacattcaagaactaggggttcataaaactgaaatgatacgttttgtagcgttaaaaaaaagctcaccatgttccctggctgctcagcccagagtgctggcgtgaggccggcagcattctctgcttttagttcagaggcttattggaaaatgctgtgtgtgtgtgtgtgcatgcacactcccaagttcaatgctggaattcctcaggggtagagcttagagacaagaagagaaactgagacgaccagggaggtgctggtgtctcagatgggcaccaggatgagaaagaaccacttactcactactccctatgtgccttggatcagcataaacgctttatgagtatcttctgaatccttatcacaacacaagatccttagtcccattttacacatgagaaaaattgaggccccgagcagtgaagtggcttgcctttgctcacacagcagaacagtggcacagccaggacccaacttgagtctaagagatgcttggagaattcccagaacattatgtcagagctgattggaaacccacatccaggagtggggctcgtgaacatccagctcctggagagagattcaggccagggctggggcaacaggagttgcgagcacacagaggactgaatgatgacccaggtggcacaggttgagtctcagccctgccctttgtcacctgagtgaccgtgggcagtcgctctccctcatctcggttgtttctgcttcctgtaccataaataagagcaggacgatgctacaagactcagcggctgtagcccagctttggggacaggaagatgttcagattccgtttttccctcttttaagctacatgacctggacctcagtttcataatctgagaaatgggaatgaggttccaaagctcccatgtctgatctaagaaggctttggtgacgtaaagtagcagatgacctattagagagcccggttcgtagttggctcatggaagagggtaggccactctgctttactggaacagacacttgaaaagctggcacccttggccgggcgcggtggctcacgcctgtaatcctggcactttgggaggccaaggtgggcagatcacgaggtcaagagatcgagaccatcctggccaacatggtgaaaccctgtctctactaaaaacacaaaaattagctgggcctggtggcgtgtgcctatagtcccagctactcgggaggctgaagcaggagaatcgcttgaacccgggaggcggaggttgcagtaagccgagattgcaccgctgcactccagcctggcgacagagcaagactccatctcaaaaaaaccaacaacaacaacaacaaaaacgaaaagctagcatcctggccactaacctcagaatctgtccatgacagggatgctgagagaaggcactgtctgctcaggtatcaggctgggtatttatttgacattatcttgcagctccagaaactgtgtgcccagcctgagtcattccttcttgcatgaaacacatggcacgtgcctactgtgtgctaggcctggtctaggaatagcagagaggactttgacctctaagagagtacaggtgtcgtagcattgctgtaggtatgtaagtgacaagaatatccataggacagatgctctaagcctaggcagggagggagcatttgaaggtagaagacgggcatcaggaaggagctggcatttgccatgaagcaaagcctcacctggcaggaggggctgtgaatgaaggggagcagctgggacacatgactgtagaggaggctttaggaagccgaggagcaggaagcaagaaggcttgttccctttgccaccacccaggccaaggctttcccaagaacctcctaaagctcctctctcttttccctcctccccaccagagaggagctgcggagtctattccaggcccgggccaagctgcctcctgtgtgccgggctgtggcaggcctggagggcacctcccagcaggccctgcagaggagccgcatggtgaggaggacctttgccagcagccttgccgcggtgaggaggaaagccccgtgctcccagatcaagctgcagatggtgagtgggcaccctgtctcatggtgtcctggccttcactgcctccatcctcatctcctctgggctgagtcatgtgcctacatcatctctaacctccccagcaaggccagaggggcgagtgtcaccccacgctccacagaggaggaaatgggggctcccagcagcaatgaaacttggccctggtcacacccccaggaagtgactgatccaaatctgaggcctaagcctgtgctgcttggtgttgagttgagaggcctgggggagttcccagaagctatgaatgccctcttgactccagtgacacatatgagagccagactagccctgtctgccttgctcaccactaggttcccctggggcaaggcggcaggacccagctggatgtaaatgtggtacctagacctggaatgtgaatccgtgaataaatgagaacatgagattggtcaatggccaggctgagcagaaatgagaatgggctgagacaagggaaggacacctttaaataaaccttatagtggccgggcgcagaggctcacgcctgtaattccagcactttgggaggccaaggcgggcagatcacgaggtcacgagttcgagaccagcctggccaacatggtgaaaccctgtctttactaaaaatacaaaaaattggctgggcgtggtgatgcatgtctgtagtcccgctacttgggaggctgaggcaggagaattgcttgaacctgggaggaggaggttgcagcgagctgagatcgtgccactgcactccagcctggcaacggagtgagactctgtctcaaaaaaaaaaaaataaagaaagaaagaaaaataaaatggacctcctagtgcgttatagtggaaatgcccttagtccgagtcctgagttctagtcccagctgttctgccactggtctgtatgacctggggccactcacttgctctctccatgcctcagtttctccatctgtttcaacaagaaccattatttctcatgagcacaaatcaggctgtaggtgggagctccttggtgtgggacataggggccccaaagatgctcaggttgggcttaatgaatatttggagagggtccagtcccctttctgtgtctctgtgagacaactggccctgacctccctctatttggtctaggatgcgctgaccagcatgatcaaaaggtcccggctgcactttatccactgcctggtaccaaaccctgtggtggaaagcaggagtgggcaggaatctccaccaccaccgcagcctggtagagacaagcctggggcaggtggacctctggccctggatatcccagcactgagggtccagcttgctgggttccacatcctggaggctctgcgtctgcataggacaggtaagagacagctaggacacagcaccttgtctctgactcctgggacatgtccacccaccagtggcagccaagggatgggagcccctgccatgtgctaggagcttcacacccagcatcctggttactcttcccagcagtcttctgagatgaggccactgatgctcagagaggtggaagtacttgctcatggtcacattgcctggacgtggcagagcctggatcaggacccagctctctttgagtctgaagcccactgtttttttttttctttatttcttctgaaaacacacacacatacacacacacacacacacacacacacaaaatgggatacatgtacagcacgtgcaggtttgttacataggtatacatgtgctatgttggttggctgcacctgttgaaaaagcccatattatttctagaattgcctgtacactcctagaaaactagggctgtgtcttccttttagccatgaatttctaaggagcattgtcttgcaacagagggtggaattcctgtgatgagtgatattttgatgttcacgatgctcagtttggtttgggaggttgctgtgatcccaggagatgatgatatgacttgatgagggctcatagcacccagggatacgggaggccctgaggcctaaaggagggagcttcctactctcactgggagtttggggaaagctcacagtgatgtaataccatagtcaggccttgaagcataagaaactgtcacctctggcaaagggagggaacattaggcagagggatcagcaagtatgaaggatggaggcataaaacgggcaggttttcagggaagtggattcagaatgagtgaggagttgtgggagaagaggctgaggcatccaccagcgcaggctgggaatgcctctgttgggttatcaccaggtccacctggggagatgatgggctggcagggggatggggggattctaatcaagggattgaagtttttgggtctgtattttagtaagaaaatgtgcacctgatgtccccacattagctaatcttaggagttgagtttgatctcagtccttgctattcttttctgcctctcagtctccaaaggccaccacactgactcccctctctgacagttagaaatggctcagacaaggccatgctctctgcagaggacagggtggctgggacaggcagaagtctcaggtgagcacctcatttggttaaagtctccgtggtcactagtgccctagtgtatggtcgcttctcccatctccccctgctgggttaataagggacccctgggcacagagtatttgactgggagcagctagaagcaaagatgagaccctcactccgctgagcatatcaatgattttccctcccacccgcacagccgcagaggagggagacagataatgtcacaagagaagagggggatggtcacagccagtggctggtcccccacacttaatcgattctatttggctgcttggcaggaagtgctgggcctttgcaggcaccatgggcctgggtcagactgttagaatgcctgtgcgcacgcagggtcagggtgtcccgttcctgtgttcacgtgacctcacgacaccatctctgttctcagcacagcctagctcagccatgatgagctttccaactaagcgaagggttgatatctcatggtagaaatgtccaatttctgtctcctagacctggttcatttcctctttttatttctattgtaagtcatgtttgtctctttcacactcacatgagatagatttgtatgcatacacagatacgtcaaatatttattatttggaatctgtgcatatataatatatatatgcatatatacacatgcatgtgtgatgcatactcatgcatgctattgagtacctactacgtactagacactgtgttgtcacctatactaaatgagatcatttttgctgtgctaaaggtatgtagtaaacattcattcaacattacctatcgtgcagcctggtaggcacagctccaactctggagggaaatggtttggccttgattctggccaccacctctcaccagccgtgtgaccccaggaaattccctagagcttatctccctgtcctctcctataatagctcatatcgctgaaggctgctatggggctgggtgcgtcaataagacaataaagcttagaaaagtggcaggttgtggaagaacacataatacccattagccacttttactataattgtcatcgcatttaatcctcatagtgaccatgtgaagatagatcttgttatctcatctgacaagtgaagaaattgaatctcagaaaggtgaatcagttgtcccagtcatggggctcataagcacagagacgggacatgaatgcagataggtgtgccctaaaggaggctggtaacctcccaggtcccccatctctgtgctgtctgcatccttcaaagctggtctgagaccctcctcttccccaggaagtcttccaggattagccacacaaacaattgctgttcttcctagttgatgcatctggcttattgtgaagtctcaaaagtggagtgagattttaccataccttttctgatccagtcacttggggggtcttttttaagcagttgaggctcttcttgtacccagggaagagtctaaacctcgagacctggaatttgcgctcaatttcctttgggacctggtctctgctcgtctttggctactctccgctgcctgggtttgagtcccagctgagacagttactattttgtgttgtgtaactaggtgaattcatctctctggggctcaatttccccttttgtaaaatgaggatgataacataggcccatgagtgtctataacacgaggaagttgttaccctagtgatttgcacacataagctctcagtaaatgctggctgttactgtggactataaaataattttttttcttttttgggacagtgtctcgctctgtcacccaggctggagtgcagtggcacgatcgtggcttgctgcaacctctgcctcctgggctcaagtaattctcccacctccagagtagctgcgactacaggaacgcaccaccacgactggcaaatttttgtattttttgtagacaccgtgcccagccttggaatgtatcttatacttccctgttctaggtcttgtctgtacagccccctctgcctagacttctcttccataccaagttattttggaaaaccctatggcttcttcaaaaactgaatctaatgtcattttctcccaacagcttttcaggtgccccttctcttcccagttccccacatagaaggatgcagttgcgtccaccctgcatggtagacttacaaatgcccttagatactgcccaatgcagcatgcttcacatacagtgtatggggtggtaatatgtgttagacaaaacactttcctttgtcaaacgggtttgggaacctctgggctaacgttgggaaactcaaggcttatcaggcatctcccctgcatgagttctcagagcctttgacttggatgctgacatggctcatggaccttccaagaggcggatgagtgtgcagctttttcaaactttcagtggagcattttatagggttcgtgttctcaggaacacctctgggaagtgccaatcaaatatagtctcttaaattaacaaatggagaaactaaggtcccaagagatgagtccatgcagcaagttagtagccaggctaggaagcaggaccctgcactcctgtctaggggtttagggaactgggctgggtcttctcatctggactctgtgctcttctcctgcctgctcctacctccctaggctatgctgaccacatggggctcactcgcttccgccggcaattccaggtgctggacgctccactcctgaagaagctcatgtcgacctccgagggaatagatgaaaggaaggtaggtggagcacatgcgagaggggtgaaggccctagatatggatatgttggttattggacatgttccaaggctgggcacggtgagtggctcatgcctgtaatctcagtgctttgggatacccaggtgggtggatcacttgagtccaggagtacaagaccagcctgggcaatatgactttgactaaggtccagtgggctcatgttccataagggattgccccagggggcatctggaccagctggaatctgaaagcaggaccatgggggcagtgctgagggcagcatgaggtttcactcaaattcttgctctagaccaaacccccacaacaatgtcacttgggacccgactcagcccagaatgacccttctgacccctagataaggaactttaggaaaagaataagaatagagtcatgagaagagagcatcccagctaaaagggaccctagcaaggtgaaaggtcatcatttgcaaagtgtgttccattcagcaccagcaccctggggtggtctatgaaaagagggcttcagggtccaaaatgtttaggaaatatttacatcagggccccatgtttgagaattctgatgaacatcactccttagggcctttgcacgagctgttttctctgcctggagcactcgttccccgaatctttgcgtggctggtgtcatcttgctattcagatcccagctcagataccattcttcatcacatcctcttgttttgatgtttatgtagcacttatctgaaataatgtgaatctcctctgtgttttctggcttacagcaagagctcaataatgtttttgttgagttaatgaatgaatgaatgaatgaatgaatacccagacctaactttgtattgttgtccctgtgtgtcttctttctccaactacaccgtaaactcatggaatctcatctctacttccagtgccaaactttcaataaatgtttctcttgagaatggccacaggcttatcgatgattagagagcttgttagaatttgcaaagccctatttcatcttcataacagccctgcaaaagaagagctattacactccatttacaaaagagaacaccacgtttcttaagatgaagtggcactcctgaggccacacagccaggcatttgtgggtttgctccttggactcaagtttctcaattccaggggaggatagtttaaagagcatagttcataaagggaggtacttcaaactgacttgaatttgattcccagctggggctgtgtgaatgtaaactggttatgtcatctttctgcctcagtttcctcatgtgtaaagtgggaaggaccacaatgcagaaaatacataggggatccacataatttcaggataagtgctacaaaaactaattaaacaagaggatgtgatggaggatgatagctgagctgggatctgaatagcaagatgaaagagtactccatgaaactcgatggagtgttctgaggatgacatgtaatagtatagttcatgtaccttacacaggtcctgggacatagtaagggctcaatatacattaaccaccatcatcaacatcagcagcagcaccatcaatatcatcatcctctttcaaatccagggcgatgacacacaagcctcacagaccatgtgttcacaatcctgttgcaactgcatgtgcctgcgtgtgcctgagatcatcagcactgcagtcctcaatgaatgagtcagaagactagatgtaaagtcacaattcttaggtgtcttcttagttcttctttgcagtgggtaccagggcacaggccactttcagtagacaaggcaatgccttctgcagggccctcctaactcactatggaggggacatcacccccagatgtctgtggcacagggctgtcccttctctgggtagtggcccattttggaagccatgaaattctgcctgacttggtgccatcaaccactctgtagcagtcttcgttcatggggttccttattcttggtctctgaaaatttgacttcattcagaggggctgaatggagccactgagagggtcttgggctcctctgtggttgaaaatggtgcaggagtcaggtgtgggggagtttttttgtggaggcaaagggtgtagcatatggaagtgtttctactctgaatgagtcagcagttctctgttgtagccaaaccaaaaccacctccatacacgctagaggcctcagaaaatggaaaattacaaggagaatggacttggttgggaatttttgcttcttcttattctttttttatttgctcacaaattttatttgctgcagcatagaattttggtagcaacgaaaagaaacatcatcctgcctcttatgaaaaaactgataaatattcatttgccaggccacatgatatgccatgaattatacatgaacacgtgcttgggtgggcaaactatcagtttctgtgtgcaaagcagttaagacctcaggatttaataagacaaggttgacagctagaaaaggtcaatattgtcattagacactagacggcagcagaggggattcattgtcagggtgtaaaatgggtcttggtgaagtcccctgtgggtctaacatgtggggtctgaatgttggtgtttcatgccaagactgtttcccaatgaagtactctcatttggtgggtacctgatggatatattgtgttcctgaaacaaaaatagcatatgtcttttatcacagatgcataaactctcattataaaatatcagacatactatgaaaaggttacagaaccatgagctaagacagtattcaaaatataattcccactctgggaatcatcctcatttcacagcgtaggcagctgaggccatgaccacccagccaggtagtagtagagctgggatttgaactcaggctctcagattcctgacatagggcttaaaaaaaaattatggtaaaatacacatagcataaactttactgccataaccatttttaagtgtgttgatcagtggtattaagtacattcatatttttgagcaacaataagcaccattcatctccataactttttcgtcttgcaaaattgaaagttggtacccattaaacaataattcccgattcctcctcccctcaggctctggccatcatcattccactttctgtctctataaatctgactattctaagtccatcatagaagtagaatcatgccacatatgtcctttcatgactggttaatttcactttgcataatgtcctcaaggttcattcatgttgtggcaggtgtcagaatttccttcctgaggctgaaaaatattccattgtggatgtataccttattttacctgtccattcgactgtcagtggatgtttgggttgattccatgtttccttttcaacttttattttaagttcgggggtacacatgcaggtttgttgtaacaaacttgtgtcatgggggtttgttgtacagatcatttcatcacccaggtattaagcctagtacccattagcccattagttatttttcctgattctctccctcctcccatccttcccctccaacaggctccagtgtgtgttgttcccctctatgtgtccatttgctttcatcatttagctcccacttataagtgagaacatgtggtatttggttttctgttcctgcattagtttgctaaggataatggcctccagctccattcatgtttctgcaaaggacgttatctcattcttttttttttttttttgagatggagtcttgctttgttgcccaggctagaatgcggtggcacgatcttggctcaccgcaagctctgcctcccgggttcacaccattcttctgccacagcctcctgagtagctggaacttcaggcgcccgccaccacgcctggctaattttttgtatttttagtagagacggggtttcaccatgttagccaggatgatctcgatctgacctcgtgatccgcccacctcggcctcccaaagtgctggcattacaggtgtgagccactgcgcccggccctcattctttttttgtgactgcatagtattccatagtgtctatgtaccacattttctttatccagtctatcactgatgggcatttagggtgattctatgtctttactattgcaaatggtgctgcagtgagcatacatgtgcatgtgtctttataatagaaggatttctattccttcagctatatgcccagtaatggggttgctgggttgaatgtacaaatatctcttgaagaccctactttctttcttttttttttttttgaactcttgttttaggttcaggggaggtacacatgcatgtttattatctaggtaaatttcatgttacaagggtttggtgtacagataagttcatcacccaggtaataagcatggtacgcaataggtagtttttcagtcctcaccctcctcccactctttaccctccagtaggccctggtgagaccctgctttcagttttttggggtatatacccagaagtggaatagctggatcatatggtaattctattttaaattttttgatgagctgccatacagttttttatagcagctgtaccattttgcatttccaccaatactgcacatggatggcaagttctccacattcctgccaatgtgttatttcttgttttgtttttttgatagttgccatgctaatgggtgtgagatagtgtctcaatgtggttttgatttgcattttcctcatgattaggggtgttgagcatcttttcatgttcacacaggagttgaatagaagccctctgagggcaggcaaagtatttagtgcagttcgttacaggacatgccattcatggatattaactttaaataattatcattaatttcatccaactttaaccaagtgcctgcttttcaccagatcctgtgctaggcaccagcaacttccatacagagctggctttgggacaccccaggagatgccactaaaacatttgatgtttccaagggaggtgagagtggggcactcagggaagacatttcagaagtaggtgatgcttgagatgaggtttgtgaaacactctggaggaactgagtaggagaaaggttacaggacattctcatgttgggtacaggattgcaaagatctggagtcatggaggtgcatagatagtttcgtggtgctggagcataaaagatgccaagtgccaagtaaaggggctgaggagtttgacagaagcaaattctgggttcttgttagccaagttagagagtctgggctttatcaggtgttcagtgatgctcctctgaagggtttcagcaggggcgtggcatagcagacctgatctttgtgacttgaactggcttcagcaaaattatgaaggaagcgaagtccatgctgcccattccatggtcctctctaggaagcagtgtcctcttgctgacctctggctattccagaggcccctgtctcctctagacacccaggcacatactgaagcctcccaaatgaccctgtcttctccctgtaatcatcttcagttccattcctgtctcccaggctacctcctctggttagatgatgctttaacctacaccaaagcctacatagagtgaatacaagggtggaatctcaggcaggtcagtgaaggcactctttcagctcaccttggctacgtcccagattctggtcccttccatttttctgctgctgaagcaggagttgccaagtctatctgatcgatgtgaggaaacccttgggcctgccctcctccccgcaaagtgtctacagtgttgattgattttagccggcaaaatctctgtccctgaggacttgatctgaagaacataattaagggctgtcaatccgtcttctcaaaggcagccactgttattctgtctcccaccctggcagacactcccagtttcctgtgaattcatctcaagagtctttatctgctgggaagaaacccttatgagcccatggccagggagggagctgtctgctctctaggtgctgaataattattcatgggctcccaccaccttcgctcctgaaatttattcatcatccctttcttgttcaccttgctgtctccctccagtttgggtctattgttttgtttgttttttgagacagagtctcgctctgttgcccaggctggagtgcagtggtgctatctcggctcactgcaacctctgcctcctgggttcaagtgattctcctgcctcagcctcctgagtagctgggactacaggcatgcgccaccacgccaggctaattttagtacttttgtagagacctggtttcgccatgttggccaggctggtcttgaactcctgacctcagatgatccaaccaccttggtctaccaaagtgatgggattacaagtgtgaaccactgtgcactgtgagctgggtctattgttttaattattttacatgttttccactcaattttaatcaacccaatgtaattggtgtgtgcatgtgcatttggtttttggatagtttctgcctttttccaggcatttcgtttataggcttgagcataaatagttaaaaaacagacacagttagcacccttatggaatgatttggccacttgtgtgagaggctcagtggttaaagtatgtgatttagagtcagatagacttgagttcaaattgtgtcttcttccatatctctctctatgaatccacgcccttgatacttgatagctgtatgaccataggcaacatatagtatggcatagcaaagtgtctggtacattataggaactcaacatatggaagccattggaccatggtgtgggcttcatgggggcaggtgctatatggacggcagccaaatggttcacaggatgagtatcctattccatagacacagattcttcatatcaaactgttcattgaggagtgagttggggaagcactttgcagctatggctcttcattatttctggagtctctctgcctgtctggcatatacagccaaatgtgagatgtcagcccatatgcttttcgggtacactcttcttgaacattggagagaaagctctttgcaaaattctaggaaacaatggaactctgtaagtgggggctgtgggttggatgtgactgaaatcagttagaccccaaaatctgggctcaatttgacacaggctatcggaattttcctacttaaggtggagagatctcaggtttgccaagagccatgtttgctgaggtgtaatgttgacttacagtgaagacgatgacccatctatgctcaatgcctgggatgcttcactgaatgaatcttactagttgtgaattcgaagtgggatagcttaacaggttaaggatacagattctggagtcaggctttctgagcacatactgtgtctaatctgctcactggctgtgtgacatttgacaagtcactcagcctttctttgacttagttttattatcttaaaatggcatactaatagtttctaatactgttgataggaggattgagcaatttaacgtattgacatggtgactttcatatacacagagtaaataataaatgtaatcaattatgattttgttgtaaaaatagtaattttactatttctatggattttaatgccccttctatacaatgaaggctttaatatttgccttaaaaacctcaaataattgttaagataaaatattttttgattaatagtagtagatatttaatcaactgatcatctctaaactacatttggatagtttttgattttctgactattatgaaaaaggatgttgtgaacatttgcatatcagtctttgcacagaaacatgtttctactttttttgggtgcattcttggaggagaattgctagtttatatggtaaatttatgtgtaacttttaaatataacttttaaagaaactgtcaagttatttttcaaagtggctctaccattgttcatcctcactggcaatgtgtgagggtttcattttctatccttatcaatacttggaattgtttgcctttttgattcaagccattctgttgtgtgcaaagcggcatctcattgtggttttaatttgcattttccctaatgatgttgacttttttttttgcatgtgcctagtagccattttatctctttttttgtgaaactctattttttttgcccattttaattaggctgtttatcttatagagttgtactagttctttatttgttctagacataattatttatcagatgtatctttgaaaatattttcttccagcctgtggcttgtcttttcattttcataatgatgcacagagatttttatgaagttcagtttactaattttttaagtgactggtgcttttttcatatctaagaacgctttacctacccctcggttacagagatattctcccattttccgctacaagatttgtagttttagctcctccgtgtagacatttgatctattgtgtgttaattttgtgtatggtgtaacatacatgcctatattcatctttctgcatatggatattcaattgtcccagtaccatttgttggaaagactattatcatttctcccagcgaattgtgttggaacctttgtcaaacatttattggccataaataaagagtttattttcgtaatctaaattcattctattggtctgactgtactaattagtagcatctctttctttctgcctctttattccttggtcagtgtaaataaacttcatcagttttgtcttttcaaaggacaaacttttgatttcactgattttttttctctgttgtttttctgttttctttggttctattgtcttctattgatttccactctatgttacttccttcctttcacttgatttgagttttctctacttttcctggtttcttaaaaaggaatcttgctcaaattattggttcaaaatccttctcctcttccaatatacatggttaaagcatacattttcctcaaagtactactttggctgcatcacacaaaaattttcatttagttcaagatattttctaattcctagtgtgatttcttctttggcccgttgtttattaagaagtgtattaatttctacatatttggaactttctcaccttttttcttgttggtttctaatttaattccattttagtttgagaacatatgttatatgatttcagtacttttaaatttatttttgtttgttttattgagacttattttgtggcctaatattatatatctaggagagtgttcaaagtgtgcttataaaaaacatgtattctgtggttgttgagtagtctatagatgttagttggggcaatttggttgatagtattgttcaagtcttatatatcattgctattttttttttttttgagacagggcaggctcttgctctgttgccctggctggagtgcagtggcacgattatggctcactgcagccttgacttcctgggctcaagcgatcctcctatttcagccccctgcgttgctcagactacaggcatatgccaccacacctggctgattttgttttttagagatagggtcttactgtgttgcctagtctggtctcgacctcctgggctccagcaatcctctggcctcagtgtcccaaagtcctgggataacaggcgtgagccactgtgcctggcatgttgctatcgtttatgtttaattgttctgtaaattattgagagtcaggtattacgctctccaactattaatgttaaattttctatttatcctgtcattctatgcatttttgcttcacatgttttggggctctgtggttaggtacagacatatttataatgccgtatcttctggatggattaaccctttgttgctataaaatgtctccctttgtttctagtaatgatttttgttttcaattttaaacaaaatttaaaacaaaatttgtctgatattagtatagccactccagctatcttatgtttagtgtttacatgatagatcttatttcattttcccccttccaacctatctttgtatctaactgcatctcttacagatggtatatagttgaatctttttacaaaatccagattgacaatctctgcctttttattaaggtgttcaatatattgatctgtaatgtgatttacattatagccattttgctattttctgtatgggcttcacgccttcttttagtcctatcctccttcacttccttcttttgtgtaaactaggtattttccaaggggccatttgaacaccccttctagtgattgttctacggtttacaatatgtattgtaattcaagatgctccacttcagattaatactaacttaattctgggaaaatatagaacctttgctccaatatagctcacgtcttcctcctaccttagtgatactactgtaatacacagtccaccctccatatgtatctgtgggttctatatccatgaactgaaccaacaactgactgaaaatatttggaaaaaaaaggatggttgtgtctgaactgaacatatacagacttattttcttgtcacggttccctaaacaacacaatataataactatctgtatggcattttacattctattaggtattataagtaatctagagataaagtatacagaaggatatgagtaggttatttgtaaatactgtgccattttatataaaggactcatgcatctgcagatttttgtatcctttggcggtcctggaaccaattctccatggatactgagggataactgcagatcacatctatatatgttaaaaaatcaacaataaagctttatgattttcttttatttaatcttatgtcttttaggtaagttaagggaagcaaaggaaaaaaatgaagatttttacattttcctatgtgtttttgttttcccatgctctttagtccttaagtatttgaattacgtgtgatatgataccttgcatcctgaaggacttcctttaatgtaagtgaaacagtaaggcaggtctcatagcaataagttttctcagcctttgtttacctgagaaggtccttacttcaccttcatttttgaagaataattttgccagatacggaattcctgattgacatgtttgttttttcctttcagcacttctaacatgtaatctcactgcattctggacttcattgtctctgaagataagtcagccactaattgttttgatgcttccctttacacaataagttattcctctctttctgctttcaagattttcaatagtttataataaatcttggggtggcttctttgtgtttattctatttggaattcaatgacccgctaggatgcatagactttttttttgggggggggtgtcaaatttgggaagtttctagccatcatttttcatactttttaaaatctttgtctttctcctcttcttctgagactcctgttgtgcatatattggcacgcttgatttgccatacatatctctgaggctctatttatttttcctccttcctatttctctccgttcttcaaattggatagtttctattgatctattttcaagtttgctgactctttcatttgacatctcagatctgttgttgagtccctttggtgaatttatcatttcagttaatttacttttcaaatgaagaagttccatttggatcttttaaaaataatttctatcttgttattgacattttttatttaaggagtcattattattacactgtcctttaattcattaagcattgtttcttttagttctttgaacatacttataatagctgttttgaagtgtttggctgttaagtccaaattctgaacccacaaagatactttctactgtttcccctcacccttagtttggatcataattttacgtttattgcacatcctgtcatttttgctgaagactggacatcttagatgatacattatagcaagtcttcattctgatcttttcttaatcatttagtattataacttgttttgactaaaattacaggatctgtctcctcatggtgtgggaccactgatatctctgcccaatttttaaaaatttgtgtttttattttaaatctgacttcccaggagttgcgcctatgtctgcatagcttagagtcagcagaggttgttatcaaacatcttgaatatttgaggcttttccattttcctgttggatctgtgtgggggttgggaaatgtactcagcattcaggcagttcccagttatgcttcaacctctacgttctgtttggccctttcacatagtttctgcctgtacacatggcttcatgttcaaataaatagggatatgtagatagtgagggccttttccagtctctcttattcttgtgtttagcctggagccaggaatatgtgggaacttatcaagcccactgtggctgtcctatttcctgtgtctcctgttaaatttctggcatgtttaaggtccagtgcttgcctcaatcaggacaacaaccttaggcttagctgtgccattggccttcctcatttgtttcctgccaaaattgctactgtttctgacaatgctcccaggtgtgggttttttccatgctttgctccatataggtgagccccttctggaagcaaagctgttgtttttcacagctgcctcaccctggaagaactactgcagagagagagagacagagctggggtgggtggtgagtgggagaacctgtaatcaatattgccacaaactctcactgtttctacctgagatccaataggttttcttgaataaatgcttctcattttgttgtatcccattgtccaatttccagagtattgaacctgtggttgttggaaattttatccatatttatcttgttttggggggaggggagaggatttattaagctccttcctccaccattctggaaatatctcccttatatgctacttatatgaccttattaaatctccactacatccttgtgggacaggcgtgattacaccatgttgtagaaagcaaactgaagaccagagaggaggagaggcttgctcagggtcacacagctagtgagtggtggaactgatcccagcgttggagggtggagaaaagatcaggagctgattccttgggttcaaaccccctaccatcacttcctaaacacgtgagctttgccaagtcatttaattgcactgggcctcactttcttcctctgtaaaatgggcatgaattagtacctgctgcagaaagttggaaacaaaacaagttatgtgtaaagcagttggagcagggctcagactcaaaaacagactgaaaactgtgttttcttggagaaaaatggccacatttgactcacgaaaaagcagcattttatgctgcaaaggataagtttcaattacctgggcaattccagtacatggaagaggtgattccataaagacacaggacaaggaggaatttcttaacagtcacttggatccttgctgtgtctttttccaccaactggttgttggacaatgattatgttatgttgaactaaatgaagtgattgatatttgacctaaaccaatgacagtttcgtatggttcaatctaattgtaacgttaaatggggataaaaataacagcatttaagtgcaaagtaatttataaagtccttttcatatagtttcaattaattctctgaattgctgtatggtccaggcagggaatattctcaccactttgcaggtggggaagagggtcagttgtataatttaatacctgcacttacccactcatgccactgtttgaatccaagctttgttgtatgtaaaatgagatcaacagaacagaatatctgtgttagggctaatgttctcagctacatagacatctaaagagttctcagaaagcaaagagctggaaaaggagtctcagttatggtgggttgagcatgtgctttggcagggtttgaagtgtatctgagaaatgggggccttcattcatgttttgcagcactgttccaaggttttgaccaaaacagaggtgactataaggatgaaataactcctaacatttattgagtgcttactatatgccaggtgctatgtagccctgcacaagcacagcctcagaattttctgaaacaggtgccgttattgtccccatctttctgaatggagtctgaggctcggagtaaagcacttccccaaggccacacagtttatggagtgataaaaccaagatctgaacccagatggatctaactctggatcatgattttttttcccccaaaacatctgccatagactttacctccaaggtacacttagaaaaatttcattggtcatatatttccttttaaaaattcatccatcttatcttcagtcaattttttattgtttttttttcttcttatgtagagaaaaaaggcattatattttggatatattggttttattcatttctaccacctacagctcccttggaacatgtttggctaaaatgtgataagtgaaaccaccgacattttggaagagtgtcatggaatgttcttccaggaggttggaagatggagcttccttcctgattgcagtctgggactagactattaataaggattttttttttgatatcttaggaagttttctgtgatgtctttgacccatggaattgaaactcatttactaaattactccagcctcataataccttttgcttcctgagcattgcaattacttttctgacagtttattcttaaaatagactttctgattttcagtgagtgaaagaccaatgagggggtagtatgagggtgggtgggaggggaattggcagtcactaagcaaccaggcacaacctgggtttatctgagagtccaaatctctggctgattgtttcaaagcctgcaccactatttgacaaggggaagattccattaaatggcgattagtccatgctgtatccagaaatctctttgagtaaaattgtttctcctgcatggggctgcttttcctccctatggaatctctctggtttgggtgtttattcattcagtcatcatatctattgggctcctactgtgtgtatagaacagtactataggctgggcacagtggctcacacctgtaatcccagcactatgggaggctgaagcaggtggatcatgaggtcaagagatggagaccatcctggctaacatggtgaaacctcgtctctgtgaaaaatacaaaaattagccgggcgtggtggcacatgcctgtagtcccagctacttgggaggctggggcaggagaatcccagcctggtgacagagcgagactccgtctcaaaaaaaaaaaaaaaaaaaaaaaaaaagaatagtactatagtgcgtacagaaaacacaggctcctctgccataatgtagatcaggcaggtgaggttattgaccatgtcatttatttagcaaatatttgtgggagtgaggcagtcaccagcaagagcaatgagagaagcatagagcggggaggctatcacaggaggacttagtgaattactaggcacgcagtactgttcaagacatagctgtggccagaaagaacttaatgggaatctgtctctgccctgtgtgcaaacttgtaatcttgaaaaaaagccccttcatttagtttttgttgtgtgtgtgtattaaaatatatataacataaaagttaatcttaaccattttaagcatacagttcagtgacagtatattctcagtgtggtgcaactatcacaacatccatctgcacaacgctcttcctcttgcaaaactgaaacgttatacccgttaaacaataagccttcatttccccctgtctccaacccctagccaccataattctttattctccatgaatttggttactctaagtacctcctttataagtgaaatcatgcagtacttgtccttttgtgactgacttatttggcttggaataatgtccttgaggttcatccatgttgtagcatgtgtcagaatttccttcctttttaaggctgaataatattccattgtatggatagaccacatagtgtttatccattcatccatcaatggacatttgggttgcttccacattttgggtattgagtataatgctgctatgaacacaaatatataaatatctcttcaagaccctgatttctttctttctttctttcttttttttgagacggagtctcgctctgttgcccaggctggagtgcagtggtgcagtctcggctcactgcaagctccgcctcccaggttcatgccattctcctgcctcagcctcccgagtagctgggactacaggcgcccgccaccatgcccgactataattttttgtattttcagtagagacggggcttcaccatgttagccaggatggtctcgatctcctgacctcgtgatccgcccacctcagcctcccaaagtgctgagataacagccgtgagccaccgcgcccggccaagactctgatttcagttcatttatgtatatacacacaagtgggatggccagatcatctggtaattctatgtttaattattcgaggaacctctgtactgatttccctaacagctgcatcctttatttcatttcgtatctttggttttctgctctgtaaaataggaggatgaaacaaattggtgtgtgtatgaaggcagagtggatggcacacagtaggtgctcagcacctgcaccttcctgtgtgaggtggggctctgttagccaaagctcacagacatgtggggtcatcctccgtcctggcgcatcagccatcgagccagcttgactttcccctttaggatcctcctaccttctatgctgtctaacttctctctaattttttccccaggccgtggaggagctcctggagaccctggatctggaaaagaaggcggtggctgtggggcacagccaagtgagtagagctgctttcttacaacattcgcccatcacatcagggacccagagatgacctgattcttgtcctacctcaattgtctattatctctgtacgtctcctttttcccaaactgaaggtagagctaatgattttctgccctgcctatcttacaaggtcctggagagacaatgtcataatatgagttgaaatcacactgggaaatatcatttcttggaggcttcactcctggggaccccaagtggtttggaggaattagcattctggtcctcaagatgaccttctgagtctcagaaagagctgccataaaacctgagaagaactgctcatcttcactcacagccttttaacttctgctttgcaaccagctctaacacagctatagtcatagctgatgagcagcagtaagggaaaagaaagaaggggcttgagaggaaagcccgtgattattcaggttgacagaaatagcttttcccaaactggtgttgagcccaaagctcttccaaatatgctcagatgtttagaacagaatttcacacttccccgatatgcttatatatgctgaagttttcaaggtgggatacatggtatttagggtttctcaaactatttgactgtggaacccccagccttttgtttgtgtggaatacctagtaccatcttctggagctagtgttccatggattatagtttgggaagtggggcacggagattgtaaactcaaggaccaaggagtgggggcaggggaaagggacacagtttagaaatacaaactagaggccgggcgtgttggctcatgcctgtaattccagcactttgggaggccaaggcgggcagatcacctgaggtcaggagttcgagaccagcctggccaacatggtgaaacccccatctctacaaaaaatttaaaaattatctgggcgtggtggtgtgcgcctgtaatcccagctacttgggaggccgaggcaggagaatcgcttgaacccgggaggcgaaggttgcggtgagctgagatcgtgccactgtactccagcctgggcaatagaacaatactgtgtctcaaaaaaaaaaaaaaaaaaaaaaaagaaggaaggaaggaaggaaggagggagggagggaaggaaaactggagaggaacagaccaaaagaaagactactccacacatttccccacctagttacttactggttgatgaatgccatctaagaaaactttgtcaatggccttccacctccaggagctatgtgaggtggtgggagggttctgctctccaggagcccaccagggtggcattattggctatttgtacttcatggagccctccctatcatatgcatccgtgagagtggtcctttactcagggagctcacagtcatctacactggctaccacccctcagcccaccctaaacacactagtgtctccccactggcctcttggtcctgctaaggtatatggcggaacctgttattccgctgtgatctcaagatactttatcctgataggagttgcagcatcccaagtctttgaagcctttttcaatagagagagtaaacctgtcagttactggactcccacgcactatgtgaggcaacttcacgttttgttcttctttgttcctcactcacagtcttctgtgagatatcaagtgtgttcctgctttacagatgaggaagctgtgcccctgggaaataagcctcttttcaagatcctatctgtagccaagggttcagactccacgcaaacctgcattggtccaaatgccagggtcttttccgtacactctgggtcctattgtttatgaatggaaatgcagtcacgtgtggcttaacaatggggatacattctgagaaatgagtggttaggcaatttcttcactgtgggaacatcacagagtgtactcacacaaacacagatgggatagcctaccacgcacctgggttagatggcacagcctattgctcctaagctacaaacctgtacagcatgtgactgcactgaatactgtaggcagttgtaatacaatggtaatgacctgagtatttaaacatagaaaaagtagagtaaggatctgagtatttaaacacagaaaaagtagagtaaaaatatggtattataatgttatgggctcgctgttgtgtatgcgtctattgttgacggaaatgtcattaggcggtgcatgactgtacatgacatattctttacagatggatctttacggtcctgaatctgtggaattgttcttcagctccaggaacttcatccttctagaccagcagttctcaaagtatgggccctgaaccagcagcatcagcatcgcccaacagcttgctagaaacaccccagacctagtaaatcagaaactctggaggggggcagggctggcaatctgtataacaagccctctaggtgattccaatgcactctcaagtctgagaaccactggtctagataatgactcagttatgtcataaatatgaaaatcagtgcctatgatcctggcagctcttgcagaagaagaaagaaaacagtcattacatgcagtttacagtggcaggagtaagaagtctgtacacctaaacattcagataataaaatatgactattattgaataatacttggtattgactgagaaactgtcaaaagcaaatcaaggtcaatgtgtccttttggaggccaggctgggggatactgagacctttaagggcagatgcagcatcttacgcattgcaggattggcatgtaataatggagaaggctatgaagctcaggggacaagagaatcggctgacccagtccacacccaggctccaccacttcctaactgtgtgaatcttcagtgactggtttaacttccctgagcctcagttatctgtaaaatggggccattactttctacctcccaagatggctgtggggatccataaagtgtcatttaacagggggtggctgtcactacttgctgaatacatttgtcagtgaggcaagaggcttatcaagcaggataacattttaatgtttaaagaattaaactcctctaatctgtaaagtgactaagaggagaggagctaattccttggcggtaccagatatggaagctgtttccatatcagatttttttaaaacctgggccttcagcattgttagaggaaaaacagtttgcgtggttttgtcccccgtggattccttaaaagtggggctttggggatgttacactctgtttgcatccgataagctgctggacccatgaaaagcaaataatttagatttttcttcgtgatttttcagcctctggcgccttatcaaggcttgtgctgagggccatggcatttgtgggaaaggtgtgattccacgtgcagtcggccttctggtcggcaatatgctcttaaaaggcaaaaaaaacaaaaaacaaaaaacaaaaaaccagagagaaattgagataagattctgcaaaggcttattcccattctgtgtatggttgtttccaattatctttttaatgaaagcttcataatcaatagtggttttggcagcacccgccatctattgtaatatacgatctggtgctgtcataactttgatcattgattttttttttatagcagcttttgggactcactagcttgtgaaattaatacagtcattattgaagcaatctgataggtaatgagccaattgtgtctttatttcaatgagactaatggtcttggtggccctgtctgataggaagtgttctgcaaagccatggagggttaggaaacagagttagtaccaactgggcatgctaatttttattttcccattgagaaaaggcatagtgcaggatggtcggagatgagtggtctccattacgaaaaatagggtttagggtaatggagaatcgatcgagaccctttgttccacctggaatcaaattgcagttgaacctcgcacttcaagtgcttgtatcataatggataagaaaaggcagcttcatgttgacggacattgagaatgggtgcaggaaataaacctgaagttctgggctcaggtctcagctttgttggcaactgattctgcaaacttgagtcaatttcataacctgcctgagccagtacattcctcatagagctgtttgagtattaaaaagagacctaggagaaagcactttggaaaatgtagatgcatgtaatgttcatgctattcagtgataattgtacccttgtctgaagtcagatagaggaaaataaatcctggtgttgccacttgcttgtaaaggatcgtgggccaatgccttttttttttaagccttagttttttcctccataaaatgtgagaatcatcgtaactaccatataggattagacatgtaaagtgttttccctgcatgtcgagtggttgtttagtccagttccaaaacacagtaagtgccccctaaatgttatccattaattgataatgtcatcaatgaatacagagttatccagtgtctccagataaccgcctctgggattataaaccacatgtgacaaagaaacacatgggactctttttagaaataagcagcataagggcatcagaaaaatgacttcttcccctgtcactgactgaaatcccaccataagagcatttttcctctgcctctgggaagttgagaaaatgaccaaagcaaaccagagctacccttgcgcattggcaggagcaggcctggcccagaagcttcaggttctcgcagaaaagcatttaactcaaacctccaggactctctgccttaatcttttgctgacagtcagtcctggggtcctagcttccctcattcctgttccctgcagtctactagaaggtggctttgtggggtgccgaggaggcattgatcagagtgctgcagaggccatcatccattattgatgagttacggtctggaaatcgtgtaccgagagctgttttctgctagatccctcagcacctctgtgggtggcaccagcccagccccatcctctccagaccaagaggactgccatcccttcccccactgtctctgcccctccttacaaggctggactgaggtgtttcttttttctttcctttcttttttttgagatggagttttgtctgggctggagtgcaatggcactatcttggctcaccacaacttctgcctcccgggttcaagcgattctcctgcctcagcctcccgagtagctgggattacaggcattcgccaccacgcttggctaattttgtatttttagtagagacggagtttctccgtgttggtcaggctggtctcgaactcctgacctcaggtgatccgcccacctcagcctcccaaagtgctgggattacaggcatgagccaccacgcccggctggagtgagttgtttctaagccactgcttcactcagattgctgtgggtgcttacccaaaatattcacattcccaggcctggccctaaacccacaacccagcctttcctggggcctgggaatctgcatgtactgcactttccaggtggtgaccgtgcacagaacagtttaggcaagtccatgctagctgtgcttctcaaaggaacgtgcacaggaatccccgggggattgtgttaaagtgcaggttctgatttagcaggtctggaatggagtgcgagattttgcatttccaacaagcacccaggtggtgccaatgccactggtgcgtgggccacactgagtatccagggcctaggggaagggagagaggagccatcagcagacaaaatgctttgataatttagactcccccacctcccacttaaagggcaactgccaacaaatattgcaggtgggtgcaagagaagtggggtctgatttgcaagcacccccccattgtagacagccttcttcagcagaggactcacctgaaaccttccctctccccaggtttttctcaaggcaggtgtgatctccaggcttgagaagcagcgagagaagctggtatctcagagcatcgttctcttccaggcggcttgcaagggctttctgtctcgccaggaattcaagaagctgaaggtactgcatgccgttcccatgaggagtctgatccaacgggtctggagcgggcatagggtctgcctgtctttcaggatgataccggtgcaccgggtccaaggatccaacctgagcagtgagactttaagtgaggctttgcaagatgttatgactgtttctgggacattgacatcaaattatccatgaggtcggccttgcgctaggtagccatgaggttgtccaagccctcctgggctgattcatgacttcaacctgtcttgtttctggagaaattcactttcacaggtcagcagacagggcatgaccagggcccagccactgaggttttggggaccaaaggccaagtcaagcttgaagcactgacccatttagggtcaccatcttcagagatctctggagactgaatttcctctctgtagctgcacaatagagagaaaaccacgtggctctgggaacaagtattatatatgttcgaattccacctctacctcttagtagctgggtgaaggtgagatgaaatgatgtgcacttaatacagtacatggcacatagtaattgctcaataaactctagctgctattaccttagaattgttattcttaattactgctactactagaatggagtcttgttgtatgtgcctccagtttatgtgaacttgtaaactcaagtatatgtacttggcagaaagagaaaaatgatgagaccgtgaataatgaacatattgtgggcaaccccactggccttctgtgctcatgtagctcataccttggaatgatgtggaatagagtttcagaccctgggctctgcagccagactgcaagggttcaagcctgctctggcactgagaagctgggtgacactgggcatgtgactttacctctctgaacctcactttccccatccgtaaatacataaaataacatgatcttcctaggactatactgaagaccaagttgaggtgtgtgagatgctcagggcagtgcctagcacttacgagcctcaatgtctgctgcacaagaatcagctgctgtgatggtgatgagggaaaagcatctcttggcctgtctgccagtcagtgctgttctggtcccccccccagtgataagaatgaagcgggtcaatgcttctcaaactgtggtcccagaccagcagcatcagcatcacctggggatttgttagaaatgcacatttgcaggctccatcccagagtggctgaatcagcacctttgggggtggtgtctagccatctggggtttaacaagccctccaggggattctgatgcacattcaagtttgagaagcatgaaattactgtttaaatacactgtgaaaatgatctcccttcaatataagctaataacataatcgtggacattgttatttgtgggcagttttagagatttttcagtggcagtttttgccttgcatgatgacctttaaacctaatcctcatgtaagatgtaacctattgtatagtttcttttactctttctcctattattatttggccatgcaagactaaattatggcataatgtttgatgcagagagcctgacatatcaaaaagactacaagaaaggaagcccgtgtgtgtgtgtgtgtgtgtgtgtgtgtgtgtgtgtgtgtgtatgtgttttaaggtatccagtcccttccaccgggaaataaccccacttcctccagcccctttgctaccctctgcctcctctccttcctttatcctcacctgggttggaaaggaccctccagtctgtgttctccttccctgcagattcgccgactggctgcacagtgcatccagaagaatgtggctgtgttcctcgcagtcaaggactggccatggtggcagctgcttggttccctccagcctctacttagtgccaccattggaactgagcagctccgagccaaggaggtcagtctatgtggcaggcagggtgctgggtggctactccccacaccctgctcctcctgtttgcatctagcaccctgtgcccctattcctgaatgttcttgatctaggaatgctcagcccaacagccttgatgccccttccagatgttcctctgcctccaacaacacagacaatcctccatcccatgcccagctcctctctaggctgtgggtgtttagagatgctattaccaccctgggggttcatgaacactcactacttaacccagagaagctcaatgggcagagtctttgagtcctttatttatttatttatttatttatttattttacctctcagacaacactctttttctttcattcttccctgtcaccacctatcttttataactgtttcaattggtttctggttcatgctttttgttgttattattttgcaaaaattagtaactatacacacatatttagttcttatatttcttacataaaaagtagaatactacatatactcttcttcgacttgtattttctacttaaaatgtattctgaaaatcttgccgtttccattcttgtggagctcctccttgttctgtctttatggctgcatagccctcctttgtgtgtctgctccttagttcattccacccgcctgctgtgggtgggcggtgaagcagcttctgaatggtgctgtcataggcacagtgctgagccactggcagaaaggcaatccctggaggatgaagtgctgagcaccgtgtccatacttgtgtatacccagtctcaggcaaagcaagggactcattctgatgatttgtgttcagcccctagactgggcagggctggaacagacttgcatgaacagagacattgaaatttggaagtggtgaaacaaaaagtctcttgttggaacctagcacctgggtatcttcatggatgctggctgaattactcactccattccccaaccgctctttaaaaaaaaaaattcatctttaatttacaaagagtaatcgtacatatttatggggtataatgtgatgttttgatatatgtttacaatatgaaatgattaagcaaagctaattaacaaatccatcacttcatttatcattttttttgtggtgaaagcacttaaaatctactttttgtttttgagatggagtctcgctcttgttgcccaggctggagtgcagtggtgctatctcggctcactgcatcctccatctccggggttcaagtgattctcctgcctcaagcctcccaagtagctgggatctcaggcatgcaccaccaagcctagctaattttgtatttttagtagagatggggtttctccatgttggtcaggctggtctcgaactcctgacctcaggtgatccgcccgcctcagcctcccaaagtgctgggattacaggtgtgagccactgtgcccagccaaaacctactttttacaagcaattttgaaatatacagtgcaccattatttgttatagtcaccattctgtgcaatagattgctaaggtttattcctcctaacggaaactttgtgccgtttgctcactcctaacacaggtggaacttaatctctggcctggaatggtttctgttcatgtgtttgtttttgtaggaggagcttacaacgctaagacggaagctagaaaaatcagagaagttgcggaatgaactccggcagaacacagatctgctagaaagcaaggtatccccatccctcctcttgggtccttgtggggggtctttatgtatgtgagatctgtttaatggggagaacaatgatatgcctgaaagcatgctaattgctttacaagcaccccagaattacctgtgaggcacatgctgttattgaacccattttacagtggaggaaattgaggccctgggatattaagtatcttcctcgaggctgcacaaccggcaagtgtaactgagattcaaacccatgtcacctggttccaaaggggagaatttcttaaataagtcacaaaagcacaaatcatagggaaaaatgataaatttgactatattaaaataatgaacttttgtttatcagggcataaaatgaagatgtatattacttacttggaatagaaatttgcaaactggaaaagagtatccagaacatgtaaagagctttctcaaatcaaatggaagaaggcaaacactccaataagaacggaaaaacaaatatgagccaataatatgaatgggcagttcccaaggaagggacgcttgtttcaagagtttaagtgttcaaaaattcaaatggccaataaactcatgaaaagacactcaacctaattagcaattaggaagtgcaaattaacaccttaataggtactgtttcacacatcagattggaaaaattgaagagtgtgatgtagccaagtgttggcaaggttgtgtggcagtgggaattcttatttactgctgctgggatcataaattgatctcatcactcttgaacaatttggcattatctgtgaaagttgaacctgtccatgccctgtggctggccattccacctctaggtatttatgctagagaatcttatccacgaatatatgaaaatacaagaagttcatagcaacagcctttgtcctgttgaaggaatgtaaacacaggaaagtaaacattcaaatgggagcttattaacagaacagtaggtgaatatgttttgtgatattaaaaacgagctcccaagagtgaaaatgaatgaagagacagggaaaactgtggctcacaggctaaattcagtgcaccacctgctttttgtaaataaagttttattggaacacagccacgctcattcctttatgtgtagtctatgactgctttcatgttacaatggcagggctgagtagttgcaacctgaaactactcagccttgccatgtggcctgcgaaagctaaaacatttactctctggatctttacagaaatagtttcctgatccttaaactagaaaatgtgtatcaacatgcatgtattgctcttgcaaacataatgccaaaggaaaataattcagttacagaagagtacttgattaggggtatatccttgtatacttatggtgtcattatatttatgggaatcataacaccaaattcagagtaggggttacctggggtacggtcatgtgactggagaaggttatgttggttgaatgtgtgaccgtattccctatgccttctctctttgatttcatgggctggggtgacttcatgggcatgggtattgatttcatgggctgggggtgactacatgaatcagacagttcccactccaagaaggtcactgcaaattacagatagacttctagacaaagtcatatgctgtgctagtccattcttgcactgctctaaagaaatacctgaactgggtaatttataaagaaaagaggtttgattcgctcagggttccacaggctgtacaggaagcatggctggggagcccttaggaaacttacatcatggtggattgttaaggggaagcaggcacatcctacatggctggagcaggaggaagagtgagaagggggaggtgctatacacttttaaacaaccagatcttgtgggaacgcactcactatcactagaacagcaagggggaaatctgtccccatgatccagtcatctcccaccaggcccttcctccaacactagggattacaatttgatatgaggtttggtcagggacataggaccaaatcatatcatatgctattatgttgcatgtggtcagcaagccacggctagaccaaagaggagcttttcgacgaaaacctgctgttctatgtagactttcaggactggggaaagggaggcacttgactagggaataaaatgtaaggggtcaccaaaacactcagcaaagtaaataatattttaaaattgtaaagtaatgcaaaaaataatccctgatgaacaaaacatcaaaattttaagtaaatgcaaaatttgtaggccaagattagggtgaggcaagtaaacattctaaacagtgtgaaccaatctttatataaaatgttgatattttctttatcgtggattttttgactaattgagatttttaaaatattgaattaaaatcttatttatcttgatttctgagagtttttttttgacacctccttacatgttgcaccctaggtaagtgttttacatgcttcattctagtctcagctctgtttgtccatgaagctctgggtacctccaaggattctgttaaagaccaaatgaaacccattttttcacccactcaacaaatgtatatgaacatctcccatgtgttagacatttgactggacaccttgatagagctaggaaggagggaaagtccctgtccttacacaaggtctccaggccgatagagggagacagaccacaagcaagcttgtcacacatgaagtgctacggatatgaagcagaaggaggtgacagtgatggaggttaagcatgggctctatttgcctaagtggtcaaggaagaattccatggaaggggatgttggactctagatctgaatgatttgctgtaatctatatgcagatctggtggaaagagtagatatggcaggtgccgaggtcctgggacaatgtgagataatatttgtcagtccaggacaaaatttaaagatttctacacccgagagcacctggtgttattacttgcttataatgttgtttggcttggttaatggacaatggtaactgtaaatggatttatgattaagccaacagaacctactcttcttcccatgttgataacccaagttgagcctgagatggctcatgtggggatgtggaatgaagtttgagaggaggccatctcttttctgcttcttctcatcttccctgtaagattgtgtccattctccccacattaaagtgtcaaccgtggagttggccacggagaaggcagaagccttgctccttgcaggaaggaccacatccacacaagagttaagagaggctgggctgagatacaccttgagcctatgctcctcctatgcaaaagactgtaagggggagaagaaatgacacacacgtgcctgatgtctcattcatgtcttgcgagagcaagctgtctgacctctcttgctggcagcaacaatgagtagaacagcagaagtgaaaaattggagagctgtgggctggttgggaatatcagggacttccctgtagaaattccttcccaccgagctgacatttgaagcagtcattaatcacgaactgtcaggttggatttgccatgcatcggctgttgggggagatgtgcggggatgagatgaacatcttcagcatccagagctgcagtttacaggacacttggagaaggaagggtgggggctcaggcttctgcaccctgaaccaagcaaacaaatgccaacacctacagaatattctactcagcctctttaactctttgcttatatcatggttacaacaagatgtatggggccttgaaaaattaagataaaatttaaaagtgaagaaagccagagcaaagggaaataagagttgatgagtgtatggaagccaggggaagaggtagaaaatggaaatctacctttggccttggatgccctctcacttcatagccttcacatgtgctgttcactctgcctgaaacactcccttcatcctcttcacctggttaatacctcttcatcccttgtcactcattttaggtggcacttcctctaagaagccctcttcaacactctaagggtgggttagggccctactctgtgctaccactagccttgttgtttcccctcacaggattaattgactctttcctagtgacctcctttatctgtgtcccagctagactgaaatccctgttttcatccctgttcgtcaaataatcccagtccctggcacaggatagataaagaatggtcaaatagaaccattaaagttgggcagaaaaatccaacactgaacttcctagcagcgaaagctaagagggaaacaagctatttcatagacatattgcatgtagattgaaaaaaaaaaaagaaacacctgttacatgagataagagtaacttttctggctattgaggtgttagggaaatttattccatggattctcataaaaggggcactaaggcatttagcaaagtatgacttcagcaatattcacacagcaattgagaagggatgggtaggagcacttttggagcatcatcctgaactgtaagccaagagcatgatgtcatttctttcaaaaatgaatcaattgaaatcaaagcagtgctttatccaggaagcacgtttgatgactgagtattatgatgactttatcttcctcaaatctttctcttccttcccacttcatcttccccaacttccagtgctactactggtttatgtcggtcacttttacattaaaaaatttttaaatagttttagagcgtacaatggcagtttttttacatggatgtattgcatagtgatgaagtctgggcttttagtgcaactaccacccaaatagtgtgccttatattcatgaggtcattactcttttttaattagttaattaatttttatttttattttttgagacagaatctccctcttttgcccaggctggaatgcagtagagtaaacacagctcactgcagcctcaacctcctgggctaaagcgaacctcctacttcagcctcccatgtagccaggaccacaggcgtgcatcaccatgcctggctgttttttttcaattttggtagagatgggggtctcactttgttgcccaggttggtctccaattcctgggctcaagcgatcctcctgccttggcctcccagagtgctggcgtgaaccattgcaccagacctgtaattacactttaaagagcattccagtcacctggggaacagttagctctgtatcttccccagtccacctcctgagggtctgacccaagaggaggttcttggtatggggggtagggagccctccagcccctaggcaatcctgattcagagggtgaggttgctttagagcagtggttctcacacttgcaaatgtgtcagaatgccctgtaagacttctccgaatacagattgctagactccagccttagagattctgaatcagtaggcttggcgtggccttggggaggctgtatttctaacatgctagagtgctaaaggtgcctgtcctgggaccacactttgagacacattaggccagagaacagctagaagatatcttcttccatgtgcatctgcttccttggaagggaatttctgttaacagacagggatcagacacccttccaggaccatgcatcatgatgacacccctgctgcggttcgtggcctctgcatgccacccctttgtctctggagggggagaaacagtaatataaacattgctaaaacgtgtcgtgtctcgtcagtgaaaactccatttgactaggcttattaaaaagacatcactattgcaaaatgatttaagtgcttcatttgtgaaggagcagaagaggagatgaggagcctctaagaatctggctataaatactcttcaagcatgcaaaatgtgccttgatgcaaactggggtttttttattttcataagaaggcagtgctggccttcttgttggaagcacctgtaaggttttgggaccacatgggatataaaatgaggtggggtgtttttccacccctctctggaataggttctggattttccccccaagaccttatttatggcaaaagacaggcccatgcactcctcatttctggcctcattagcctgagaggtttcgcttttggtaagaaattgtggagacaatccactgacggggactgcagatgtatgtaggtcagaaagtctatttgcaaagtgctgagggagtttgatcatgggtcatgagtgtggcttccagcttgtctctagcaggaggtaggaaagtgacttgttggggtcacatggtcactggtaactgagcccagaccacatcccaggtctcctgactcctcgctccatagtcctgccacagcatcatgcttctgtgaggaactggactggtagctccctaatccccgggggaaattagacagcctggtttcttatctgtcttaggctattaggatctgttgagccttcactgttgggacatgctagggagtatctcctggtggacagtggaagagacatggtggtcatattcatagatggtcctggtggaagaaactaaggcctctcagctaaagaacagctggtgtattctttctgactgtgtgcctcagtttgcccatacaaaaccgagtccataatctcttctctacctgccttgtaacacagatgaataatctgggcactgtacaaggtaaggaatgaatgcagtgacctgaccttgtatgtccagtttggaggggcagagggtcgagccagcttgagttccagatggctgactctgtaccttcattgctacaagattgtgggcaaattcttcaagtctcttagcctttgtttcatcatcagtaaaatggcaatggtaatcattacttcatcttgataagcctgtggggagaaggtgcatgtaaaacagttataacactgcgtgctatctagcaagccacatcaccactattaccaataaatatattttttaaatgtttaccctccccccagtagagtgaattcctcaaagaaaatgacatatcgtagacagttttatacccttctgtgtctagtacaaagcattcaatgcaaattcagtgaatggagtcatactgaatttaattagaaaaattacatttaatgagtgatgttctgtgccagctgctgcgataagtcctctcagcattgtgagcatttacctgcattatctaattttacctttaactgaaactgtgaagaaggtgttagtatccccatctcacagatgaggcaagggaagcccagagagctgaagtgatttgtcctacatcactcagctggtgaatggcagaactgtgatttgaacccagggctggtcaactccaaacagactgtgattgaggagaagcatctactcaggtgggaaatggggtcagggagggcttcacgggggagaagtcatgaaggataagcaggagctggccaggtgacaaggtgaggggacattccaggtacagggcacagcaagagcagaggcggagagcagaacctggtctggcaggtgcaattctggtggttggagtgtcttgtatggggatgtgtttgtgtttggggggttgaggggttgcctatgggttagagatgaggcatgaagccggactggatcgcagggggtcaggagaatcacattcgaggtttggacttcatcctgaaggggagggcaggaccaaaggacattttcaaaaagaggtatgtgggtgtcatgatcttaggattatttcctctttgtgctgaaacacttggggggccctaatggcccttgaaacccccttataaagcccctgaaaggccataactgtcccttcattctagagggacccccaaggccagtgggtggtgtgtcaccctcctatgcccagctcagaggcataacctttctcctggcattcttacaagattgacccattcccactgacatccagagcctatagagccttcccatgtatgaattgctgtcatgcacttgttagttcagtcaacccgtattcattgagtcctcaagagtcagtttggcagagtggttaagtagccaccacctggctggtgtccttcggtgagcgtttgcaccttggtgcctcagtttccccatctgccacctcgagacaacatcagtacccacttctcagcattttgagcattctgtgggcaaacctgtgcatgtggtaagcactatctgtggtggcgatggttattattatggttattatatgttacttagtagcgagtggtgaacccagctgggatgcacagcagagggctggaactggtgtccaacaggcatctctggggaacccgggagcctgccactaagctgcagatttattttgaatttcccctgctgactgaggcagctctgggggcagtaccatgagactgaagccatggcttaatctccttgacgaacatcccacaagccagctggtactgcagttgggctggccctgtatctactgcctcattttgtcttttcttcactcaggttgaagggggtgggagtgggggcttcccttccactgggcatccacctaggctctctttggccaaagtgtccagcaagggtggttgaggtccagatcttacttggtctttgatctgtacccactggctacttaatctcagctctctgggctatggctgcctggtttgttctaggtggataattgctttactaacctccagatgccagaggggtgagggaggtcaaagaaagggtcagatggtagatgtgggacagaaaatagtggggttgttgtgagccaggtgctgggaatcaggcagcccaagctgggctacctctgctacttaccagctatgatcctaagcaaatcactccctctctcaactccccagtttcctgttctgtaaaaggggaataacaaaaatgcccttctcataaggtatttgaagggcttaaggcaaatgacatatgccaaatgcttagggcatacctatcctcagcatttcaagagtgtgagctgtttctcacccaaggggttataatgaacagatctttctgtgcaaattgcaaagtatgggaggagagcaaaaagttgctgtttcctgctgtctgcaggtcagatggtttttgggcttgacagtctatgaatataagagctgaggacaggatcaagccaagacccgtgtgtgcccctgtggtttgtttgtctctctgactggccagtggggtccttcagaacaggacctggcacacagtaagtgctcacatagtgcttgttggatccgtgaagaacaagcaacagtgacggtcccaaggaccccaggtgtgtcctccagcatttaacatccgtgaaatcccagttactcactgctcgcccaagctgcaaatgaggccagtgcacaggatatttttttttctgttccactccatacaaaatatacaacaaatttattaattcctgtccccttctctctggcaggcccttggagtaattgtccctcaatagaaagaatatttctgttggtttggccaagtggtagatccggagaggttttcaagataatttctggttaattggttcttgagtaatctgcaaggactcttctgggtttgcaaaccagactccccccttcattaaattggttttcaatttgcaatcgcctgacagctctgagcatggtgcctgctcctcacctccatccaaagcccctgtgccccatggtgtgggaagggatagggatttatggggacaggggaaggtcaggggcaccttgtctctgagaaaaacatgtgtcatttcccccaatttgaaaagactaattgtcctttgggctccagactttgggttctgtgaaactcaaaattaatgcatcaaattaattgtgtggtccccttgctcaggccggttagcataaattaaatttcacactaattggctaaggtggagagaacacagtcctggtgcttggaattaatgctaatttcaaggatggtgtttggggtgtgacctggggcattcctggcttgcacctccctgtattgtgtggccagtgcaaatcagcactcttgcagcaagaatgattttgcacagccttaagcaaatctaaccccttcaaatccaagtgtgaggccaaaattaggaggagaccctggcagtttctatggcagtaattcctaaatttttttgttcataaaaatcaccctggagcaggttgaaatgtagattcctgaattatgctttagagatcctggtttgggggtctgagagtcctataatttgcattttcttttatttttttaagagtcagggtctcactctgtcactcaggctggagtgcagtggtgtgatcatagctgctgcagcctaaacccctgggatcaagtgatcctcctgcctcagcttccagagcagctgggactataggcacacaccatctcggctggtttatttttaaaaactttttaaagccagggtcttgctatgttgcccaggctggtcttgaactcctggcctcaagtgatcctcctacctcagcctgtcaaagcactgggattacaaacatgagctatcatgctctgccctagaatttgcattttaacaaccatctgaggtcattgccacataagtacttccctggtgcacggtgtaaggaacagcaagagaaagctcccatgctggagacaaccaggaacaccctaggagagtccctcattaattaactggaggtcctgacttggacctgactggtctgagttcaaatctcagttctgccttttacatgtgatgtgactttgcagtgcttcccccaagccttctttctcctctgcgtctattgaaatgtgcattttggtctcagcagtcggtgatgcggtcaacagggtgggaggcagatgggctggagaagtgaaacagatggggagcatggaatgcacagagcagcctcagattttgttcactctttttgaaagatgttttgttttctgattacaaaatcagttaaaaaatcaacagtacagaaatgcatcacaagaaaattggagttccctgtgagcccatccttccaggaaaaaaaaaaaaatctcaattaacagtttgggagtgctttgttctgtgcaaacaaaaatgggattacaccaaacattctattctggaaatttgcctttttttcccctttggcaatatatcttggggatatattttttttatgtcagaacatagatctgcgtcttccttcttcatgggacagctgaataaattttgagcctgcctaagctgacagtaccgagagaggctagctcgggaagggcagctacgttgctcattgtaagaaccatttaccttctcagtaaagataatgcagagtcgcctctaaatatcagtcatgatgcagagggtccgatgaaagagtgaggcattctaacatcttcacatgcaaaatttacagcaggaggacatgtgaccgcacccaattcaatgcattttacagctcaggtgaccaaggctccagagcaggagggaatgtccaaggtgttagttgttgagtctggactcgaaccttgcaccctacctctttctttttttttttttacaattctgctgccttccataagaggtagcctcagttttatgagctgcccttctcctacatagggttgtttctctgcctcttagccataaacactccactaatatatttctcccgttacgtactctgccatatcctcaaaccctgaacgcttcattttggaacgataatgccacagaagccctgctcatttggcatcggtggctggtcagttaatcagaaaaaaaaaccagtgcaggtgggaattcatttaaaaattcctattttaaaattaattacatgtgtaatttaaatcactgcatttctgaggcaggacccatccatttctttctttcttaaaccacgctcctaatatacaaccgtatgatttccaattttggcttctttaaaacagagcaaatggcaaagtaatttgaatacaaaaacctaattttttacttcaagtttctttttagttgttgcaacaacacctatttggcagcattttaaaaagcagcttacctttattaattccttccaaggcattcaacctagttttcatggaaactctgtccagccatattttataagtttatgtagtagctaactgaatagatagctatggtaaaaatgcaataggcaaaaacagtttgggagcacacacatgtgatactggatgtgcatgcctgtcacctgctagaggcagataggccatggggccattgtagagaggtggtctggtggagagcattctggtgcagtgggcatccatcagtgtgtcttactgagggacagtgttggtacatccagtgagatgatttgctaaaagctggttacgaagagattccactaaaatggccatttttaaaactgagcacttactacgtgccaggcaccgtgctaagctttcaatggattatctccttgaatcctcaaaaataatgatgtatgttgttttcccccctttaaagctgagaaaactgagaaccagcaaggcatcctgcttggtgtaaaatcacacagctagtgagtgttgaaccacatcaagaccaataaaattctgaagtccatcctcttaacgagttgattatactcaagggttgctttcccatgatagtgatttgtccaaaggcgatcctgtgcatggggagagaagggttggtggctccatcgagtgaccgttccttgatcaccccattccccatctcagattgctgacttgacctctgaccttgccgatgagcgcttcaaaggtgatgtggcctgccaggtgctggagagtgagcgggcagagcggctacaggccttccgggaggtccaggagctcaaggtgagtggtcaggggtggccaggggtggctgaacacggtggctaaaaatggttgggtctgctccccgaccctctcattggagatcagtaagcttaagcaagatgcacaggttgactgactgctgggctcaaggtcctgggggacacttaggtctcctaaggcttggccttgggggtgttatgggtggatagtccctggctagagaggcgaataggagaggattgtgcagaaggtggacagtctttggccttggaggtgatttgggtgagaaatatgccgaaggtggctagcccatggtcctggattctgcatggctcagggctgtgcagagggtggccaatccgagccttggaagcacttcatgggtaagatgaccagcccatgtcttctgtccagctctagtttagaccttgagccctttcttctagagcaagcatgaacaagtccagaaaaaactgggagatgtgaataaacagttggaagaagcccagcagaaaattcagttgaatgacttggaaaggaatcccactggaggaggtgagcagcctgggacccttggggctggaaggtgatggacaaagttgtctttcccatttattcagtcactcatagagcactttttaggtgctagatattgcatgaggggctgcgactttggcagagcaaacaggcacagcgtactctcttggagcttacagtctaatggaataagcagatattaatcagataatccaacaatatcccaggtaacaaattatctgtatgatatgtgctatttagttttaatgcaaagaatgatttttaaatagtggctttatgggcaaggtacttttatgtttatgtgaatattttaaaaataaattttgagaggcctggcgtggtggctcacacctataatcctagcactttgggaagctgaagtgggaggagtgcttgagctcaggagttcaagaccagcctgggcaacatagtgagaccccatttctacaaaaaatttaaaaaattagcctggtgtggtggcatgcacctgaagtcccagctacttgggaggctgaggtaggaggatcacttaagcctgggagacctaggctgcatttcagcctgggctacagagcaagaccctgtctcaaaaaaataaaagcaaaaagaaaacgtaaattttgaggaaggctgtctagtggttaaaagttggaacctatgaagttgtatttctggatttggattttggggcaaagaaattgctgtgcctcagtttcttcctctttcaaatggagattgtcttggataattgatagaaaatgtttagccacatgtatagaatagagtgatgaatagctaatagctactttaccattattatgaggaatgatgagatcacagttcatccttatagcaacctgtggaacagaaactactgctctccccattcaaagagggtaaagctgtgtcaggcgcacaacagttaccaaatggcgagaaggcgagaggactcttggttttacccagggatattatacatttgttcagtagtgccaggagtttctggaggtgtccttcttatacagtttcctggagacctcgtgattggatggcatggtgacatctttgccaccttgtcaccgtgcctcttactctccccagcctaatggagttgggtgagaaggatatccagtgggtcagcttctataaaatgtcagcattattccctccgtgtgtccagagaatttgtgcccttgagatgtccaggggaatggagatcaggggtctgtggaaaagagacaatgagtatttattttctgtttcattcttgttcttgttatcctggctacccccgtggcaggcatttagcagggaggttaatacagatgagtttgaggctctcttataagcgagacccaacaaggtagggtacacatagagagaggggaacatgttggtataaaatcagtagtgtgggacagtctctggccttggaggtaatttctataaaatccccagaggggcgccagtgtcagttccatctgcgtgaaattcatgtctaaataatgcttcccagtttgttttcctctgttaagattggggtgttaatgagagggggacatgtgcttagctcatgggcacattagtcacaatgctatataggctctcagctctggatgctcattccaagaagccaacccacaaatattttgtttttcattatgaaagtaatacatactcattatagaaaatgtctaaaatataggaaatttgaaagaagcagtaaaacattttaatcatatcatcgcagtggtaccacaaccacctctatggttcaagatggagtatgaattatttaaaaaaatatgttttcctttatgcatggctaaatatttaaagagaaccttttgtgatatgcactcagcgtggagctggacactgtgggggttacagagggattttaattgggccctgctctcaagatattcacgatataaatggggatatcaggtaaactcaggaaaacatgttgattaagggtggcactcatgggcagggaggttgaaggtagagatgagccttgaaggagaacagtttcccctcttgttcgtgttgcccactcatgccacttgctctatagcacatcatagcacagagtacatgggaagctgcagaaatgctttctgctgctgcttcttacttttgcagtccatgctgcttgtgattgtgaggcttttcctggtggagagatagtgtgcttttcccatcatgatgtttttaccttggtggaagcttgaacaagctttaactctttattattataccatccgttatttggttaatgatgtagaaatctctattgaggtcacctctttcaagaacttaatcctaccatccatccatctatccatccatccacccatccacccatccacccatccacccatccacccatccatccatttatccatctgcccatctactcacccacctatccatataccctaccacttatttatatatcaatccatgcattcatccacccatgcacccacttctctgtctacactaacatccatccatccatccatccatccattattccacctatccaaccaactatttatccattaatcctccaccctatcatctagtcaaacgtcctatccattcaactatccacctttccagtggaagttattgagcatttactatatgctaggcattatagcatattctaggaacacaatgatgaacaaaacaagtttgttgtcttattaattttggttctcttctggatttctataagcttctttatgaaagccctgatcatactaggcttcagctgtctttttacttgtttcccttgcttgattattctggaaggtgggtggatatggcttcttattcatttcattatcttgtacaaagtagtgtgctcaatgagtgtgtgaatggatggatggaaggatggatggatggatgatagatgaataagtgggtggtctctatctttggtcatccacttgtggaatgttttccacaacttcattaacttaatgggcattattctattattcagatagtcaaaagataagacatcttagcctaaaatattccattctaatcagtcaaacagttttaatcaaaccagccaataatttttttgagatgtttaccaaatcaagggatttggtatccatcttatcttgtggagacatcttctgaacagtttagtagagtcttgaattattgctaatttactcatttgttaattgcaccaacagccaatgattatatactctgtacaacccaataaagttggccagtaggatgactctttttatctgattattgtattaggttcattaagcaatccatgagcttgtatcaacatgtaggggaatctgcttgtagggaactcttccagagggtgtgaaggactcacagatgactgaaacagctcccttgcccttaaggattatgaaatttccttggaaaagggaagatatgaatacacttatagagacaactaaacagtataaggcaaccaatcttagaagagtgagcactcaagaactttagacagttggaggtggtcaggacaggctgcctggaggaagcgttatttaaaactcagagttaaagcatagtttcttggtccaaggttgaggctcaagggctctgtgaatattgtgaaattgcatgccaagagccaagaaagtggaggagagccactcacactcttgccttacactcatttggcctcttatcctggtctccctgactccgttaaacagcagacgagtggcagatgcgcttcgactgtgctcagatggagaacgagttcctcagaaagcgtctgcagcaatgcgaggagaggctggactcggagctgacagccaggaaagagctggagcaaaaggtaagatgtggggatagtctgggccacagaagtgttagagagtgggcaggctctcacctccactgtgggtgatcgaggtattagctgagcctgaagagggaggaagaggacacaaaccccttaaggtttttccatctccactattattacaaatgctggtcactgtgagacatgaaaaatattgtctgtacatgtggatcttctatccagagactgctctgtggtgtaaagaacatggatattaactcaggatatctgagttccagttccatttctacgtgaaccttgtggaagtcactttaactcatgtttcttatctattacataattatcagcggtctcaaaaccttcacatttccctgttgcctctgttctaatctgctaccttcatctctcatccagaccaaagcaatagcctcctagctgtgctccttgcctctggcctctcctctcaaccacctgccacactgcagccaaggaatgtttcagggtctctttcagattgttctgtgatcataaagtatgctgactctcatgttggatttttttccttgtgtgttttgtaaatttcgtttttgagctcatcttcaacaggtttctgtgctcctcccccagtagtcacaggtgttctgcattgtggaatgtttttttttttttccgctcccagtgaatttttgtgtgtgtatttagctattttttattgtgagttcaccttcagcaggagatttaatttttttaacattctgttgactttgatgggagccctttgataacagggtcgtgggtgtgttctgctagaagaaaccctttttcactttctttggcagcagtccttgagataatgctaaattcttggtctcagatgttttgcggcatgtaaaaattgtcaattggatctctaaacccacatgaggcttagacctggggtttaaaattcttacgagagtacttcttgccccacctagatccagggtgaaagcaagctttcttaccaccttccaggccagcaggtggagcttttattttctcttctcactgaggtgcatgcagttctttgaggggtttgtcaatgcaacggtcttcattccaactcttcaccttccatgagcccagagccttgtctcctgtctctgtctgggcattgaaacacaaacctctatcctaaaggacacttctggatctatcaactgctcttccccctcatcctggccgccataatattagtatgtaccattactgttagggctttgtgtcctctgcatttctgatatcctgaaatttccttctttcttgaaggtaacattacaaatctaatgcaatcttatctatatataatatatttttatctagcctttctagatgaatgtacagatagtttggtctctctgcttgtcttctgtggcctccaactatccctcgtctacattctaaccagttcacactctaacaaatggtgtgctagtaaatggctccctggaaaaaaacaaaaagccctgatttgtagcacttgccaatttccctggtgtaaatactcccaccatggccaatttcaaactaccattgtgatgtcactaacatggaatttgaaagggatgcacagaattagctctgtgcatctctttcaagtcggtaccagctgactctggcacaccactgattccagccacactcagttttttttcttctccttccaaaaatgcctgattctttctcacctctgggactttgcatgtgctatttcttcttccccgagcaatctttctttttctctcctgcctagatatctccaactattcttaagatcttagcttaaatgtcactctctccagaaagtctttgctgacgcagattgggttgggagtccctgagttgtcttccaaaacataggcctcatcatgttgtattgtaattacctactcacttcatagtctctcccattcgatatcggagccatagggtggaggttatatttgtgtatctattctattctcaacgtgagcaaaaagtatcatgtgattgccttgcagaggtgggcctgggtgagatcacatgggattttataaacaatggaagtgactcttgatatcctctatgctgatggtgatgattttagtggtcgctttcaaggtgaacattgcatcgtggtcctcaagagacatcttgaaccatagataaacacagatggacaactgcaggaaagcagcccagttctttaataacaaattataaagttgagtcagtttccctgatgaagggggatatttatgctacattaaaaagtaataaaacagcaaccttttctgagcagcagaatataagagaacatcccatttgccttcaaatactgaatttagaattacaggcttcattaactcagagttttgcttatttaaagcaattttttaatgaggccatttcttcaaagccagtgtgctgagttgcgtgctctttcccagatctaaactaggacatttgggagagtgtttcctggaggaagatgcaagagtcttgacttttgtttgtttaaggccgtgtgcattctggtattaattcagtccatgcaaagtgccatttgctgctttaacctttaaggcttgtcacttgggattccgggtcagattttctaggtatgtcattttggctgctctgtggctaatcctcacatatcccttctgatcatgtcggctggtggggatatgagttatccggtggctcaggggtcatcaagttgaggcagggtaggtaaagtctgtgggtgcattggctggaggtttattgagcaaaagtaaaatcaaccttaagagattgatggaattatccccactttacctctgagcaaactgaggctcagaaaagtagcttcctggaggtgaccctggaggaaggtagtcaagacagggtctccccattccagcatctgctgttttctcattacacaccttggaaatagcaactccttgaaatacaaagtaaaaagctcgttccatgcccacagagccgggtaattcattctattactcttacagcttggggagttgcaaagtgcttatgacggggccaagaagatggctcaccaactgaagaggaagtgccaccatcttacctgtgaccttgaggatacctgcgtcctgctagagaaccaacaaagtcgaaaccatgagctggagaagaagcagaagaagtgagttgcatctctcaccatcacctgggctgccagggtgggctacattggagctggcgttttctggggtatccaggttctcctaactccctcacttcaactcccttgttttgctctaatcttcctccctgtcccgtcacaccttattcctgtatggttctcccaagaatccagcaagaaattattcttttctcttagccagcctcaactatgtggccaattgatcttgtgaccttggggaactttctttgcctttctgggccttaacatccccatttgtcgagtgaagggtttgttgcagacggtcaagacagcatggcgattaggagcccaggcattgatataaaagtcatctcattcaagtcctaaaggtgcctctttctagatgtgtgaccttgagcaggtcattcagtccttcccagccagattccttatccgtaggttggtgataagatcgcccccttgtgctgaggactaaatgatgcagtcagtacatctaagtggactgatcctggttcctcttcctgttggtgaaaattgggctagagaataaggaggaggccaaaatatggccttctcatttaggacttggactctcagatcacgtgagccattctggcagagactgggccttgtgcaccagcaagatgctaatcttgaatctgcacggtgtggttcccatatttgcattccctttgggttgctgttacagtgaggcgatggtggagcctggatttgtacccagattcgcacactcataggcttcttcatgcaaaacctcagaacctgtgatgcttggacgccttggctgtgtctaaagttctccagctcactcggtgaggggaaaggtatacaggggtcctgttttgagccagccaagtcctaatggagatgtcatactaggcaaataggtgggaagcagcctcttttagaaggcccatgataaaatacagaaaaatgttcctgtgtgagccaagatgtgaatttgtggaaactgcctcctttccaagaagtaggaaggagaattatatttccatggaggtggcatagattttgaacttgatctgcattaaatattatttatcttatttatcctacagctttcctgagctggcttcttcatctgacaaaggtctttgggggattgttagcgtgctctgcatccccaaaataagaaagatttattttttgtttattgatatctcactctgttcccctttccacctccctgtgggtgctctggctgaaccttacccctgcagtggggaaaatggcttggctccatcttggccacctgctgtgtgtccttggcaaataacaccacctctctgggccagagagtgactgatggttcagatggtgcagaagtctcagtttaacaggtcatctgatctggaagaatggctctgacatatacccctgtctgtgaaacaagaggttgggactccatcattccccaagtttctcccagctgtgaccctcttggcccccaactatgggttctactcctgttctgagaggcctaactgagggtttcaactctctgatgagtaaggggccagcctctggagtttgtgcagccagaaaattccatctgtctggtctttccttttccctttggacagaatccctcattccaggcacttatgaatctccccaggataccccccaagcaaagttcctatttcttcatatttgcatgccctcctctcaaaacttagctttcttgtgatgccctctgctctgttaccatctctaggcagaagctaatttatgttttgatgccaattgcagatagcaggcattacctttccaggtagattagcattttatgtctcagtctaactgtggaagttcaggcagaatgactatggtgaagggaaaatttagaagtcagtaatacttccttgcatctctcgatgcttaatcgaaatgtagatgcagctgcctcctgagtttgctgggcccaggatagagtgatgcctccacattggtagagttctctgtttcccgctttggcttctaagttcagagtggcctgggatggtttcattttggttggattgtttgtggcatgattaccctatgggtcacaaagcttggttctgagggctgatgaaattccgggtaagccctgtgctagactcactgattcccacactcaagggtggctggacccaaggccctttcttaacagattgaaggttgtgtgcaaacctatctggcctcaggcaattggctggtcagtgtgggctgtttgctaggagctggtgtttgtagtagctattctttggcatcaagtggcctgttaagtcaaggactcctctgcaccatcagttactgtctggtccctactgtcttacctcacctgtcccaggaatggacaggtagatgggggactagctaagacattagggaagcccaagtccatttctaccactttggaatttggggctgaatcactcctcctctccgagtgatttcagtttcctcctcagtgaatggatcgaataacatgtttcttgctgaactgttgtaaggacgacatggatcccagcccaggacctgacacactgggactgctggatcatcaccctcatcacaatgcttccattcagaggcagcaaatagtgccccttgaatgatgtcaccaacagccaatcagaaagctcctgagctgttccaacaggagggctccattatgattgggtctctcagaagtctgagactttgaatgatagtctagtattaaggaacactggatagtcttataataagcgagactttcttgccaccaaaggccaaaccccatgcccacttctgccatatcaagatctctggaacaatgggacttcctgtttgggccaaggggaagtgactgaaagtcacaccttactgaggcttggcaaagccttctctatcggtttcctcacctgtgatactgccaggaggctgagacaactgaacagagtgacataacatccaggaggggcttctcacccagtggtcatcacagaagggcaggagggcccctaacaaggcattaattccctggatgactttcagtaggactgactagtctttgtgttttctgcttgagaaacaaatgaggacaagaatgtataaatgtccatcattttattgataatcagcatgctttagtatggcatatgagagtataagccagacaatatgttaaaatatgaaatgtagaatatcctcattctacttacatccattcgtttgttcattggtcaggaaatattggaagtcaaatggggcctggtagatttaaggggccttgacatatgctggcagaccagatagatcaggtttttgggttggttttttttttttttttttttttttgagacaaggtcttgctctgtcacccagactggagtgcagtggcacaatcatggctcactgcagccttggcctcctgggctcaagggatcctcccacctcagcctccagagtagctgggattacaagtgcatgccacgatgcccaggtaattttaaattttaaatttttaaagtttaaaaattttaaaaatagagatggggtctcactttgttgaccaggctggtctttaactcctggccccaagtgatcctccttcctcggcctctcaaagtgttgggattacaggcgtgagccaccatgcctggccacctttaaaatatatcctttattctatatctgtatatagttttattctatttttattcctgtccatatatttttattagattttagggttagcatttagattagcattttagtagggagatgatgggggcagcagaagtctcagtctaacagtggaaattcaggcagaatgactatggtgagggagaaatctagaattataagtatatcgaatagttctgtggcaagtctacctcaaccctaaaaattgctctgtggtttttcagattcccaccctacatccacagccttacgtaaaagcattgagaaaaacttccaacttctcatactttctctatctctcttcttccttttgctctctttctaatggttcttgggaaactagcggcctctctgcagcccctccctgcccctgcctcaatcactcccctgcccacctgcctacggggccctgacacgtgctctgctttgcacaggtttgacctgcagctggcccaggccctaggtgagtcagtgtttgagaagggtctccgtgagaaagtgacccaggagaacaccagtgtccggtgggagctaggccagcttcagcagcagctgaaggtaagggatgggggacacagagctatcttggctcttggtggctaaatctcgggaaactgcatcgtgcacctgctgcaaatggtgacagagagaaaacttcacaagggtatcctggtctgtcaagcagctgaatcccagtgtgtcttaataaaatagcaaatggtggctggtaaattgataatcagactttgagcaagattgatgtcttgatcttgcttcagttacctgcacaggttccgaggtgcttacctgggaggtataacaggctcagcagagaatgagttagctataaccttgtccaggagcaatgtcctggtccaagcaggctccaatgcagagagattttactaaaatacaacacgggtgcctcactcagctgctcctcatccttttgtggttctctactactcgcaggagaacctctgagcgctttagcctggcgttcaactccttcacgatctggcccaaagttatttgatcctggagctgactttgtaacctggaagagtcatttctgagcactttgcctccctgctccaacatctcaatcccagcctcagacggcacacagggaagctttagctgtgtgcctccacttcccttacaaatggggtcaacccttcctgtaggtgctctgagatcgaactctagggacaatttattccaatcctacctcccacccccaactccatgcctgtaggagctataccaagagcagcccttgctggtgtcccacagggggcgctgtgagggacggtggggtccaggtggaaatggcaggcattggaaagtggaaaacgccactccagccccagttggttgtagaggtatccctgggggaggagggaggcatactcatgtgactccagatctctgtcctctttgtctctgtagcaaaaggagcaggaagcctcacagctgaagcagcaggtggagatgctacaggaccataaacgggagctgctggggtcaccctctctgggggaaaattgcgttgctggcttgaaggagaggctctggaagttggaatccagcgcccttgagcaacagaaaatccagagccagcaggaaaacaccatcaagcagctggagcaggtaggaaagccctgtctcagggcaacaccctgtcccatgtctccaatgcagagtgatgttattaaaatacaatgtgggtgcctcacttggctgctcctcatccttcaatggctccctattatcccagggaacctttaagctcctaagtctgacattcagatccttcctgatccagctctcccctgcaaggttcagtgtcacctcctcagagaagcctgccttaatcatcttgcaaatagctcccactaggttgcattcatttcccatctccttagctgggttgctttactctctggtacctgccatcgtattagatagtattttttaaaagtttgctttatgcctttctctctcattaacatataagcttcatgaagtcagattgtttttctctttctcttgcttcttagtgcaatcctagagcctagaatgaggccaggtacatagctgatgctcaataaatagctgttgaccaaatatctaacattcattgagtactgtctgtatactaacctcagccctaagctctccccacacatctcacgaatctccacatgaaccttatgtagggagatcttagtattatccccactttacggatgtagaagttgagactcagagacatggagaaagtatcagggatgggatttggaacctgtgtcatctgaccccacactgcctcgaatgtctgctatgtgctaggcattgtgcacagcttcggggcagattgaagtgctactctttggggaaaataaaataacaaagggaataagacaaaaatatcaaatactcttgtaccagtaccctctgcaaagtaccagatgaatactttatttgtctgcttgcttatttatgtacttacttatttacctcattctataaataatttgaggcagcttacaagatacatgtataatagaacacaaaaattgtaaataaaacaatccaaaccacaaaagtacaaaataaaatagacactaaggaggagggtgggggcagtgaattaataggcagataaagcataacatatggtcttacacacataataattttagctctaaaattcctggtggccagaaagaaaaaggaaatgtgagttacatgcctgagataaaaaaaaaaaaaaaatttctaggggaagtaagacttcttctgatgcttggctctaaacgaatttctcttgtgggattttgtaaaaggcaattattttaaagtgttttttttaaaaaaaatgctgaggccaccgttatgcgagaaaatgtgaccaggtgtcatgaatgtgtaaagcagatgaactctgagcagctctgttgaactgaagtggggatgggtgggacaggggatgggggaaccaggggtcagctcttgcttcttgctaaccactgctccaacaagatggagcctggtgagtatcaagacatgtgggtggtgggtgttggggaacaagatccaggaagtcttggatgctcactaaggagcgataaggaagacaagtcttttactcagtcagcctgtatttattaagtacctcctctgcatcatgcactctgtggatgctgagggtgcaattgcaaataagacagacacaatctctgccctcccaaagtttatagtcatgcttagtgttaggggaatgttgaacttgaagatctggtcgtgacagcagggttgggggagagatcggggaaaacttcctggaggaagtgatatttactgaagagggaagctggaggatgaatcagaattggctgaatgagagagttctaggcaggggaccagcctgtgcaaaagcctgaagacagacaggatagtcgtaggatattcaaggagctgtaatacggggtctttgaggcagcttgttgcctgtatgaccttaggcaagcccctgttttctccagacatcagtctccttatctgtacaatcaaatatggagccttatctctcccctagcttcctgccaaccacagctatgaatcagtgaaggtttgtgaagaaggtggaatatctgtgtaggtctttaaagggcatggatgacggtgcagtgccatgtagcaccccagtgttccttgtgttccttaaatgagcaggatcttcacagagccaagaataaaacaagccctcttgaaaactgtgttaactctttaagataccactgggggaccacttagtgctcggaagcaaaaatgtattaccatggcctcagggacccaaaacttaatgcagctgcctgaatttccatgctcagttcacccaggagatgaggctgactcaacactttcatccgtcttcagcttcacccataacctcaggctgcattgtgcccttgtagacatccagtggatatttattgattataatacaacactttttccagggaattttatgttaactcgtataagtttgacataaatggtattgcagatgtcaagaatgtccaagaggctagaaaaaatgaaaaagaaatattatagttacttgctcaggctccttggttttggattatcttcccacaacccctgtcattttaaaggaaaaaaaggcaagaagttgacatttaaagtgagcctactttatgccagaaactgtaacagggcctctgacgtacactatccttttgctcctcaccacggcatagcagggaatattatcaacattttaaaagacccagattgtttttttctgtccatgttggggacagcacttgttaagttccaaaagcttgatgagaggtgctgggacagtagagtaaatgatcagaaagttatcatttctacaatgtaacccattgtattagtctgttttcacactgctgtgaagaactgcctgagactgggtaatttatgcaaaaaagaggtttaattgactcacagttccacatggctggggaggcctcaggaaacttacagtcacggtggaaggggaagcaggcaagtcttacatggtggctggcaagagagagtgtgtgaagcaggagcagtcacgtataaaaccatcatatcttaagaaaactcattcactatcatgagaaaagcacaagggaaaccaccccctgtgatccaatcacctcccaccaggtccttcccttgacctgtgggaattatgggaattaaaattcaaaatgagatttgggtggggacacagagcctaaccatatcacccatctacgctattgagttccaaatgctttttcatgatccagtaacattaaagagtatagacagataaaggaaagcttcaaagctttcttgggccctgtaccctggggattctaatccagtaggtctagggtgaagccctgcaatttgtatgttttaaaaatgcgtttgtaattctaacgtgccacaaaatttgagaagccagggcttgggccaatctgtaaatcatgcagatcaggaaagtgaagtcttgaactagacctagaactcatgacttttttgccttccactctagaaccctttatacgacttcacacagttccaacattatgcacggctctatgcctgttgcatgtgttttggaggttcttgtttgaaagacccagctcattcatgggatcacagctcttaattatgtcaggttgccagggagggaggggatagtcttttctgttttcgaaataatggggaaagagaaagtaatatttatgtatcagatactgtgctaggtgctttatatcatcatttaattctcatagtagcattctaagacggttgttttctacagagaaaggggactgacctagaggtaaagtgaattgtctcagataacattttgggcaaatcatcttcttttccaggctttcatgtcttcatacacttttgtcctaccattcatctacctatccactcacccagaaaaccatcgctgttgcctgctccaggaatgagaaatatgtttcatcttaagagtgttgagaagggggccgggcccggtggctcacacctataatcccagcactttgggaggctgaggcgggtggatcacctgaggtcaggagtttgagatcatcttgatcaacatggagaaactccgtttctactaaaatacaaaaattagccaggtgtggtggcacatgcctgtaatcccagctacttgggaggctgagcaggagaatcgcttaaagccaggaggtggaggttgtggtgagccgagattgcgccgtggcactccagcctaggcaacaagagggaaactccatctcaaaaaaaaaaaaaaaaagagtgttgagaaggattctgaggctgcttctaaactcagtgggaaagtgtgattgatgagtgatgtctgttataagcacaagaatggatagaggcaatatttaatctatttacccaccatttgtgatcttccaggatgcctagggcaataacttgactctcatttatgtattccaaaaatgagaaatgcaattggaatgccaaggatgacatggagggcttggagagttagagtgggtcaccctcacgtgctgtccttgctgcccccgcagctccgccagcggtttgagctggagatcgagcggatgaagcagatgcaccagaaggaccgtgaggaccaggaggaggaactggaggatgtccgtcagtcctgccagaagcgggtacgtgagcagtgaacacagctgtgcccttggatcctggcaggtctggcatggattccctcttccttagagcgaggagtaggacagggtctgggatctggggacaagctctttctgcaatcatctgagaccttagcttcgaagtgacttcaaaggtgtaggagcggaaatgcccatcttaaatatgatcttggaacttccagaagcctctggaactgtccagcataatggctcagagatttctactaagtccccgtaatgccatgtgactgatgccaaggacttgtaaatttcaataatagaaccaattctttcttactattttctttacaagtcaaatcatttcttaacattttatccaaagtctttgtagccattccgaacagtgtgtaagaaagcaataaccccttgacatgttatcacctagaagccatcattattactattttaagtgttcttttatagctctctttcactctctgtacacacatgcagatttgcagagatatcattttcactaaatgaggccatgtggttctgaagcctgttgtctctgcagtttgtcatggcctcttttcatgtctgtaaatacagatctaacttatatgtttaatggcttaacagtttttcacccaaagcttatcctctaacttatacagtaaatcccctatcactggacattaggttgtttctagttttctgcccttataaccagtgccgagataaacattcttagagctgtattgatggatttgaatgtaggatcttcaaagtggaattgctggaaagcttcgggttaagcctcgtttaacaggttctcacatgtactctataagaccttccctcccttctcgtcccctgaatcatacctatgtacagaatacactcaattttgccttgcttgatatatagttttgttattttgtgtgtttttcaagatgggttttagcttttccagtctttattctaaaaacagatataaagagagcgccttgtatttctctccatcctaaacgaaatttctgaaacgaacttgctttctatagaagtgaccatcactcagtactttttccccctccatgggtcaggagatggaatctctcagtccctgcccatattccttcaggtgaagattgcacacatttctggtttattctaagaatgcctcaaagtatggtgtgtgccctgagccagggctccagtgagttggagatgtgacccagactctcctgaggcttttctctggatagatttataaaaggagagagtgaagtcagagaacggtgtttttctccttataacaaatactgatattgacttctcattctggtgactgctctgttcagtctatctctcacgttggcaggaaatcaatagttagtgacctgggtgggaatgctggggctgtctggggtggcagaaagagctggggtcaggagagaggacactaactcctctaaacagcaactaattgcagagtatgcacttcggattttccctgggtcttagtttgcccacccgtgaaataggatctctgatggcatgaggtggaaatggaggatggataatatatacaagagaggctggtgggggtggtctgcaaagcacagccacagtagggtgtttgctctagtggggaatgtctgtgtttgctgggtaattgctgagaaatcagagccagttgcaaattaaatgagtcgctcatagtcagatgtctgagttcaggctgctgtagcagaatattattgtctaggtggcttaaatgataacatttatttatcacagttctggaggctgggaaatctgagatcaaggtgctggcagattcagtgtctggcgagggctgtcttcctggcttgcagaccaccacctcctgtttgtacgctcatgtggtggagaaagagagtggaagacagctttctggtgtcttcaggcactcaccccaccatgaaagctctaccttcatggcctcatttaaacctaattacttccctaaggccccacctccagataccactgcactgagggttagggtttcaccatatgaattgtggagggacacatatagtttataacaccaaaaaatctcaaatgcaacttttttactgcatcattgtgtatttaataatggaggggatgcatttttgatatgttggttataatattgttcagagcctttaaaaatcaaagtgcaaaggtttgcaaatattcagcagtggccatggctgcaggagagaggcatctcttctactggggacctgggggagggggtttcacagtcaagggcaaggggttccccatcattgaccagccctccctactgttgtccagctcccaagcttttaggctcttaaattctcccacagagacactaccacccaatcactagggcagcctcatggaacaaagccacaagctctacattcctccgccttctgagggtccttgccttgtaggatgtgtctggatggagttcatttaccctgtgatgtttcttccctgtgtatccacagcttcatcagctggaaatgcagctggagcaagagtatgaagagaagcagatggtcctccatgagaagcaagatttggaaggcttgatcggaaccctctgtgaccaggtaagggggagacattggcagacattcagaggagtatctcagggacctatttgagagatgggctcatggagagaacagcctgagggataccctctcctccatcagctctgttcccaccatattcactggctcttcaaaggagaccttcaggtgcctgcaaacagcagggtttttgtaagaacccatggggaataaagagagtggggccagccaggagcaatggatgaggctgtctttgccttcagcagctgttgggatcagagtccaccagacagtccttcctttaaggggatgtatgtgaatggccactgcacacatgactgccctcctgagaacatgacttttgctagaagcagtcagccttggagccaggcaaatgtagctttaagctccagagggaccacttctgtctgcacggctttgagtgagctagttaacagctctgagcttctggagagtggagccttatggggttgtggctatcactgtacaccagggttctcgactgtccatcagtgtacaccagggtcctcaactgcatcactatgaacatttggagctggatcattccttgtggtagagggctgtcctgtacattgcgggatatcacgcagcatccctgacctctacccaccacattgcagtagcccacacctcagttgtgacgaccaaaaatttctacagacattgcccaatgtcctttggggaaaaaaaatcaacttccctcactactgagaactgttgctgtactaatgtagccagcagagctcagaggcagcttccgatttcagagttgcaaggaatgactcttccacctcctagatactctattcccttcctgtgctgctgctgcatgaaatcccaacacgggagagaaatgcctgtggcttctatgatttattttaaagtatcaaaggagtgtattttaatgtatttgcttaacatgggttcgatgtctattaattagtaatggtcttgttatcaatatccttccctaaattcattaactttattcacaaaacaatgtgggtgcacttcaggtgatcatcttgggcagccatgccttggacaaaataaatgcttattatgtattaaaaaacaaattgatttaatgagtgaattccacagcagggacacacgcggcaagagtaagagttggaagctgagggagtcaatataatcttccttcttctctgggttttctaattttccagccaaacaattgagaccattgaattcagagccattgaggtgactttccttcagcatcagggcaagagagcacagcccagtaccagattctagaatgatagaggggaatcactgcgagaaggttgcattctattcagcatagtctgagaaaacagaatagataatctagtaaagcaaggtttttatacaaattgcaaaaataaattttacatgtaaagagaaggtaagtttaaatgaataaaaagccatctttgtgttagtcaccaagttggatccttttaataaattagcacttttgatgattttaaatgtttttgttatgacctttgccaaacccatggaaaagcagaacaaataatgtaatcggtgtttatgaaccaagcactcagggttcacataaattaacattttgccatttcttattcagatgtttttaaggaaacaaaacgttttaagaacggttggtggcctctttatgtcgcttcctaatctcaatcctggctctgcttttctctttctttcctccctccccagatgaaaccattccccggggtttgaggtgtataattcccctgaatgtatatttcaacttcagccacatgcagcaatatgattctgcactttactttgtccccctctatgttatgtttttgagattagtctataatgatacatgcagttctaattaattcatttcatttctacacagcattcatttttttaaaatctcctacttctattggtgggtagttagttacttccaccctaaaaccccaaactgcagtgcatagtctcgtatctgcctcactgtgcacacgggcgagtgtctctccagggtatgtagctggaagaagaattgctggctcctgggaatgtacaatttgggaattattaaatatcgctcagattattccccaaagtgattgcagcagtttccatcgtcactagccgtgtctgaaattttacttcttcatgtccccaccaacatgtggcactgtcagacatttttaaacattttttccaggcatcgggtgctaaatggtattgcgtggccctccacagggatgctgtgcatttttcacatgttgattgtggctttttcttttcttttctttttttgagacggagtctcgctctgcctcccaggctggagtgcagtggtgtgatctgggctcactgcaagctccgcttcctgggttcatgccattttcctgcctcagcctcctgagtagctgggactacaggcgcccgccaccacgcctggctaatttttttgtgtgtatttttagtagagacacagtttcaccgtgttagccaggatggtttcgatctcgtgacctcgtgatccacccgccttggcctcccaaagtgctgggattacaggcgtgagccatcgtgcctggccgattgtggctttttcttatgtgaattgcctattcatagaagtttgtctcctttttctctattgatcattcatgatctttatacaagatgcgaatccatttttggttacgtattttgcaaatatctcctacactatggataattgtttcactttgtttataatgtccttagcttaataaaaaatatttttaatacagtcgtgttaatcaagcatgttttatggtttgcgcttttatatcttaagatactgttctttgagttcacaaaaatgtcatcatgtgtcttaaaagttctaaagtattgcttttgacatttttaggtctctaatccatctagattttattggggtgcatagtgtgaggtaggaatctatcttcctcaatatggataaactatgttttagttcataatttttttcctgcaattaccatgtatgcctgggtgtgtttatgaactcctcattgtggctcattgggtttttttttgtctatttctccaccatatggtcttcatggctgggttttgataactcgtaggacagcttaccttgactgtttttaaaattgcctgttttattgaccctttaatcttcttatttaggttctacaacaaaacctgatgtaatttttattggaattgcattgatttacaagttagttgggaacaattgactttttttatattgaactattatattattgcatatgccctctccatttatttgtggctttcagtaatgttttattatatttttctatacagatcttggacttttttgttagatttattttcaagaaacttgtagtttctatggctattatgaatagaatatttttctgtattctatctatatttcaactagttattgtggcatatgggaataccattgattatcatgcattaatcttgtatctagcaaacttcctgaacgtttattatctttcatacttcatctgtaggcttttttgtattttctgccttgacaatcttatcatttgaaaataagaatagttttgactcttttttttttttttttttttttttttttgagatggagtctcgctctgtcgcccaggatgaagtgcagcggcgcgatctcagctcactgcaagctccacctcctgggttcacgctattctcctgcctcagcctcccgagtaactgggactacaggcgcctgccaccatgcctggctaatttttttgtatttttcatagagatggggtttcactgtgttagccaggatggtctctgtctcctgacctcgtgatccacccacctcggcctcccaaagtgctgggattacaggcatgaaacaccgcgcccggccagttttgactcttgaccatggattggggcaacaaagatctcaacaaatttaaaaaaaaaaatgttatactttctacttcttgtttctttttcttaccttatttcatttgcctccagtataagattgaatggtagagaaagatatttgacatccttttcttgttcctgaccttaataggagtgcttgtaaagttttgtgatacacatatttgcagtgtctttgataattacagtgatggattgcttagtgacagggatactttctgagagatgcatcattagacaatttcatcattgtgggaacatcctagagtgcactcacacaaacctaaacgggatagccttctacatgcctaagctatctgatatagtctattgctcctgggctacagacctgtacagcatgttactgtactgaatttgggaggcaattgtgacacagtggtaagtatttgtgtacctaaacatatctcaacatagaaaaggtacagcaaaagtatggtattataagcttatgggaccaccgttgtatatacaatccatcattgatggaaatgtaatgtggcacgtgactgtaactttaataaggttaaatcagtcttgtatttgtaattttctaatatcttaaaaaaagatgttttattattgaatattatatgttttttctgcaattgttgataatctgatgacttgtctcaatctatcaatgtagtatattttagatacttaaggtatcctgatatatttcccagataaacctttcttagtcatatgttttcaatacacagctctttcggattgctaacagtttatttaggatttttgaaaccaggcacataagtaagattgttttataatttttttctcttagactgtctttgtcaagtgttgtactaatctcataaaatgaattcacaactatttctgagacaattttttgtaaaatttggatcatgcagttcttgcagattagatacaatttgcttgtaaccctatttgattactgtgtcaaaatgctgtaatcataattgaacacaaattcaggtattattcttttccttattgagtgaactttggtaactaatgtttctagacatttattatttcatctaatttttcaaataggttgacataaaaaatattcatggtattttctcgttatttaaaaaattctactgtatcagattattttctttttaatcataataatgtttacttttgagttattttgtggttgatgatgattagtcttgttagagttttgtctgtaatcccttcaaataacctgcttttgttttattgtttctttgttgtgtatttaatagtgtctgaccttatgtttgtttctttttccttcttttttccattggtttagatttttgttcttggtcttcagttttagtattaaaatgtttaactcaccttcaatattttttatcccacttaaactgttttctttaagataatacatttaagataatacatttacctggaattgctgttttagtgccatctactaagtgtcttgttgtatcttttgttctttttttcttttaacctgtaagttatctagaacttgagtttcaagtttattaacatttaggatgatttggagtaactttctattgttaatttttaatttaatggcatttaggacagataacatggtagaatgcataacatcttttctttgaaattgttgagatctctttgttgctctagttattggtagagtttaataaaggattgtgtgtggctgggcacagtggctcacgcctgtaatcccagcactttgggaggccaaggtgggcagatcatttgaggtcaggagttcgagaccagcctgaccaacatggtgaaaccctgtctctgctaaaaatataaaaattggccgggtgttgtggcgggcacctgtaatcccagctgctcagggggctgaggcatgagaatcactagaacccaggaggcagaggttgtagtgagccgagattgcgccactgcactccagcctgggtgacagagcgagaccttgtctcaaaaacaaaaaacaaaacaaacaaagaaacaaaaataaactactgagtagaaaataatgtaactgtttatgaggcacagggttcaatacatggcaaatgaatcaaccttgttaaatttttatttcaacattacatacgaatataaaagcataaaccataaaggaaaagttttaaaatacatgattatgtattttttaaaactacctcctgttaactttggttttgagttcttaatctgtttctaagagagtcctgttatatccttaccatgagaatggttataccaaagtttgttaacagttctgtcatagtttctctttatgtattttatggttatatatttaggtgcatctaagttttgtattgctttattttcttgaagatcattgcttcgattcttacttggtgtctttctttctccatgaataagttttgccttattttatttcgcttgatttattttagtcagtttacctgcaagactttttctatttcattttaaagctttgtaggggtgtgtgtgtgtgtgtgtgtgtgtgtgtgtgtgtgtatgcatgttcatgtgttttctttaaacagctggataattttaatgcaatattttagtctctagcttttcatataaaaatttaatttatttacatttgttataatgactgatatatttgaaactattttgtgttttgttagtttcttgtccctttacattgctctccctctattgctttcctacttttggatagattgatgttttctatgttctcttttgacctattgattcagaagctataaactctatttctgttcttttggtggttactcatacatttccagatatatgcttaatcataattttttactaacattaattttcacagtaatgctgtgggatagatattattatttccttcatataaatgaaagaagtgaggctcggaaaagtaaagtaaagcaacttgcccaggattgcatagcaagttagtaccctaggcggattctaaatgaggtctatattatttgaatatctgtcattttaaaaacctattatgattctgcttaaaagcgataaggtccacttagctagaaccatatttttgtgcaccatctttttttcatagtgttctcaggcagccagttctgccattaatttgtgaagccctcagcaacacgcattctgtctccaagcctcaatttccccatctgtaaagtggtttggttatccctaacggcacttctagaccatattttaatagtgtttggagattcctttgacaatggacatttgacaagctccccaaacaatttgcctttatgataaatggtgaaccaactaaggttggaatatagttactcacaacaacactaaacatcatgtagatttattagttaattattcaccatctttatcaaagtttgaatctttgtgctttaaaagggaaactcgcagaatgacatttatttcccattaacctaatgagtgatattttttgccctcctctctgtagcaatttgttataaatgggaggatgactggtctgagattttcttgtgaattctgtttgcagtgcttcctctggaaaggagttagtgccagcattttcagggcctttcaggcagtgaagatcgtagaatctgagccatctctactgcatggtcagtgtcaacatcagggaatgtccctgatgctaactcgccccacaggagaattaaaggcactttaggatatatgcaaaacaaaaacagacacaaatataagaaatgtgcaaagcccactgcctaagcatactcatgagtctgggttctagagtaagtaaatctgagtttatgaagcagctccactaggcactgtggtgcagtagttacagacttacatcctaatgctgagctgtctggattcagatctctgcacagccacttagtagcaatatgacattgggcagatcatttgctctttcatatcagttgttcctccatgtaagagccctggataacctctttcactttgtaacctgcccctcaactcggggttttataccctcatggcaaccaccccgaaatgcatagcccagattatttcttgcctctccgcctttgctcattaagtgctttctacctaaaatgctcttcctccacctcccctagctaggagtagctacctcctacttcccaattccatcccagcctgagctgggtaatgctcttctgtgcccccataatatatattttttcagaattaaagactaaaacacacctatctaatgttatattttactaaaattaccactttccagccagaaaagctggattcatattccaactctgccacttactagctgtgtgatctgaggcaaattacttcatctttgcatacttcagtttcattatctgtaaaatgggaatcataatactatacacctcattgattcatcatgatgactaaatgcatcaatagctataaagtgtttagaatagtatatgacacttaaaactgtctataaatgtaagctattactacatttgtaaaggcaataataataaggtctatttaaggagattgtcacaggagttaaatgcaataacgtgacaaagagcctggcacaatgcccagcccttaactcagttcagcaggtgagattgtgtgtgtgtatgtgtgtgtgtgtgtgtgtgtgtgtgtgtgtataatagaacagcattttgaacctaccaaaacaatacatttcagatataaagaccgtattctgagaaccaactcgtttttcaaagaactcaaaaccagcagtagagaaatagaaatacaaaatctagaggaacacattcgaggtcttcagacaatactcataatcctttatatttgcaaagcactcaacagcttacaaagtgctttggaatccattatcacatctgatccttgtcttatctcaacacgaaggatagggtgttttttttaacctctctttttgtggatgagaaaactcaggttcagagatgtggcgtgactcagccactgctccatcatcagcaaatggtgagccagggtttaaagcctagatctgctcattctcaaccccatgttttttctagaatattccaggacattctgagcatcccaggaaatggttagcatttcatgtggagacacagatttccaggtgtgtaaaaaccacatcccagtgttgaggcatctgcaccctgttttccttgaaactccccatctgatggacaggcccgtattgtatcgtctggtctcctgaagagtccaagaagggagttgttagtttctttcagagatgttaacacgttgtcttttaagtcagcactatttctagagaggtgaccagctgtcgaaatttcatgtagggccctggtgtaattctgcacctcttctgttttggcttaacctgtactttttggccactgaaggctgtcaaggagtctaaggtcacactcctggtgcccagtccaggatgcggcttctttgggactcccttgacagctgtccctggcaaattcaagattctgggggaaggaatgtactcacctctgggtaaggttcctctgcagaaaatgatctcatttgtttgtcctccaactggaaaagaggaccaaaggacagaaaggattgacttcaaaaggagcacatttacaatttactgaggtgtaacacaaatacagagtactccgtatcccacgtgtacagctcagtgaattttcataaactcataaaacaacacccagatcaataacattaataactctccagaagtccagaggctctgtccagtccctgcccacccaggactgtcctaactgctgtcagcagaacctggccagcagcagagggattcacctggcacatgaggctcttacaagatgaggtgaggtcacactgatgacttgcgtgcaagagatgggatgacagagtggctttggatccatacgggctatgatagcagcaatgatagtaactcatatttcttgtacatttattctgtgtcaagcattaggctaggcatgtatttaattttcacagcagcccaatgtggttggtgccaatcccatttctcagttgaggaaactgaggctcggagaggagaatggtcttgtccaaggtcacacggtgtgagtggcagaggcaggatttaaaccagggaacctgattccggaaaacttagaccctggccactgctttgccacctaagctcatgggtctccctttggctttcagattggccatcgggactttgatgtggagaagcgacttcggagagacctcaggaggacacatgcactgttgtcagacgtgcagctccttctgggcaccatggaggatggcaagacatcagtcagcaaggaggagctggagaaagtgcacagccaggtgggtgtcacgggatccccttgagaatcaggctggggaggatgctacgacctgcagagaattgctgtccctcccaggtatgagcggaaccatggtgccaacctccaactttcacagatgtgcagggagatggggggcatttcagggctgtgagggtcatgtggagtgtaggtgaggaggaggggtctaagaaggagtcctgttccctttttcagagatgaggcagaattcttctgtctggaaggcttgggcagatcagcactggccagaatggctgagtgcagtgtgcctgttgtgtgtgtgtgtgtgtgtgtgtgtgtgtgtgtgtgtgtatgtgtatgtgtgtatgcgtgtatgcgtgtgtgtgtggtgactgccaggactaggtatgagccaaatagcaatagtgtgtgtgtgtgtgtgtgtgtgtgtgtgtgtgtgtgtgtggtgactgccaggactaggtatgagccaaatagcaatagtgcaatagtgccagtcatgcaaaaccaatgcttaacaatagcaacagttatacaaacgttggcagtttgactgcctattagtatgctaatgatattgatcaaggcatgatgttgaccactggctgctaccagctggagccctcactaggtactgggtcctctgtatctctgcacatggtgctgcatggtgttctcaggattgctgagtgaggtgagatcatcaacttcatttcacaagtgcaggtgatcgggtggcagaaaggtacgatgacccacccaaagtcacacagcttgaaagcggcagagccaggatttgaacccaggtcttcaggctctaccatccttgggccgactcaaaggaggacaggaggagcggcaggtctgagggtggtagggaggtgaggccggagcagagactggggacctaaggagatgtgatgagtgtgggcggttgcggtggcagactgtggcccagggcagctagtgttgagaagtgtgaatggatcccacagggtggtgcaagccttgcggagagatgtcccaaagctgaatgatgtagcaggaactcaggatttgctaccggtccccatggggagctgaagacacctggggaggctcagagctctgttggaagtgttgtgtccatgcaattgatgttaccttccctcggataagtcattcttgctaagcccagatgccttcgccacctgccttcttggagggttactgtcccttcctccagtcagaggctgagctgggcctgggacccatgtttcctgactccaaacccagtgcccttctctcttccttctggagacacagcccatgatgaccaacaggtccccaggaagacagcaaaaggcagcagactatagcgccaagggttggaaacagcgatcccacagcttcggctgcttccagtctctggtgtcagtttctatctgtaaaacaaaacatttcagttagagcttattcgcttaactagaagacctcaaccaaaacaaaacaaaacaaaaacctaaatttagacttgatttgaatttcaccagtctctcccatttcctctcccgggatccaacccgggaccacactctgcattttgctgtcatacctgcccagtctcctctggtctgggacagtttctcaggctgaccttgctttttatgaccctgacagttttgaggagcactggacaggtatcctatggcatgtcttctaatctgggtttgatggttttctcatgaatagagcgagtttatgtgctattggaaagaatatggcagaagcaaacttgttaaaccagaagacactgggagggcccttccatcttgaaaattctgcgactcttagccatctcctttatcaaatcattctcttctagggtgacccaccatcctgacttgtctgagactttcttagttttagcactgccagtcctgggtcctgggcaagccaggatggctggtcattctatcctcttcatggccatgtcaggaagccagtatcacctgtgcttgaacgcattgccctgcttaatcctcatgatacccctaggggaggggaggtggcattgtgcccattttacagatgagaaaatgttgtccagaggtggcaagtggtgtgtccaaagtaacacagcaggtaagtggcagagtcggggatttgaataccaagtttgtgattctaagtgcagaattgagagatgcttttgactcacattgcgtcttcctgtctgcttggctgaccaggtgggtacggaaccttgaggcacctggcttgcttctaggtaggcagagttgctgtgtgattgcccagccaggggccaggcattttgagttgagcaactcccttggcagaaggccacatacctgcccattttccatcaaaatgtccccagtgccacagcacccaagcttcccttcccccaacaggtggatgtttttgaaaagaaaccacacagagattttgttactttttcttttttttttattaagtattcatgagaattctccctctgcagggttaaaatgcatgttcttgggaaaaagtggtatttaatgaaggcgctttgagctgaatcaaagagcctcattcttctgaaagtccttcttcctagtctctgcatccggctcctatcaaaggaaatccacagctttggcttttcgttgctgttgtcatggaaatcgttataaggatgggatcgcgtggaccagaggtcagggtacagttgctttggctcccagcgcacgtgtcccagatgccagagtcagagctaatcaaataaagcagtgatgacattgggcattgctgcatctcctctccaatgtacagtatttgtcctttgcctgaaggctccagggacataggtagggaaagcagacaggaggatgaaggaagagggagctaactttgctgctggctgctacttaagtgctgagcatggtgctgaacaatttcattcattcaatatttatgcagtacctactgtgtgtcaggcagtgtgctggatataagcaccatggatagtgagacagcggtggtacccaccgtcatagaatttacatctgatggaaaagaagacaaacaatgatacgaataaatagaatcatcccacaccttaatttgaatgagaaaggaaataaatagggtgctaagatagagaactgcaggggcgtcctgtttagcttgggtggtcagctaaaataccctgggagaaggagaaataggcagggaccagaacatacggggcctggaagtttggattttatcccgggggtggtgagaagccattgggaggttgtgagcgaagcgtgacagaatctgattcacgttttagaggattgtacttctgcatggagattggattgtggagggtatgagggaatatccttagaaggctaatgcacccttctaggccagaggaaatggtcacctgggttgggggagtattgatagagatggcaagaagggacaaacttggagctgatttggaattgatgggatgtgcagatgaggtttggttagcaacacttaagtgtgttatttcagaaaatccttgccataaccctaggaggtggatattcctatttttaacccattttactaatgaagaggcagtctctgagaggttgagcaatttacctaagggcacacagcaatacatgtcctatacccttacaacttggtttgaccaatacgggtcctattaacttctattgtcaggcacttactatgtaccagacttttccttagtgtcttggggtttctcaaatttggctgcacatcagagaagttaaacaccattttaaaatcacagacttctggattctgccccctcccccaccccattttaaaaaaatcaagttttggttggaattcaggatctgcatttttaaacaaccacatgaaggggttctggggggaaccataggctttatttatccctcagaacaccctttcgagttcagtggtagcatgtatattttgcagatgaggaaactgtcactgaggttatattagtgtgacagatcttatttccccctattttaaaattagttaatttttgagtagagaaaactggatccagcacttgctaattcatgacttttgacaagtgtcccgacctctctgagccctttttctaaagcgaagcatcatcatcatcatcacatgatggcccaggggctgaggagggaaaggcaatgaagccttcagaaacttgagcaggtggctgggcacagtggctcacacctgtaatcccagcactttgggaggctgaggcgggtggatcacctggggtcaggagtttgagaccagcctggttaacatggtgaaaccctgtctctactaaaaatacaaaaattagcccggtgtggtggtgcatgactgtaatcccagctactcaggaggctgaggcaggagaatcacttgaacccgggaggtagaggttgtggtgaactgagatcgcgccattgcactccagcatgggcaacagagcaagactctgtcaaaaaaaaaaaaaaaaaaaaaggccaggtgcggtgactcacacctgtaatcccagcactttgggaggccgaggagggtggatcacaaggtcaggagatcgagaccaaactggctaacatggtgaaaccctgtctctactaaaaatataaaaaattagccagatgcagtgacaggagcctgtagttccagctactaggaaggctgaggcaggagaatggcatgaacctaggaggtggagcttgcagtgagccgagattgtgccactgcactccagcctggacgatggagcaagactgcgtctcaaaaagaaaagaaaaaaaaagaaattagaacatgttctgcgaccttcacattcgctcactgtgatgacagaaaacctagagaaaggtgtttttttttttaagacagtgtcactgtgtcatccaggctggagtgtagtggccctatctctggctcactgcaaactctgcctcccaggttcaagtgattctcctgtctcagccttccgagtagctgggatcacaggcatccgccaccatgccctgctaatttttgtatttttagtagagatggggtttcaccatcttggccaggttttactgagttggtctctaactcctggcctcaagtgatccacccacctcagcctcccaaagtgctgggattacaggtgtgagtcaccacacctggccgaaagttttgttgtataaaggacatgtaggagggaatgtgttcgaatgcacatgttagaactgtgttcactctgcaaatatggatatgatctccactctgggatgaatttgaggccaagctacagggataaagaggaaatgtcaaggtctctgcccttaaggggctcctagtcctagaagcaggctataacaagcagagtgataaactcttttgttgtgggaaatcagggaccccaaatggagggaccagctgaagccatggcagaagaacgtggattgtaaagattccatggacatttattagttccccaaattaatacttttataatttcttatgcctgtctttattgcagtctctaaacataaattgtaaagatttcatggacacttaacacttccccagtcagtacccttgtgatttcctatgcctgtctttactttaatctcttaatcctgtcagctgaggaggatgtatatcgcctcaggaccctgtaataattgcattaactgcacaaattgtacagcatgtgtgcttgagcaatatgaaatgtgggcaccttgaaaaaagaacaggataacagcaattgttcagggaataagagagataaccttaaactctgactgccggtgagccgggcggaacagagccatatttctcttctttcaaaagcaaatgggagaaatatcgctgaattctttttctcagcatggaacatccctgggaaagagaatacgtgcctggaggtataggcttataaacagcccccctaggtgcgcctgtctcttatggtcgagactgcaggggtgaaagagactccagtctcccatagctctcccaggcttattaggaagaggaaattcccgcctaataaattttggtcagaccggttgatctcaaaaccctgtctcctgataagatgttatcaatgacaatggtgcctgaaacttcattagcaattttaatttcgcctcggtcctgtggtcctgtgatcttgccctgcctccacttgccttgttgtattctattaccttgtaaagtacttgacatctgtgacccacacctattcgcgtactccctccccttttgaaactccctaataaaaacttgctggtttttgtggcttgtggggcatcacggaacctaccgacgtgtgatgtctcccccggacacccagcttttaaaatttctctcttttgtactctgtccctttatttctcaagctggctgactcttaaggaaaatagaaaagaacctacgtgaatatcggggcagattccccgatactctttattggaggactatttggattagctaaagaggaggcccttaattttgctttgagagaggagctggtagctttggttatctctttaaagatggaaatgaattgctggttagataaggtacatgtatgtagacattctaggaggaaacaccagtgcgtaaaagggcagaggcacacagagacagaaagcatattcagttcggcatggtattgctggagtataaggtatccaggggttaaaagggcagagaggatagtgctggtaatggaggctggagccagttcatgaatggtttagtgagcttggctgaggagcttcagttttatcccaaagccacagggagccatagaaagctactgagcagaggaaggtgtggccagaacggcttgtaaaaattggcaggattccaggtgcaatgtctcacacctgtaatcctagcactttgggagacagagggaggtctttttctctgagcccaggagtttgagaccagcctgggcaacatagtaagacccggcctcaaaaaaaaaaaaaaaaaaaaaaggcaagtccccagctaaatcacaggagccctgatgtgcagaatatcaggctctaccagcagcaacagtttcccttagctacagcatcttctctccagatgggcaggcaccccctctgttcattgcccctgcatctagaaccctaagataatcatttggttcttttctcccagtttccctccactgggagctttggatacatctcagtgaacacctgaggcttaaaaccctcctgatacaatacagaagactcctgaaagccatatataggattcaaatcctgccaatgacacttaccttgctgcagatcttgggcaagtcagctgccttgcatagagtctttcttgcctaataagggggtacgataatctcagctgattgggctgatataaagaacactggaccatggatttgaaaggagtcattaaattgaaaaccctaagacagtgatctcctggccaggcatggtggctcatgcctgtaatcccagcactttgggaggccaaggcgggcgggtcacctgaggtcaggagttcaagaccagcctgaccaaaatggagaaaccccttctctactaaaaatacaaaaattagctgggcatgatggcgcatgcctgtaatcccagctactcaggaggctgaggcaggagaatcgcttgaacctgggaggcagaggttgtggtgagccaagatcacaccattacactccagcctgggcaacaagagcgaaactgtctcaaaaaaaaaaaaaaaaagacagtgatctcaaaatataacataacatccccaattggctctctcctttcattcaccggtgtcagctattggaagattttagtttctgagcacatgattttataagacctcttggaacaggtaggcagacaaggtgtggggttgatctaatgacacctgttttttttcagagctgatttctaattaattctcatggaatgtttccactggaaacaaactaatctggagacagaagcagttccaacaaccaagatatataattgagataatcgctgtgcacaaataacatctgtgagcagcagatgctaacacctggctccaaggagaaagtcggagatgatgtctgctccagggcagcagttgctttttctctccccctatttgattcatgcttctgacctttgtctcttccacagaggcaatatgttacttgctttctgttagatagagaaggatttgcactgaactctttagtcgtttacttaattcatgctgggggctgtattcacctcttccttctgagaacaaagctgccaccaagtcattgtaccctctaaatagctctgaaatgcatcccccgtctctctctgcttgtattacagtccacctgaatatctagtacttggatttctctcaagttggctggcctctggtcttgtctgagcaatctttgtaccgtctgatctttggagagagaattttaaaatttaaacgcaaagtcggttctttgtgtgttcaagatccattggtagtttcacattgccttcagcctaaagtccaggtttcttcccttgacctacacggatgcatattttggcacctaccctcctgtcacccctcacccgaagcttaggatggcttggtgtcctctgcacctgccctcacctcttcacctttgcccaagcaatgcccttggctgggttcttgcttctttcactgatccctctttgcctgataagcatctaagcattctgtgaaattgactttgggtgtcctctcttggagccctcttggtcctccatgggctgggtgagggtgccgcctctccttccccacaatctgttgggcctgcccctgagttagtacttgtcactccctgtaattattcctttgtttccatcgttttttttctaaacccttaaaggcagggactggggtgagtaaacatagtaaaagacttagccaaagtcacaaaggtaattaataaaaatcccagcctgggtttgaactgaaggaatccgactcaggtacctgggaatttaacctctccccgccatgccaccaatgcctcctgttggtcctctgctgtctcggggctattacatcctttttaatttttttttttattttgaggcaaggtcttgccctgtcatccaggctggagtgcagtggtgcaatcgcggtttactacagcctcaacctcaagcagaatacaggcatgcaccaccacacctggctaattgttctgtatttttgctagagacaaagtttctctgtgtcgcccaggctggtcttgaactcctgggctcaagtgatccacccgccttggcgtcccaaagtgcagggactacaggccacatcttccctggacaccctgagtgctcctgtaggtccttccacttgggaattctgggtcagctccggtgtttactcaggtggagccacaaagccttgtgcgacttatacactgtgagctcccagcagtggtttgttaatagcccgaggctctctgttagtgcttagaagactaataaccctggattcatgctcagtgcccttaattgggacatttatcaccgtgtgtcatccatgcttccatgagacattggaaatagttagtaagcactgggaagatgaccctgatgggagtcttttgtgtgtgggcacctggggaacatttttccccagccaggaactatggaacaggtggcttcctgcgatgttttatttgaagagccttttttaaaacgattatgttggagtgaatttattcaatgttaacataacctcctgtcggagaagataaagacagaattgtaattggttaaaaacatggttatcacaggcctgttcaccccacaaatgttgacacattcaatgctatgatgaatgaagtgggaagaggctggtttcattataggcaagaaggcggggacatctccccaaaaggacctgttaccatttagtcatggaggggcctgtcaaggtcgtgataactattctacagcaacgatattgacggggaacattgattctttacactgtgctagtcatggtgccaaatatatcaacgtcatgacctgattatatcccccaaacccacttgagtgcagtgaattctgcaatggcaggagccttttctgttttgaaccagtgtgtgggagtgtgactgtatacagcaagtgctcagtgaatgagtggggagagaccggacaggtggtggccagactccagaggagaggagacagctagtattatgccttttctttttttttcttttttctttttttttttttttttttgagacagggtcttgctctgtcaccaaggctagagtgcagtggctcaatcatggctcactgcagcctcaacatttcaggctcaagcaatcctcccacctcagcctcccaagtagctggcatgtgccaccatgccctgctaatttttttttttttttggtagagatgaagtttcaccatcatgtccagctaatttttgttgttgtttgtttgtttttttgtagagatgaggtttcaccatgttgcccaggctggtctgaaactcctgggctcaagcgatcctccagcctcaacctcccaaagtgctgggattacaggcttgagccaacacgcccagcctatgcccattttatacaggaggaggctctgcgtagaggcaaattgctcaaagtcacagagatggatggaactgagatttaagaaaatatattttgaaagaatttaaaacttacagagaagttgcaagaatagttcaaagggcttatttaagtttttcacccagattcatcaacttttaatatttttccacatttgcgatctggttctctctataaattttctgaattatctaaaagcaagttaaagacatggtgcccctgtatcctaatcaaaatcacaaaatttaatattgataaaaatccttccttccttctttcttccctttctttctttccttctttctcttttcttttcttttcttttttcttttctttcttttttttttctttgagacacagttttgctcttgtcgcccaggctggagtgcagtggcatgatctcagctcaccacaatctctgcctcctgggttcaagcgattccgctgtctcagcctcccaagtagctgggattataggcatgcgtcaccatgcccggctaattttttgtatttttagtagagacgggatttctccacgttggtcaggctggtctcaaactcccgacctcaggtgatctgtccacctcggcctcccaaagtgctgggattacaggtgtgagccactgcgccctgcctaaaaatattttctaatccaggagttggcaaactagggcccaaaagccaagtccagccaactgcatgtttctttgtggtttttgtttgtttattttattatagctggtgagcaaagaatttttttttttgtttttaaatggttacatttaaggtggttatgtaagtacccacatatatacttgattttgcctcttgacctgccaagcctaaaataattattatctgacccctgattttatctgctgtctttttaaattttgccaattaccccccagtgtccgttatagcaatttatctcccaatttaggatccaacttggaaagtaaaactgcttccattattttcatggtgtcatagttcctcagtctgtctttttttatgatactgacattttttggagagttcaggccagttgcattgtagaatgttcctcaattttgggtgaactggaatgtgaacccctatttctttccaatttcagagccatttttatttatgcaggtctgagattcccaggacaaaggacttttaaaaccagaaagtcccagaccaaaagggatgagcttgtcatcctagcaccagtgtctcaagcactgagtaatcctggggaagataaaatctccttaccctggccccaccctccacctggcctttgcagtaaagccagttctcaaaagccaactggtggttttagcagaaagggtgatgaaccaaatgccagtgtgagaacctgtccccttccacacaggccttttgtcttctgtcttcccatgtttctcgttagagaaattctcaccatccacatgtgctggccttgtatcttgccttttttccctctatttatgcatgtgagctatattgatattattgcgtgtgttttaggcaattaaagtaatggcaaaaagtaatggcattaaattaatggcaaaaactgcagttacttttgcaccaacctaataattggtttattgttgttgcggttgtatgtgactaccacaatttatcttatccatgttgctgtttatggatatgtgggttttgtctaggttttggttatgaatagagccagtatgaacatttttttgcacattattttatgggaggggagcaaatgtatgcatttctgtagggtgcataactagaagtgtggtatctctgggtcatagtacacatggtttttgtctttagcagatactacaaaataaatttccaaggtacctgtagacatttacattcccatcaacagaacatgaaagtcctactggcttcctgtcatggctggcagttggtattattatcagttgttggcattttagccattccgagggaaggagaatattttttattctattttgcacttctctgatgttcaccttttcaaagtatatcatccatttcgatatttatttttacctgtccaaggcatatgcttatttttctgttgggttgtttgtatttttcttagtgatttgtgggatactttgatagaagctctttgctacatatgtctattgccattattttctctcactttagggttgaccattacattttcttggtggtgtctttttatgaagagaaattcttgattttgatgtaatctaatgggtcagtgttaaacatcttagaatccaaattttaaatcagttggtcaggcagagggtgttctgtttagctggatattctggtgagttgggagtggtgcaggatgatggaaagtctacctccatggccaagactctgtgaacccccagaatttgaggcaggtctcagttaatttagaaagtttatttctccaaggttgaggacgtgcgcctgtgacagcctcaggaagtcctgacgaagtgcccaaggtggtcggggcacagcttggttttatacattttagggagacatgagacatcaatcaatatgtgtaagaagtacagtggttttgtccagaaaggcagggacggctcaaagctgggagggggcttccaggtcacaggtaggtgagagaaaaatggttgcattcttttgagtttctgataagcctttccaaaggaggcagtcagaatatgcatctatctcagtgagcagagggatgactttgaatagaatgagggcagatttgccctgagcagttcccagcttgaattttctgtctagcttagtgattcgggggctcaagatattttcctttcactactcgtggttccgtccctcagtgctcaatcagtttctgctaggatttgaattacgctggtggtttccaggctcgtgtgggtgtgtgcacacacgcggtgtgttttctttttagcaaaataatccacttattaaagagaaatctcattaaaatgccctctgccctgaccattaatagtgtaactgaaaattgggttagttgctggccaccgcatgtagagtccaattaacaagaaccaggcctggtacaggaaaagtgagttcatttctgaagctagcttgggagaagggcacaaaacatcctactttaaatgtgccgctttgcctttggagcaaaaagcagacacttccataaggtcaggaggagagtgagcaagggaggggggtctccctgctaccaggtagttacctagtgggcagttgagttggcacctttctgggcaagagtaagttgtaaaagtggccgagtggtcatgccttaggcatgccctcctgaggcaaccccctggagggggtactttcctggggacatgctttgatttccaaatcaattgtctgctctggaggagaaattcatcttggagcacatagatgaacttgctctataggaaacattgggtgagggggaggtgagaggttattttgcatttcaaaaagggctaagtaggaagtagagggaaaggggaaaggagaaaagaagagaaaaaaaaaaaccctgtgtcttagaaaaatgggggtacttggttataattgggcttcccttgtttctcccagagtaccctccttctggctctgaagaaaggtaccagctcgggtatgtggggtctggtgaataaggctgtggtcaccctccctgtccaggtcatttcctcctacagagggggatcctgcccacaggtcccaccccttgtccttcctgtggacactgtgggtatctgggttagagacctatgcatggaggatgggggagcactcctggttgcgggcttcttcccaaggatgcatgcagtgcagacaggctacagagtcaggcagtcctggctcaccctgcgggttcactgatgctgctgagctcacgtgtctgcctcagtctctcagtacacgacatgtgtcgagttcatactatgtcaggacccagagttgaacaagagccaggtgaccctccaggagcccagtgtccagtggggagacagacgtggaggcacaagacctggtgctgtttaggggagcaaaggggtgctggaatataataaaagagggatgtaaatgagacggggatcggggagggccttttttggatgttttatcctgcttttctatttttctttctctctttggagcatcagtgtgatccagattcatcatcaccagagaggaagtcaggatagaagcttttgaagtctgttcagtggtggaggattcaagcagtccttagatcctaaaatacaaaaaattaggaggactcttgaaccctcaaagaaatagacttaagacaagtgaaaggaggcctgctttactcagcaggtggtgaacatattccacaggacttacaggaaaaagctgtggacttaaaagagacctcggttcagattctgccaccttcactattagctgtgtgacattgatgagttaactaacctgtctgtgcctcagtttcctcatctgaaactgaaaacagctacttcctagaaatgttacatgttataaattaacatgtcttaatcagctcaggctgccataaaaaaataccgtaaattaaactaggtagcttcagtaacagacatttatttattatagttctggaggctggaagtctgagatcagggtaccagcatgcctgggttctgctgtgggctctcttcctggcctacagacagacaaatgccttctctctgtgtcctcacatggtagagaggaaggaactttttggtgtttcttcttctaagggcacgaatctcatcatggaggccccaccctcatgacctgatctaaaccttattacctccccaaagcctcatctcctaataccatcacattagggggtggcttcaacatacacatttctaggggacagaattctgtctctggcaatgtggtaaacacttgatactaagtagttgtgattatcctactactaataataatatttattattactttgaagaagatagaaaaataaatattcaggaagatttttttttttgagacagaatcttgctctgtcacccaggcgggagtgcagtgagtggcgtgatcttggctcactgcagcctctgcttcctgggttcaagcagttctcccatctcagcctcccgaatagctgggattaatgggtgtgcaccaccatgcccggctaacttttgtattttttgtagaggtgggtcttaccatgttgcccaggctgatctcaaactcttggcctcaaccgattcgtttgcctcggcctcccaaagatctgggattacagctgtaagccaccatgcccagcagggaagtgttttgatacattgataagtgatggtctggagcagaatgtcatgaaaattatggaatattcaatatatacccaaatagtttaagttaaaaggcaccaagagtagccaccacactgtcttaagatattctcccccatggccactgtcatcagacttctgggctgcacagaccattggtggacctggcctgacattctttttttttttttttttgagatggagtttcactcttgttgcccaggctggagtgcaatggcgccatctcagctcaccacaacctctgcctcccaggttcaagcgattctcctgcctcagcctcccgagtagctgggattacaggcatgcaccaccgcgcctggctgattttgtatttttagtagagatggggtttctccatgttggtcaggttggtcttgaactcctgacctcaggtgatctgcatgcctcggccttccaaaatgctgggattacaggtgtgagccaccgctcccggccgacattcttaatatgtttgcatttaacaattttgtttgatgttagggctgtctctagtttgatctgtgggtgattcccttcagggaaagccttaatgttgaaggttggttctttcaagtaccctgatgggatgtcaaggcctgggatgtgttgagaatagccttccaaagacaccatttcttaaccagaatgctttccctgtggtgtttgtgatgcactatttttaaatcccctcagttgttcaaccagacccagaaatccaggttctaaccattctgcccaaagactggaatttttcctctccacacctcattccatatgtctagtcaactcatctagtagcttaacaaatcctagcaaacatttcacctaggtatttaaagcaggcagatggcttcgcatagagaagtaatgctattcaacagtttgtagttgatgtatatgtgataggaatctcaattggcctcacactgaatgaaacagaggtgggtgaggggagagaatgcctagatttagctcaggaacagagactagtgtgtagaggagtctttggggtggcccaggaagggcatgggtttggagtctcaaccactagcacacaagtctgaccttgggcaaatcacttcttcctgggctgcagttttctcatttgtgaaataatgaaggctgactgcttccttgcagggctgttgtgggctatagtgataatgaattttaagtggccacgcagtgcgtaatgtagtgagtgttgaagaaatctccttccctctttccccctcgatgagtaatcgggaaagggaaatattgatcctcctatgggtaaggatccatacacagaacaggtaaacagtaaataattgttactctgtcacagggttttgggtggaaccactttgatccaacttttttggtagattagcatcaattaacactatggaagtgtttggttttgcttttttaagagatgggattgcccaagctggagtgcagtggtgtgatcatagctcacagcagcctttcattcctgggctcaaggaatcttcctgtctcaccctcctgggtagctgggactacaggcgctccaccatgcccagctaattttttgctctttatagagatgaggtctagctatggtgcctaggctggtctggaactcgtggcctcaagtgatgctcccacctcggcctcacaacatgctaggattacaggcataagccaccatgcctgacagatagcaatgtcttttgagtgtttattctgtggctaacatcatgtatgcattacctcctttaattcactcatttgtatctgggttttgggtggtaacccagttcaaattggcttgcatagaaaaagggaagttattggccaaaatatctgaaaagttctgaggctaggactgccttcaggtttggctagatctaggtaccccaatcatgtcatcaagattatgtctctgccacctcttaggtcagctttaagatacaacagcagcttatatcttaagcatgttccatcttgtattcttaggcagactcttcgatcttgcccagactttccaagcttttatcctgcttcagaaagagtgaactttattttcatagtctcagcaaaaatcttggtgtcaaccatgtcgttattacagaaccaaccactgtggccaacaggaggcgatgctctgattgggtaggctgggtcatgtgcccctctttgagcttggggagcaggatctgcaccatcaaagcacatggatgtttggagatggatatttatcacagggaagatggggtccttctctcaaaagaatgggaagtggatgctgggcatgtaccataccacattttttgtacagagcgtctgtagtgggcactattgtttccaagggagagcaaggtaatggctcagagtgggaacttcatgaccagactacctgggttcatatcccagctctgccatttagtacttgaatgaccatcagtaagtcactcaacctctctattcctcagtttcctcaactataacaacaggaatggttgttgaccctacctcggagtgctattctgaaagttagatgaattaatacatgaaaagtgttcagagcagtgtctggcacagagtaacagctcatgctcataacctttgtgcatggcatctcctaggcttgtacagtgcacaactgatacagctgtactcagcagtcctactcaatgaacgcaaatcattttgtcccccattttttggatgatgatatggtttggctatgttcccacacaaatctcatcttgaatcaaaagtagctcccataattcccacgtgtcatgagagggaactgctgggaggtgtttgaatcttggggagcaagtctttcccatgctggtcttgtgatagtgaataagtctcacgagatctggttttataaaggggagtttccctgcacatgccctcttgattgcacccatgtaagacatgcctttgcttctcctttgccttctgccgtgattttgaggcctccccagtcatgtggaactgtgagtccagtatacctctttcctttataaattatccagtctcaggtatgtctttattagtagtgtgagaacagactaatacgcatgggaaaaatcaaagttcagtaacctgcccaaggtcacaggctcatagatggaggtactgggactgaaatcccaattctgcctgacctttgggtctgctcctaaccaccacatgatactgtgtgatgttaaacatccccccggtggtagagaacatagagagaatgcaacctctccttccctcccattctttgaccctagatggagctcatctcatcttacccctgtgaactccaggcttccaggacccacaatcacagaagagtcagggccccaccaaatatccccaggccaaagcttagcagcacttaatttatgcataagatctgaagcatgtttccctctgtaactacagtatggggaggacttggaatgaacattttactatttagtagaagaagggtcctatcccaagggaatagtaggcaatgaagccctccgtagatgcctgccttgcagaattcgagcagatctggggaagccgggctgatttaattagagaacaatagaatgacttagtacgcacggaggaaggtgctttttctagctattgaaagtgttttggtgctttgtacccacatactcatgccattgttctattgattttacaaaaagtaaaaattggaagagaaacaaaaatctaatgaacttaaactaaaatcaaatcagatgtgttgttgagggtctattgggatccagcccacactaggtcgggagacagatggaaattgcaggaccttcatctcaccctaaacctctccacccctgagaggccttgtccatggggacgtgatgattactcagagtcgaaaggtgggaagtgtcagctgtcacctcaggtcctcattgtcacactggccacaagggttggagagtgaacatcaataattcttccctgtcgcctgtcaacccaaccacctttactacccactgctctctgatggctcttcctggagctcctcaggggaaggcattttcaaaggcgagtctggccagtgttgcgccactgaaggatctgatctctgtccttaacatgacttgccaccgacttcataaaaacatcagtcaaacagcctccgtatggaaataatgtgcagtgaattcttcttatgctgggtcatccataataaaaaatcagccagaggtggccccatatttctttctgctccctaaagtgcaataaattgaaacttttaaagctcagcatgaagacagcttgtcagcagcggcctggggcctgccccgtggaggtcttgggctgggaaatgcctggtctggtctatccagatcctcttaaaatctagacctgcttgacttgtgtgcctctgggacactgacctccctctacccatcccagtggaacaggaaggctaaaattcctcaagatggtcagtgctgaggccctgcttatcctgactgtgtaaacttggcccattcttttggcttccgcttcattttctttctctctaaaatggagttaaaaattcccacttcccagggatgaaaggagctcacaacgacaattgttaccattttgtaatgttttctcactgccagacactgtgtaagcactttgcatgttttcatccatgtatcctgcagacatcctgtgatggaaccatccctattttatagaggaggaaaactgaggcatagcaagacggtgctgctggcagaagcagactgcctcaggtctggctccagtgcccaagctctgaaccacacacacagtgaaatctggcacttagtgttggtaacgttggtttccttcctctgtccttcggaatgaatgtgttcatccctggcaggttccaggaatgatgcatatttccaccacatttgctcaaactccgagttctgtcattttacagactcccaacttagtccaggctctcctgatgctgcctaagaggtttccgttatagcacgaaaccactgagctgttttctctgcaacagagctctctctttattttgatccattccgtctgtgtggtcagacctcccagtgagtggctttctatgaggggcagtgaagctcagtagttaagagcttgggctctggcgttggagcaagcaggctctccacagaccagctctgtgatggtgaacaagtcacttcccctctgtgtgtctcagagtccgcctttatcaaaaggtcctaatggtggcacctttctcctagaggtgctgtggggctgtcatgaagcaaggcagagaaagcacagtgccttgaacatggtccccaagcaacagtagcaggtgggactgctaatgccaaaaccatcagggccaagataatcctatctccagcccagtatgagctaagaaggccagcagctgtctccattgactgctgtctgtgttcatctctctctggggataagtcgtccctctctctgcttgctccaaggaaagaagggaaaggaaagagcatttctggatcatgcaccattatgccatctataaaatggggataaaaatagagtctcctttctccaggggctccgaggactggcgggatcatgctgctgaaaccctctgctgaagtaggggctgggcagatgggaactgtgtcatcgtgttctgctttgccctgttgctttatttacaatgactctctcttgcctcctggctcccagcccagctccttggcctggcagaggggccctgcgtgaggcctcctcttccaccattagttatctgacatcatctcccttgatggcccatctgctcctgccgcccagaccttttgttgtttgcatgccctgctgtgccgattcttccatttctttccacttccaccccttccaccccggctggagcacctccaccgcctccttcctgcaggaccatggcgatcccctcactggctgccctatttgcaatctggtcccaccctccccacagcagccagagggagattaggccacctacctccttagaaaccatccatggcttcctggcagactgaaataaaatctaagctttgtagcccagctcacaagcctcagagatgtgacccgcgtccacatcttcagcatctcctcctcctctccttctctgtgcagctgccctgccgcactagtgaggtttctgttcctcagcaccaccgttagttcctgtctctgcctcagggcctttgcacttgctattgctgctgcccagtgcgctctgcacatggccatctactttgcatcttgtttctttctttcctttttttttttttttttttttttctgagacggagtttcggtcttgttacccaggctggagtgcaatggtgcgatctcggctcactgcaacctctgcctcccgggttcaagcaattttcctgcctcagcctcccaagtagctgggattacaggtatgtaccaccatacccggctaatttttttgtatttttaatagagatggggtttcaccatgttggtcaggctggtcttgaactcctgacctcaggtgatctgcccgtctcaacctcccacagtgctgggattacaggtgtgagccaccgcaaccagcccttcctttgcatcttttaggtcttagcttaagtgcttctccttcatgagtcctctgacttctcaaaagaggggctggttttgccctgctgccttcagggcagccctatcacccacctcctagccatggcagaggcacttgagttacctgctggaaaataagaccaggcctgacatctcacttcttctgtccattatgctctaacaaggccaattaccttcctttgctctacatcaattttctcagtgtgtctcaatccctcccatttgccgactgaaatgggcccccagccctcttttgctgggcccaactgcaggaatacatttttctcaggggctggaaaagggggttttgtgagttgtgacccatccctctctgagccccgaatgtttaccttaggtgatttctaagagtgttttctgttccgagatacagaaaagggggataagagggccaacgggacttactgtagacctgctaaatgttcagcactctgaatgtgcaggcatcctgctgtgagctgaacattataaatgagctgagttaggctgggcatggtggctcacgcctgtaatcctagcactgtgggaggccgaggcgggcagatcacaaggtcaggagttcaagaccagcctggccaatatgatgaaaccccgtctctactaaaaaacaaaaattagccgtgcatggtggcaggcgcctgtagtcccagctactccagaggctgaggcaggagaatcgctggaacccgggaggtggaggtcgcagtgagctgagatcgtggcactgcactccatcgtgggcgacagagcaagactccatctcaaaaaaaaaaaaaaaaaagctgagttagagttcagaagaggcagctgccaactgcagaatggatttagggtatgtgcatgaatatgggtttctccagtggggcgtgtctgtcacctggggccacgtacataagtaattggatgaatcttgatgactccactttgctaggataggaggcctactgtgtgcagctgggaggaaaagagagaaagaaaagtgtgagaaagagctttatttaagtcggtgtctcttagccttcgaggatctagtgaaagctatgaacccagcaaaatgctaaatgctcacatgcagaatattttgcatacccttttaaagggggtctgtggacccacttttaaccctgaaccctggttaagaaacttccacttggctggttcccatgggccgtcaaaccacctcctacaggaagcctccctcaattcccatcctgtgtttccactgtgccagtgtcaccctctttcctctactgcacaaagaggttgtcattagctgttcttgcctgtctcccactgagagggcaggggccagcttgattgttccctgcatgtccagtgcctggcactgaatgggcttcagcaaggatttgctgaatggaactgaagaataactcctggtgatgcaccaggggtgacattttgagtgggctcagaacctggcagcttcaaatgcaaatttatttgctttctcccaggtgtgagttgatgaatagttgtgaagacatgagggccgcctgtatattaatcccatgcctgggaggggctgggctgagctagaggggaaggacattgaaggaggcagcctcatgaggaggcctctcctctcccctcgcctcccctctcccctcgcctcccctcccctcccctcgcctcccctcgcctcccctcccctcccctcgcctcccctcccctcgcctcccctcccctcccctcccctcgcctcccctcccctcccctcccctcgcctcccctcccctcccctcccctcccctcgcctcccctcccctcccctcccctcgcctcccctcccctcccctcgcctcccctaccctcccctcacctccccttgccttgcctcgcctcgcctcccctcccctctcccttcccctccgctctcttcccccctcccctcccacctcccctcccctcccctcccacctcccctcccctcccacctcccctcccctcccaccttccctcccctccccacctcccttcccctcttcccttctcattttcttttcttctcttctccacctcttgcctggtccagctggagcagagtgaagccaagtgtgaggaggccttgaagacgcagaaggtgctcacagcggacctggagagcatgcacagcgagctggagaacatgacgcggaacaagagcctggtacctgtcccttcctgcagctgcagggacctgggccagcataggcctctgggagctagtgtgggcctagtgtgcgctcagcactataggaagtatgaggacatttattgtaaacctaccaggtagcaccttggaggtacagacatccattgtaggccttttatgtgctcagctctgtaagagggacaaggggacttattgtagacctactaggtgctcagcgttctgaatgtgcaggcatcctactgtcagctgagcattataaagatataagggcatcagcgaggctcaactgtgtgttcccatctgcaacgataagcaaggaagtctgttgtggacataatgggtgctcagtgctgtgaatgtgcatctgatgtgagcttgttatttgctcagtacccaatgtggaaacacaactgtatgttgtgtgcccaccctgcttgccactctaagtggttctcagacatctgctgtggtcctactgtgtgctcaccatcatgagatggaacttgttccttattgtggggctactgcatgtcccctctagtaagtggagacaagggcatctcttggcccgcttaggcttattaccaggagaagatttgagccatttattatggaactaccctgtgctcacccctgaatggggacacatggacatatattgtcgatgtattattttggtgagaattggatgtaggtttccaagtcccctatctgggtgtacagggttggcttagatttatactcaatgtataaaacactaaagtttaggtatagttcgagttttataggcaaatgcttatctcaagatctctgtgggcctttttgtcccttatgttgttggaacttgcctacaagcattcacacacacacatacacatacatgcgcacacgtgtatacacaggaatgaatgtacatattcacgtgcgatcaccaggcacacatacaaaataaatgccctccgtataggtaacctgtgcctccaagtttattcatccacccaatacatatttattgagcacctgttatagggctggcctggtgcttgctgctgaggttatgtttgtggacagaacaaagtccctgttctcagggagagcgccgggatttgcattttcatatatgtactaggcacatttaaaatgtgcacacatagattcccaagtgggattgcacagacataaattcatacacacatacaccctgaattcatagtcacatgtaatgcctaatacacacacacacacacacacacacacacacacacacacacacacacacacacacaccaagctgttatacctaccacatgcattggtaaccacagccactcttaaacattgatggtcactcacctcacacacctataggcaagcccctctttgctcttcctctggaccttgctgcccatccctcaccctctcaccttgccttgaccactgatctgcctcccccaggtggatgagcagctgtacaggctgcagtttgagaaggcggacctcctgaagcgcatcgatgaggaccaggatgacctgaatgagctgatgcagaagcacaaggacctcattgctcaggtagtgaatgagaccttggtggaagaagctcagggacttggggtggggtgaatggggaatgttgagaaggtgatgtggttggactactccctggtcttaacatcttggagggataagtgcacagagatagttaggaattgtgcatttcctgtggtcctaatggaggacaatgtcaccttcagatggtgtgtgcatctctggaggacgtgtccaccatgaaagatttggacttattcatgcatctgtctgcccatccacccacccatcgatcattcatctgctcatcaattcacccattcacttttccacccatctactcattcacccacttaactatccatctatccattgtccatccatccatccgtccatccaatcatccacccatccacccaaccacccatccatctgtctgtccaaccatttatccatctatccagtcatccatccatctttccattcatttatccatccatgcagccatccattcatttatccattcatccatcctaccaccgcttacccatttattcacctatccacctatccaaccatcattttcttttctttttcctgtctttccttccttccttccttccttccttccttccttccttccttccttccttccttctttctttctttctttctttctttctctttctttctttcctctcttttctctttccttctttctttcttccttccttccttccttcctttctctttctctttttcttctttccccctctttctttctttcttcttatctttctatctgtagctatttattcaatatttactgaatccttgccatgtgttaggcactgtgaaaaatgctaagtatattgtggtgatcagaagcacatcccattcccaccttcatgtacctcacagtttagtgggctgggaagaccttatcatatggtcacccagagcagagggcagacttgcaaactgagccaagagtccagaaaggaagtgtacacaattctgcaaatcctgacctaggttgggagtcaggaagggcttcccagagtaggtgtcatttggatggagatctgaacaaagaataggagtcacttagattggagtgggacattggggattgggggtgccttccaagcagaggaaatagcacatacaaagggcctgtgatggtgcattggagagactgaaaggagaccagtgaggacaatctggcacaagacaagctcagcaaaagaagaggatcagatcagggtcttagaggctgttatgagattgggttttattttatggttgaagggaatcaattggcaagcttttcaggggcaagagcagttggagaggagcagccagcatgccaccccagactgtcatctccataaaggcaggactctcctctgccttgtccagtgctgtattcagagccaagaagggtgtctgccctggaggtgctcagtaaatcactgttgaataaatgaaagctgactttgtccaggggaaagacaactccagcctggtagatggagtgaagatgaggaggagtggatggatgggcttgggagatgatcgggagccatgagggcagcatgggtgaaacagaagctttggggtgaagctgaggggtatgatgtggaatccccagcagatctccacataatgactgcataatggggagaacagctccctccttgcaatacaccatccagaggagagccggggtaaaatacctgccacgctctaaatgcatctgacagaggttggatctgaagggatttctgctggacaaggaataataataacaaaataattgatgatatcatccacatggtaacaaacaccacaaaaatagcctatgccaatgtctccacttgcgaatcacacttatttttgcctcaaagagaggttaatctgttcagttacaaaggcactatatgcatatgcccataataaataatttaaataataaagatacaagaaatagaaagtaaagaggtgtttctaccctctagaattcctctcttcagaggtaatgaagctcaacagttggttctattttaaaaaaaacctttactctccactgcttaatttgatctctgaacaaacccaatacggaaaggctgagctgagattgtcagtccgttttacgaatgcagagactcaggtgcagagaggctccacagcttgctaaggccagggtccaggtctagaagctcagttaaatgaccctccgagtagctctcatccctcggaatctggtcctagtgccatggccagcccacttctgtctgggttctcaagggtatataataaaatgctggacagtggaccaaatccaggggcttatataattggagtgactcagcgaacattgaaatgaaagatggtgaggaggatgtgagaggtaatttttgggaaacagctattatcatagaagctctgagagatgtagacatctgtgggtggggaaagtagggattttcaggggtggtttcccagcaaggcttgtggactcagggtgatatatatacatttttttttttgtctcaccagtctgctgctgacattgggcagatccaagaactgcagctgcagctggaggaagccaagaaggagaagcacaagctacaagaacaagtatgtgctcagagccatcctatagttgtattagtcagggttttcttagagggacagaactaataggatgtgtgtgtgtgtgtgtgtgtgtgtgtgtgtgtatgagtttattgtttgtttatttgtttatttatttttgagacaagagtctcactctgtcacccagactggagtgaagtggcgcgatcttggctcactgcaacctctgcctgccaggttcaagcgattctcccgcctcagcctcccaagtagctgggattacagacacccgccaccatgcctggctaatttttgttttttaagtagagacggggttctaccatgttggttaggctggtctctaactcctgacctcaggtgatccgcccttctcagtctcccaaagtgctgggattataggtgtgaaccaccaggcccagctgggaaatacgttaagtattaacttacatgaccacaaggtcccacaataggccttctgcaagctaaggagcaaggagagccagtccgagtcccaaaactgaagaacttggaattcaatgttcaagggcaagaagcatccagcacgggagaaagatgtaggctgggaggctaaggcccatctctctccttttcacgttttcctgcctgctttatattctctggaagctgattagatggtgcccaccagattaagggtggatctgccttccccagcccactgactcagatgttaatctcttttggcaacaacctcacagatacacccaggatcaatactttgtgtccttcaatggaatcaagttgacactcagtattaaccatcacagggaggaagagagggattctccctgggcacttacttatactttggctcctggaaactgtttccttcattcttttattcatcagttcattcaaatactcactcaattccagttgtgtgcgaggtgaattgagaccagtccttagacagacacatgcacacacactcacactcatttactcttggcctgtgcttgtgctgaatccaagcgtgccccatgcactgagattcagccattcagtgcagaattttctccgtctgagaaatggctccaagaacaagagatggtctgtgcaagacaggatcacgatcctctgcgaaatcttcctttgaagtcatggtccctccaaacatctctggctttccatcattacctagagggttgctattatccatgaaattttcaaagctcttctagaaccctggcatgcacctgcttaaagtgactgttggagtgaccaggtctcaagcaatttcctatgggtgctggataacaacacgcacaacaaatggaacagcagcagtggccatttgctggctgcttattatgtgccagtcactaatctcctctaatcctcacaagaaaaatgaagaaaccaaggctcaaggaaaggaactgactttctcagactcacacaccaggcagaaacctggctcccaaacccacacttgcttgtatcttttgatgctgtagcttgttgctcacagactagctttgctccttgatcagagcagggaaggagagaagggaagcactgattaaaagtcttgttttcaattgtgaaggcataagaagcatcacctcccagcacctgagacccaggatcagggtctggtgtgagggtccagtgaaggtcccaagattgacacctggccattcttgcttgtgcagacatttaacatgcagcacacctgagtagagaaggaggtggtgtgaatagctcctcccaccctcccaggctgggtcctgcacatgtctctgtcctggtatcagggacaacagatgtccaatagacttctctcatacttacagctgcaggtggctcagatgcgcatcgagtacctggaacagtccaccgtggatcgagccatcgtcagcaggcaggaggcggtcatctgtgacctagagaacaagacagagttccagaaggtgcagattaagagatttgaggtacgtagtgattcataaatagtgcctgggccaagagcagggagagcttttgtgtaagcttcatccatccttctactactcatctatctactcacatgccttcatctagatatacattactcatccacttctcacccaagctccctccctccttccatcatagcatcatccctcaagccacctacccatttacccatctatcctcacgtatgtctctccatctccttccaccatcatgggtccattcatccatcctcccttccatttgttcttcctttcacctttactttttcctctcttcctctattattttttctttagccctcaacccctctgtctgcccattcttctatgcattgatccagttcttcctacctccgtccacctactcaaccacttacatgcccaacactcattttgaacagaaatttattttgcacccagtgtgggctaggccctgttttaggtgcacagaagacagatgtatgacacagatctgctttcagaagcatatgtctttgtaagcaatgtgggtaagatatgtacataaatatctgtaatatggagagagggctgtgatgtttagaggatagagatcttttcaagactctggaatcaggagggcttctgggaggaggtggcattaatgctgaaccttgaaggacaggtaagacttggatgggctggggtgaggttcagtgattacattcacattgcccttgagctgggaacacaggtgttcacttcttcagctctgtaggccagtgacatgggactcttacagaagacatcaccattgtcaaaatcctttcacataagccactccacttgaggtttgatacagtcctgtgaggcaggtaggataagccttatctgatgagaagatgaccccggagaggtcaagtgacttgctgaagataaagccaggcagtgcgtgggataaggtagatggacacctgaccttcacttcctcctggttacaggttccaatttctctgcagccagctggcttcaccacagtaagacagtgcgtctagacagttgggaggctgcattcctcattctgaaacatttccccttgatctccctaggggcatctggtctccaataaggctgctatggatgaagaacagagagaaattcttctttgctttgaccctcagtggttcccagaaattgctcaagggatccctcaaggtctgactgtctctgcagatcaccatgaaactttgatctactatattttaaataattaaatatgtaaagttgggctatatcacatgccattttaaaacttgtgtctagcgtagtgaaatgacagcagaggagaaaagaaaatgaatgtgggaaaacttcaaatggaaaaattctatctccaaattcaattttgccctctgccactatgatttgaatttagtagaatcctgggtctttgaggtgtagagatggggtacctcaaagacacagtttgagaactccttccactcttcctgctgttcttggaattgtggctgaacttcatttgagaggtgaactgaataggaaagcatttcttttaggttattatttggtgtctgatctgcaggctgttatccccactgcctgtggctgcagaaaaagggctcaaagtccttagcaggggcttgaaatattcatgtgggtcccgtcttatgtcaacactagagtatttgcccatcaggatcgattggttcccggcttgttggccaactaatgaattctgcagaacagtctttgggtttgttttgtgtggcactcgtgatggccaaagcacttttctctctattgtttcattgtgtcctcaaggattccccatcccccctgccaccaggaaaggaaaaatgtcataaaatagtagggctgaggctcatgagaaattatctgaacaccctcattttataaatcaggaaacaaaaacacatgtgggggaaaggtttttgacttcagcagagttctctcttcattgcaccagcccctcgagataaataggagctgctaaaaaaaaaaaagaattaataatcccccatcccttatctggcacatcctatgtgccaggcacccaagccttctgcataccaagaaattagattctgacagcgtccctgggacacaggtactatcatcatccctgtctctcagagggcctccataacgtgcccaaggtcacatagccagggagaggtagaggtgggatttgaacccagagggtcttgggggcaagggttctcataaatacgctacactgcctctcagaatagcagttattttatttatttatttattttttcgagacagggtctctctctgtcacccaggctggagtgcagtggcgtgatcttggctcactacaacctccacctcccaggttcaggcaattctcatgcctcagcctcccaagtagcagggattacaggcatgcgccaccacgcccggctaatttttgtatttcttagagaagggatttcgccatgttggccaggctggtctctaattcctgacctcaggtaatccacatgcctcggcctcccaaagtgctgggattacaggcttgagcactgcgcccgaccatcattttttgcatgttgttaattcttcatttttgtagcagacatcagtattcttatcctgattatgaaaacacaggaaactcggcaaaggatttatcttcctgaggctcccttgtttcatacccctggcctccaactccaaggtgggcatgtgtctctgcccctcccaggtcctggtgatccggcttcgggacagcctgatcaagatgggggaggagctttcacaggcggccacctccgagtcccagcagcgggagagcagccagtactaccagcggcgcctggaagagctgaaggccgacatggaagagctggtgcagcgggaggcagaggccagccggcggtgcatggagctggtgagtcctgtccccatcatgggctcttagcgactgagggtttgcaatgtggtagacccccctttcttaagacttctgaatgggagactcataggtttgggtcctgggcctcaggggtgtgcggaaagccaggagaaacaagaaggggagagtgggctgagacaacaccgtcattggctgcaaaccctggaggtgggcccaaagtggaccaatgacattcactgctgccggatggctgccaagttcatttacatatcagatcccagactttcttttcctgctccattcattccactccaatggcaggaaggcctcatacaaaagaggaaaaaaccggtatttattaacggcctatctttcaccaggtctcaatatccataatattctataatcctcatgtcagccctgtgaagtcagaattattgcccccatttcacagatgaggacaaaccgagccttccagaaggggagatgactagtctaaggccacatctagtaaacatagagctatttctgggctgttaatagcacaacaaaaataaaagatacaaatgatgattcaagccaccatgtgtgaagtatttgctccctaccaggttctgaaggaaacatttctcgtctaaatcctcatttcagaactgtgaggtaggtgctatcttgatgtcccttaaaaaggtggggaaactgacacgtggagatatcaacttgccaaattgaggctccgaatggtccatttgcttgcccagggtcacacaggagtaagaatttgaacccaaggctgcctgacaatgtagtctctgcttttagtcactaactcatattttgtctccaggatggaccgaggaaccttttttttttttttttccctggagacagagtcttgcactgtttgccaggctggggtgcagtggcacgatctcagctcactataatctccatctcccaggttcaagcgattctcgtggctcagcttcctgagtagctgggactacgggcatgagccaccatgtccgtctaattttttgtattttagtagagacagggtttcactttgtggcccaggctggtctcaaactcttgagctcaggcaatctgcccacttcggccacccaaagtgctaggattacaagtgtgagccactgcgcccggccccaaggaacattttaaaatttgtttcttgcctaatgggaaggtttctccatcattcagtgtgttgttctaagaagttttctgcacaggtcacagagcatctaagagtgactgttccactttttctccacggggccagatatcactaaggttccagatttctgattctgtgacctggggtgtatctggcacccctatcgcctaccatcactcagccttctagagacagcccacaatatgccaagccttggcccagaggtctctaaattacatttgttttctccttcctgcattatccgctctggtgctgtgagaggtcttaccaacttgttcttcctgcagcaaatatattaatatgtctcgggctactgtctttcacagccggtgtcatccccatcagctttgcccttgacaagctggctgtctggttcttctgtgagggggcagtaaggcaccgcacagagacagaggttcccagacaaagtccaggcctcctgactggcggttcctccacacccatggccctgggagagagaaaagctctttcctccagttgacaggataacttcctcattaaccagccccatttctcatgcagctgagcacccctcctgcaagctctggctgggaggagagaacatccccagcctttctcctctgatgtcttctttaactagccaggcactcaggcattctgtccagatcaaatagtgattttcttcctctctgtcccttgacctctttttctctgtctcttctctccttccctcttttctctctttcctctccctgtccccattcctggggccatattctgatcttgaaaggccctgaaatactgaaaagattatagcatagttcccacatatgaatcaaaatggacacaacacaaaaccttaaagagcttgcatgcatgctgaaattagacctgcatctgtctccaatttctgatggcaagattctggataagtttatcaaagctgaacttttctctttagtttggtgagtgtggttgaaaggagtgttcgtttcctaggattgccatagcaaattatcacaagctgcatagcttaaaacaacagaaattcattctctcatagttctggaggcctgaagtctgaaatcaaggtgtgaacagggctacactccctctgaaggctctggaagagcatccttccttgcctcttccagcttctgatggctccaggtgctccttggtttgcggctgcctcagtgatggctttcttcacatggctttcttttctgtgtatgtgtgtcccaaatatccctctgcctttttcttataaggacaactgtaattggattcagggctcactctaaatccacgttgatctcaccttaagatcctcaccttaatcatatctacaaacgcttttgctttttttttttttttttttggaaacagagtcttgctctgtctcccaggctggagtgcagtggcacaatctcagctcactgcaacctctgcctcctgggttcaatcacttctcctgcctcagcatcccaagtagctgagactacagatgcgcgccaccatgcccagctaatttttgtatttttagtagaggcggggtttcaccatgttggccaagctagtctcgaacccctgacctcaggtgatccacccaccttggcctcccgaagtgttggaattaacaggcatgagccaccgcgcctggcctacaaaccctttttctaaatgagatcacattcacaagtcccaggtggacttgtcttttgggaggcaaccctccaacccactacagaagaggaaggcacatttctgcttggttggcattctgaagttatccagtacatcctgtcgtttccttaatgcttctgtggaagaacaaagctccacgaataaggtcgggccagcagcctcttccaaatactggatgtcctaaaactcaccaacctatttgctctcaaatatttcctttgcctttgagctctgggaagtttccactgggagaagggaggaagtcatactttcttgtatcactcatttattcattcaacaaatacctattcaacaccagctatgagcatggcacagggataggcactggtgaggaagggcaaggaatcataaggtccttgctgtgtagaagttacacagtgtgcccaaaacagggctcagtgggagagttaagtcctcactgtcattgaaagtctagtcttgctgctgaggcccctcctataggtgtggcatcctggtactctccctggcttctgaagacagatcatcccatctgttcatgtctatgccaccaacttgccttccctcatcccatttctataagataaggggcagcttctttgtgccatatgttctctctaaactacactaaaatcctgcaaggcagccagagctttgcttctttccttcatgcaatatatatccatagttttcactgtgggtcaagccctgtgctttatgctggatacccagtgaggaacagcacacacctttgccccccaggagctcatagatggaaatatataactgcatgagaaaatacaactaaggccattcttagtgtacttcgtacaagtatggagtttcctccgtaatgagagctcagagccttcacaggcaaaacaagggggcatgcactgtgatttgagggattttagaaggccagttggcaccaaatctctctcccatgcccactgtcaccaccacaagtccatttctttgggcaaagtattgccttctccatcttccttttttttttttttttttttttttaaattgagacagggtcttagtcacccaggctggagtgcagtggcacagtcatagctcattgcagcctccaactcctgggcataagcgatcctcctgcctcagcctccagagtagctgagactacaagtgcataccattgtgcctggctaatttttcaattttttaaaatagaagtggggtctcactactttgaccaggctggtcttggactgctggcctcaagccatcctccagccccagcctcccaaagtgctaggattataagcatgtcaccgctcctggcctgtcttcatttttagaattcacatcctccctgggagggatagaatacatttcctaactccacagtccaagcattcatttattcattccatcaacaaacgtttattgagttgttctatgttcaagccgtttgcagaagttgtcttctttagcacttaatgtcaacctcagcaagtggagaacatggaggggcccgggtgtgaggttgtccagggctgcagggtcagaaagggcagagctgggattggtgtcccacgtgtccaatgctaaagctctcaccaggtcaccctgctgccctttcaacccaaccttgctgaaaaatggctctgctctggagaccaaaaaaaggatccggtgctctgggccctggagagcagtgggaaggatgttgatggatctcctgtccacaatcctttccgcccgtccccaacctgtactatttgtcactgttggtgttggtttaaagaactgtgagttgttgcatgtgaatgatttatacccccagctgactctctggcacatccagatcaggatcaattacccctccggtggaactttgcttcccagaaaaaagaaaaatgaggttttcccattaattttagtaaatgtactattcctggagactccaggagccattatggagaaaataatattctggctctaaatcattccagtccctttgtcattagagcgatgaagcaactcatctgtggatgtatatatcctgttgtttttcagtagttacagggcccgggggaaccaccctggtcccaagactgggtaatcaaggggtgcctgaggaagctggaagtcctgatgctgacgggaaggcctgacttcggcctaccaggtgcacctatttcagaggctgcacctgttgggttttatccctcatcaccttggcctgattctccggttttgactttcccctgatccaggtgtccttttcacaagttccccaggtcttgaaaaacttgcatggtgcttctgctcactcttcctgcatccacctggtgacctgagttagaaattgcagcaacctgtctccctctcgctcacatagcttaatggtcagacccgctgattttaccctattatttttcaaattcacccctcctgacccatttttgctcactctatctttatttaagcatcatcccctccagtctgggcttctatagtgactcctcacttgtctccccactttcccttcagtcttggtccgccctgcaggagatccttcaagaaggagcatagcttactgtgttatttctctgctaagaaatcttttatggggccggatatgttggctcatgctttataatcctagcactttgggaggacgagtgggaggatcacttcaggcctggagttcaagaccagcctcggcaacatagcaagaccccatctctatgaaagagaaagagagagagaaagaaagaaagaggaaagaagggaaaggaaggaattaaggaaggaaggaaggaagcaacaaagaagaatttgctacgtctgctggcatgtacctgtagacccagctactcaggaggctgaggtggaagattgcttgagcccaggagttcaagattacggtgaactatggttgcacccctgcactccagcctgggtgacagagctagcctccatctaaaaaaaaaaaaaaaagaaagaaagaaaacaacaaaaagatcttccatgggtcatgggtctccattgccttcagaacaaagttcaaactgcttcctatggcctacaagaaatctaacctctctagatttttccacctctggttgtctgcctctcatcctcttacctgttctacttaagcataaagacagatgttgaggactgctgtagtttgaatgtttgtccctcaagcatcatgttgaaatttgatcctcagttttgccattaattttagtaaatgtgctattcctggagactccaggagccattatggagaaaataatattctggctgtagattattcctgtccctttgtcattacagcgatgaagcaactcctctgtggatgtatatcctgttgtttttcagtagttacagggcccggggaaccaccctggccccagaactgggtaatcaaggggtacctgaggaagctagaagtccagatgctgacgggaaggtctgacttcggcctgccagatgcacctgtttcagaggctgcacctgttgggttttacctgttgggacctcataggaggtgtttgggcagatccctcatgaatggcttggtgcctcctcatggtaacgagtgagttctcactgtgttagttctcactggagttcccctgagaaatggctgttgaaaacagccttccacttcctcctctctgtcttgcttctgctcttgccgtatgatctctgcacatatcagctccccttccctttgtgtcatgagtggaagcagctaaggccctcactagaagcaggtgctggtgtcacacttcttgtgcagcctgcagaaccgtgagccaagtaaacctcttttctttataaattactcagcctcaggtattcctttatagcaacacaattgaaataagacaagaccccagtgccatgttactccttgattcaccgcctttatcctcatgcatcctgctgcctgcctatgcaaatttcaaaactcaaatatcaggttaagcacctcctttgtgttcccgtaccccctgtgcccaccccatcaatgcatgtgtcacccagttattgtaaatgccgatgttcttgtcttcctagagagagaaaccctgagagaagactttacttgactcgggctgcaacctccatatcagagtcaggtatagggtagatgctcagtaattgcttgctgaataattttctcagcattttgaagttttacctcttaacagaatggctcaaaaaagtacatcttagaaatggaaaattttaaatcaaccaactgttgtttgtatcttactatgtacctagccctgtgcctgatgttgtgggagatgcagacatggatggactagggactgtgcccttgcatttctcaagatctagaggaggagatgcacatgtccctcaataactctgacacaagatgggatgtgtggacaaaggaagaaatggtttcacacaaacaggagccctaggggagattgtatggaagatgcatcattcatctgaaacttgtatggagtttcttgaatgataaagcaaatactggctggcagctttgggggagcagtgatccagtcatgtttatcacgacatctctcacttgcattcagcaagtgtctagtgaatgcctgctgtgtgtcaggcaatgtccaggttgccggagagtcagagagaaaccagttacagggatataaacacagactcttcacccctttcctttcttctcttccttctttctcattgcagctcccctactgcatgccaattgcaaaatctcttcctcctccctcttcaacctgttttcttttgctttccttgttcttccttattcttccttagttctcacttgtctagacttaggcatgctgtttctctctctctctcctctttctctttctcctctctctctctcctctttctcctctctctctctctctctcacacacacacacacacacacacacacacacaattgttttgactcaggttgggaggagggtctgtgttaaatttctaggctaccataacaaataatcaaaacctggatatcttaaaacaacaggaacttattgtctcacagttctggaggctagatgtctgaaatgaagatgttgggagagacatgctcctctgaaggctctaggggagaatccttccttcccctggtggctccaggcattccttggcctgtgggctgcatcatgcttatctctgcctctgtctttatgtggccttcccctcttctctttctgtctccatgtgtcctcaaggacaccagtcattgaattcagggcccaccttaatctagtatgacctcagcttaactcattacttctgcaaagaccctatttcccaataaggtcccattctgagtttttaggtggatatggatttttgggggacgctatttaacccactatacggtggttgaaaagagcattgcgcttggagtctgatacctcagacagctaagttaacattgaagcaactcaatttcctcatctgtaaaataggcataatatggcctgttttattgggtagctatggggattaaatgagatcatgtatacaaaagtgtcaaatgacagcccataataagcacctaatagatggtactttattttctttcttccttttcttactcttcctttgagtttctgattttctccttccactcaagctttatcatattctaccagctccacatccatgcagtgcccgtgagtggatggcagtgatgttaataggatttaatatttgtttatcatatactgtatggtgggtactgggttaagtactttacatgaatcctctgttttgagaacttgtttggaggtttggagatatacccttgaccgaagactggtcctcctctatcagagacagtcatcctcttgaagcatgcagctttgggagggatgaacatggagtggtgaggggggaaggggacacccgcctagccagctagatcagccagatcaaccctggcgatcaacagggtgacagatgttacagctagatcgccctcacatccgaatcccctattttgagcctcaccgttggaggtaattgtccttattttatcattaaagaaactaaaatccagacaggtgaagcaatttctccaaagtcacattcccagtaaatggcagagtcagaatttgagtgcgggtctgaccgactcaatgaattttagatacgcagtgtttacgtgttcaagtacaattttaaaaaattaataatatatgttaatattgcttctgattctgtaatgtagaggttctcaaccttggcattattgacatctaggatcagatcattctatgttgtgaagactgtcctgtgtatggtaagacatttagtagcatccctgtcctctacctactagaggcaaatagcatttctgccccgtttaccataatcaaaaatgtctccagacattaccaaatgtcccctaaggggcaaaatcaccatctgttaagagcaacctgtctgagataatcctcaccataaccctttagttaacaactatgataactccccattttacaggtggttaaactgaggctcagggaggtgctgtgcccaaggtcgcagggcagctggagaagggggaacgtcaggaaaggagaaagtcaagaatggaaagaggcggaaattagactccctacccttgtaggaaaaaaaccggtagcggttccagcaaaatccaatcccaaccttcctgagacccagaggcgacttcacagcagaatctaattctgagtggaattgaaggccttgctgcagactgtgtacttttaatcatgtttaaataaaacatgggaccatgggtgtgatctcctcactgagcctggcttgtcagccgcttgggcaaagtcataaatagttaataggcaaccacttatggctctacttctgttaaatctagcatcaattatatatggttcatgcattatttatttggtgttactttggggtatatcttccaccttcgggggaaaagtgtaaagaatgggaggcgtagagcagatttgaggatagcttgtttccctctgtactggtcaatttgtgaaggccttgttcccctccatattggtcagtttccctcgaaggaaaaagcccattgatgattaggagatgattaggagatgaatttggatctgagaggactttaccagaccaccaggaaaaaagatcggggcggtgatgtgctggtaaatgtttaacaactgcctttccagggcaggtggattcctggcttgtagtgtttgccaatttctgtggtgtaaattctccctccagggctgatttcaacctaactacatgatgtcaccaaggcagagttgggaagcaatgcacagtagcgcatcattatatatcatttgcaccatacaggtacaaaaagcacaaataccttcaaaagcatagttagagcaaaacgttagcaaaataattagaaagcaatgtgttttgagtacgtattacctttgtttttcatatatttagttgtaagcttgtatcatttaatctttaataatagctgtgtttgacaactggcttgcaaaattccctaaaatttagctatcagctcttgccagccaatatgagccacttcctgcactcctgtgacctggcgtctccttggggtggtgtccccataccctgttagaaggcggttggcagagtagaaggagtgaaaggctcttaatcaagtctcatcgctcactgactgtctttttaagcaagattacttcaccattagaaatctgtccttctgagcatgctcttttaactcatgtataaaatagatgcaatcacatctcctggaaaagactaaaacaagtaattcatgccatgcttctagatctgcctgtcacataactgtccccaaaagcacacctgctcctctctccctgttcattttctcctgccttctgagaatctgaacatagtaggtaggggccttaggaagcccaaagtcaggttctgttttttgtttgtttgtttttgtttttgtttttgttttttcatttgctttaatttttttccactcccaaaccccatgttttcaaaagtccccttccatctacttactccatggcattcaccaaacccacagtgaaggggttcatttcaaaaagcccttggtgttttccccctgcaaatggctatgaacttgaaagcgtaaagatgaattattctggctgggaactgaagtatttaaaaaggcattccacatggagggcatttggggccatgagccgggtgtaaataacacattttatggctctcctgacagggagatagccctcctaattactgccccgttatctcagtgggatccaaaatgacccaacacgcttataaactctgtgttcacagatttccttttaatccctactcctaatggcctcccgcatgctcagagagctgacaggggaacccgcgggtatttctgtcactcccctccttctaggcactgtggtttcctgtttgtctccctacaaaggtttctgtacaaaagaaacttagtcctaataggcatttaggtgctgctagcctcagacatgtttctgaaagtgaattctcccaagctgtctttatctcacatggtgaatgtgcttgtctcaattcaagaggtgttaccatctaacgaaagagtttctttgcgtctggctctgagatgagttatcctgataataaaatctattaccaaaagcctacctaggaataattgggtctattactccccgacttgtggctttgtttctgcattgaaaacagactctccagcaattaatcagaatttaaagttgctaataccaattacaaataatgcgctgaggctcaagatggcaaacagaggagcagatactaatcttgtcccttgagatttcatcaattgaactttcgtcacttcagacttgctggaaattagagtaacttaactctgcaaagttaattacttaaaaaagaaaggggagagatattgattgaatatggcaggagtatattaaattattcaaataaatccaatttatattgtttagatgagattatgcttcacttaattgtatgccagggaggcttaggaaggttagtcttcatggtagaaagcttgatcattgttacgatttgacatctttaaaagatagtggtcccaaggaaatccagggggccccaaatcagacacttcatgtttttgattcatttccaaagtataattcggtttgaagggtaattctctttttactgttcttttttgacagagcttaaacaataagaaagggagaggggatctcagaatatgaggatcgaccaagcagttgggaagcgaaatggtttttttgggagaattggctggtttggaattcaaagtgtatttagtggggaaagatgaatataacttgtctaggttatggctcttttagttgcaagtgacggaaacaaaattaaattggcttaagcaaaaggaaatttattggctcatgtaatgaaaaagtttcatgacctctggcttcagactcagtgaaattcagggactcaaatgatgccaacaggctgaattcggtgtgctggggtcaacccgtatctgtttgccagagctgactgtgtccatctcttcccaattccatgctccatgacatcacattggtagcttgacattggccattgtgggattatttacactatggaaactggcaaatgttaaaggatttccactcatccccacagtcagttttgaacatttaccagcacaccaccgactgaatccctcccttcccattgccttggagttgattgccattctcagacaggctttcccttcctagtggcaacagagttaggctgacaaacagcaaggctatcaacctcaacagaaagagggccccttccacccagcggctcaaacaaaggccaagaagtagaatctcattgaccctgattggcctggtttgggttatatgcccacacctaaaccaagcactggtatttgaagggtagaggctggattgaacagttctggggtacatgcccagccctgaatccaggagtagagtcagctccaccctagccatatggatggagagtagaagaatagattcccccaaggaaaattgaaatgttagtgccagaaggaggagaaatggtttccaaaaaggcaaagcctttggatgcccactgtggaagccacatctgtgggccttgactcttgcagagatctctctgccttgccacaggccccttctaggttttatcttctctgcttgtgttcctgcctcctgcttgactttttcctcctcctttttgtatattttctgttactcctggggctgggacatcccataagtagggtggatcaaagaaaggaaatggaggccggaagtggacagcctaaattccctttctatcttctcaaagggagtggctcacacagtaggaggagcttgccttgaagccaggaagtctgggtccaagccacacttctgcctctgactgactctgtggacttgggcacatcttttcccttgctggactcactttctctctctgtaaaacggaccagacgacttttaaagctctttctgctgagacccctgggcaagcccagagctggttggtcatagagctgcaagctttgagtgtgtctcaaatggctgatagtcatggtggcagcttcctctgaaacaagcacattcctacaccccaagagcaatgcacagagtcacacaatctcaaacctgaaggtgcccaggcctcttcattccaactggtatcttctccaacctcagactggtaaaaattccatctctgttatgcaactgtggggttggggaaattactacctctgtgggcaacaacattcccatagacctccccttctccatcccattctagattgattctatagctaccccacaactggattccagatgtgtcaccttatctgttggagagagggtttcaaaggacagagagatatcccttgcttatctcacctgggagttagcaaggaggtatccagagattaccacgtttttttcttcttttaagtagccaaatcttattttaaatccatagctgatacagatttgtggtaagtaaaagcagagctccccattagggctcatctacttttccaccctggcccctgaggcagcaccataaaatacagcttgataacctatggtcagatctggctgctgtcctgatttttataaataaagttttattaagacatagtcacaaacatttacctattttctatggctgctttggggctacaacagcagagaggagtatttgtgataagaccatttggcctacaaagtccaagatatatactacctggtcctttacagaaaaaaaaatcacttacctttgccctagaacattgcttagcacagagtaggcataaaaaaatacatgctgagagaagaaagagcttgacaggacaaagaactgggaataaggagacttagatgcaaatctcagttccatcatgtccttactgtgtgactttagtcaaggcactcactttctctgtttccctgttaactcataaaatggagacaattattgcaactgcttcacagcattgtggggattacttaataaaataatgtgtttaaatacttattacagtgcctggcacaaagtaagcccgcctatcatcatcatcataataaccatcatcatcatcattatcatcatcattgccatatcatcttcttcatcaccaccaccatcaccaccaacacatcatcttttccaccattcccaccatcagcatcacctccattgttaccacaaccattaccatcattatcttcatcactgtcatcatcaccaccatttgcatcatcatcaccatcaccatcaatcatcatcttgatcaccaccatcattatcatcaccatcattaccaccaccaccatcatgaaaattattattatcactctcatcactgtgaccaccgccatcatcatcacatcattatcagagtgagactagaatcaaagagcactgcagagccccttcaagagtaggcaagccctgtgattcagagcaggcatataagtctaggccagtggttgaattatttcctatttgaaaattctgtgaatgacgtccccaaatgcagtataccccaccttgtgacctgtgagttcatagatgcctccttctttgtgctcagtgtcctgagtgtcagcttcattggaattctgccttctccagccttgtcttggctgcattccaggtaaatgactcggagcccatcttgctgcatgtcacctctgccgcccgcccgcttggataattagaatcaacacattcatttccctaacagcattctcatctccccctctcaaagttttcaaatggaaaaagaaaggcaaaaacaagctacatctgtccttgttcaggcaatttgcagctgtctgcagctgacatccacccagctgggcggcagaactagctttcctgtttgcttttggtggaagatgatgtggttgatgctgttattaaagtttggcagtggtttggagacaaagcgtcctgctggagagagacttaaacactcagggggaatccttcaggctcctgcctttgtgagctaattgcttggtgggtggggagaagaaaaaagactgatgtcacttttcagcaaacaaaaggaaaggaactcaagaaataagatgattttcggtttttgcttctttctgagagcctgctgagtttgcacacaggtagcaactggatgctctgatccagggactggcaagtattttctgtagagggacaggtagtaaatattttagactttgtagtccatactgtctctgtcacaactactcaactctgctgtcgcagcacaaaagcagccctagacattatgcaaatgaatgaatagatgagcgtggttatgttccaataaaactttatttagaaaaacagatggtggactggatttggcccacgggctgtagttggccaactcttgctctatgctctgttggaagaagaagtggagttggaggcagacagcagagctgggtttaaatcttgtctcgatctctttcaggcacctgtcctctttgagtctttgtttcttcatctgtagaatgggttatcaggtagttgggagattagaatgttttgcacatgttaagtggtcaataaattgtaattctttgtagtactcacccgctgaccccagccaaaaaacatgagagagtgaaaccaaataaagaaggctgtctgctttcctgttggccctagctatggttacagttcagtgatgcagatctttttgtagctcatttgagagtctggcagctctgagtttcccaggatgatccttctgttgtctgttcctaccagtgccttcccacaccaagatgccttcctgtgttcagactatttcgtttccatcacaaaggcgcggcctcagttaggaaatcccaagtatgcaaattaagattctgtttatgcacttttgttgtttagagagagtagtttttgttgtagttgggtcgacattaaagacttgttgtctgtaagccaaagacatggctgcatgtcaaatctaacaatcatgtttgcattttaactggtatgattttcaaacagggtcctagggacaattcagacttatgtgtgctgatactcatagttaagattcacttaacctgaaagggcaaaaaaaaaaaatttttttagtagagacggggttttgccatgttggccaggctggtctcgaactcatgacctcaggtgatccacctgcctctatctcccaaagtgctgggatcactgggattcatgccactgcattccagcctgggtgacagagtgagactgtctcaaaaaaaaaaatacatacatatatatataaataaaatatatgtattttatatttatatatgactcacaggtcattacatatatatttttccatgaatatatgcatatatatatacataggaaaagtgtgaccagaaccccgatttgtgattctgtggttagttgcttgcttggtttgcatctgttaaggatgtcagctggaggtatattttaagttgcattatgtatagcttgtatttacttgttattattacttatataacagcctatcatttgtgccaggcctgagcatgttttatacctcatgtcatttaattctcttcaatttcgtgtgacttatggctttacttttcaaaatatattcgcagatcagcagccttggctatagaaatgtagagtctcaggctcagccccacacctttgagtcagaattggctttttaacaaggtcccaggtgactcctaggcacagcagcatggcaggagccctgatgtcggtatttcatcagcactgaattgcaggtgaggagactaaggctgagagaggttagagacgagatctcggctgggcacggtggctcacgcctgtaatcccagcactctgggaagccgaggcaggtggatcacctgagggcaggagttggagaccagcctggccaacatggcgaaaccccttctctactaaaaatacaaaaattacctgggtgtggtggtgcatgcctgtaatccctgctactccggtggctgaggcatgagaattggttgaacctaggaggtggaggttgcagtgagccaagatcgtgccactgcactccagcctgggtgacaaagtgactctgtctcaaaggaaaaaaaaaaaaaaaaaaagagataggatctcctcccatgcagatctcacccacacaatccactacacaatttagctatggttcctgcctctgtattactgatttgtttttttgcttctagatcttgtttctgaaggacactatctacttcctattgttaagcatcactttcttcttggtgcttccagtgtggggtccagaagctaaccacacacttagtaggtgttccaatatttactaattgccgagtgaacccatgaaacattcacacatgcaaaagtgagagcttactcttaaaaatggggtggtggtggtggctgtgaatatcaatcaaaagggtttcctgagcacatctgcccttcagggctttgcatttttagaacatagaacaatagcacctcttagaaccttcagaccatagaaatatagaacacagaacgtaggacagaacccagtggctcttggcctggagttcctccagttttctcccatggggtgatttcagcagacagaacaagtgaagtgccataatttctctgatatttagattattttctatctctctataacatatatgaataccctaggatggtgttgtcaaacatggtagccaccagcctcacagggatatttacatttaattgaagtggaataaaatttaaaattcagatcctcggtcacaccagccacacatcaggtgatcaatagctatgtgtggctagtggctaccatattggacagcaggcatgatctcaaacaagcataatccttttgtgcataatccaaatgctttgtgttcccatcttatttgtaattgcctcccagacttctccctagggtggagggggctggaccacatgccacttcctttccaatcccttttgaactcacacatgacttttctcatcatcacatcattgtcacaaggagggggacctgtttctggggcaacaaatagtaatacatactcatctgagcctcatttggtcccacagctgttttgggtcaaatctcaattgtgtcttaggtcatcctagtcttaggacggtgaggaggcaaacgttatcatctcacatctgtatttcatccattttttccacaaggtaccatcaacttgcattttttgaaaaattaatttactcactaaactcttttatgtctgctaattaatgttcataccttttcttcctctaatacaacagcatctcttaattatcaatatggctactcaacaattagacccgccaaatctcagcgtttggaatgatagcatcctagaactttgatatataagaccttagagccttcaagccagaaaatctcaggattaatagaatcttgaatcatttgacacgcataatattaaaatcttattaaattgaaccatatgaatttgccacttgtataggtcaaaattggttcaatatagctgattgtaattggctcaacctaatagaaatatggaatattgaaatctatacattcttagaattgttagctcctaatgctacacaattttagaactttaggattttagaacaggggccagtcaactttttctgcaaaggaccaggtagtaaatattttcagttttgcaaaccatagagtctctgtctcaacctccgaagtctgtcattatagcatgaaagaagccgcagataatgcataaatgcctagttgtgctccaataaaacttgatttacgaaaacaggcaggaggccagatttgacctgagggttgtaaattgccacccctgttttggaacataaaactgaaagggtcccaccaagcacttggatttgcacaggaaactcatagacctctcctatggttccaaagggtcccattcaaatatggagccattttaagcacagttttgattggttcagtccactgtctgtcccagggcagtgtctggcctccagagagggaatgcgggggaagaaggagactttggaggctgtgaccaaagcgatccctgacactgggagagtgtcaaagagccatgtcccagagttggagaaaaatgggggagactgttggaatcaatgcctggcttccaaagttctggaagaccttgtgagtcaagcccctcgatcagaagcaaaagatgatcctgagtgcctgggaaggcagaactgatggacctggcaagagtcaatgggccccagctgcgaagtgaatttgatgaggctgttcatccaagaggcgtgcacaacctggccataaccttgagatgtggaggtaaaagagagcacaccgcttagcagttgtttttctttcctgatgagtcaataaatgaataaatggaccatgagtggccaagtggctgatataatttcagactccgtcaaaaggaagatcgcaaaagtgtacggaggtagcttcaacgtctttatgttccgccgctgtgagccccggcatcctaatatcatatagtctgagaggcatctgaaagcgaggcagagggcagcctggggattaacatttactgtatgtctactatgtgacaggcactgtgcaaagtgctttcgatataccatctaattaaatctgcactttcaaccttatgagcaaggaaatatttttatctctattttacacatttaacaaaagaggcttacaagagttgaagtgatttgcccaaggccagatagctaggaaagattgacaccaacatatgtgatcactccaaaacatatgctcttaaccacaatgtctgcatttctccaatatcacctgtacacagatcacccggggatattgttaaggtgcagattctgactcagcagatcgggggcagggcctgagattctgcatttccaaccagcaaccaggtgatactgatgcttctggcccagagaccccacttggagcagctggtactatatcatagtttctctttatgccagggcccccaaagttatgaaagggtgaggtttacacttttaagatgaggtcacacagcaaacagtggtttgtcctagattcaaattcacatctgtctgactccagagtccatttctttcaaaaataaagtctactgcttacccttatgcctgtagcttgaccctcagctgggggtgattttgtccccccagggaacattaggaaatatctggagacatttttggctggcacaacttgggtgggaggtgctgctgatatctggtgggtagaggccagagatgatgctaagcattctgaaatgtacagcatagccctgtgtaagcactcacaaagaattatctgctcccagatatccctaatgctgaggtcaagaaaccctgctttctcaagacactgctcagtgtcttttggtcagaaataaaaatccacccagaacctctctcttgaggccacttagtgcacttaatttagagttagtggacatttcaaccaattccactaaaaaatggccatgaataaataagagctgtagctaccaaaaaagtccattatgcaatcaataggtggaactttccactactttgagatgagggcttgctgtttacaactctgttaatatccttgtgccacagcagatggaaaccaatcaggtccagaaatcattgtcttaattttagtcattaacatgcctggccacatgctgtttattggcatcttttgctgtttatgttgcatgctccgttttctctgatggtagcttttgccttcaccctatttctgagggagatagcattgactctgatccaagcctggggaaggctaggatctggcattgatcaccagcaccaatatctccattccatatcctccttgatcaattcttggaagaacatatctaataatacaagactattgatgaggcttgatttgcccgagagggattgtttcccccttcttactcaagctcatttaagatgtttctttggcttgtggaaaatgctgattgaggtttcatttgttacgaggtgacgggatatgcctgaaaagagaagtgtgtctctgaagaatgaagaaacagtatgatagataattatctcctatgcattcagctctttacagtttacaaagcacctgaatgtaacttgggctgcacgatgctctgtattgaacatagggaaggaattgacatctattgtagagttgaggggccgactgtaggatgtactcattggtgcctggggaatccaaacagatgtgggatccatttctatgtcttgcaatggatgtggttctccttctcatatccgtgctgtttctccccggctatgcttatctgcatagctgttgggttacagtcattttaatcatcagtggcctggatggctttattcaaggggtgatccgattttccaactcctgtatttgtatttgtatttgtatttgtatttgtatttgtatttgtatttgtatttgtatctgggttgctgtgtctgtaacccaagtagagtctctcctgggactgctgtgaacatacatggatgctacaccaggttaagacctaatgtgccccagggggttgtcacattgggagtagtggttgtatctcattcttgggcatggtgaattgtgacctgacagtgaggaagtgggacataggacgagcatgtttttgtggagaggagaaaggaaggactttgaggcccatgctggggcattacaatagtttggctagtagagtacagagcacatgcctgagtggagagaatgaggggcacagggaagatggggtgagggtgagaaagcatcaaaacagaggagaccccccaggttggcatattgcacaagctgtcactcaatagttctaagaataggaaagggagctgatgtttattaagcacttgttatagtctatgcaatgtgtcaaacacttcctctcatcagtgactcttcagctagtcctatagcacaacaatgctgttattatttccactttgcagatgagaaaactgagggtcaagtgggtgacaagacttgcttggggtcacgttgcaaatggtggagctgggttgcaagctcctgtctgtgtgaatcgatggcccatgttggtaagacctgctgcatgctacccaagttatgaatttagggcaggaagagtttaaagttgaagtatttatgtggtgacttctaagttctgagtactacacgaggtatttgggatataaggccgagtacaaccttattcataaggagatcaatatagtagggaattagacattggcaaataattcctatctgatgggatatctgtctttcctagtggcttgtacaaatgctgggagcatagaagggaaagaaactaattctatgagagggagccagagagcacatcatacaggaggtgattatggaatggggtcttgatggatgagtagaagttcacttgtcagagaagggataaggcagagtagagcattccagatggagcaatggtaggttcaaaggcacagaggcatcaaagaacatggcatgtttgggagcttgggaatactctgggaattactgatgtggggtgcaaggtgtgggcagcaaaaagaaagggcgagttgggacagagactttaaaggacttgatatgcgaaacaacaaagttgggactgtgggaactgagaagacactgaagacttttcagcagaggaatgacatgatcaggttaaagagattcctccttggaggctttgtggaatacagttggagagtggtgtagattgatgagaggaacaccagtttaaaactatgtgaatcctggccaggcatggtcgctcatgcctgtaatcccagcactttgggaggctgaggcaggtggattacctgaggtcaggagttcgagaccagccctgccaacatggcaaaaccttgtctctactgaaaatacaaaaattagtaggttgtggtggtgggcgcctattgtcccatctactcgggtggctgaggattgcttgaatctgggaggcagaggttgcagtgagccgagattgcttcactgcactccagcctgggcaacagagcaagactctgtctccataaaaaaagaactatctgaatctttaggagatgatgatgaagactaaatttataaaaagataacagagagcagaggaaagatgcaagagattgtattgatgaggtacttgaggcctagagaagggatccagggtaagctataaattgttcccacgctacacttctttggagacaaaatccagtggccacttgagaagtttcaaagtccattttccctatttctgcaatcacgtgggctagtgggctgagaagaaatatgagctgcatttccatttaaattgaaataagacatgtcaaaggtggcttagtaattaccagctggaacaatggcagtatgatgtgggaagtgtagtgtcagtatatgcggtgcagataatttttgcagttgagacttaattatgttgatataattattcccctgtcaggaaaattgggtggcacagatatgtcatatttgtgtttgagcagaaaaatgaaatgccttttttattcagagagcaactgggtggttgactctgggaagttgggattggggcgtttggagtttaccccaggtcaggatgtctgtttgcatctgggggttttgtgaatcccctgctcagttggtatcaactttgagaaggttgttggggtcccatgatggctattctttgcccctttctgaggatgctgcatcggaagtcataggctggagaggatttttagggatgggaaagctaggagctctgaatagcaagagctttaaggaactttagagagatttctttttaaaatttttatttgcaaaccttgcgactgaaaaacccaaggtagagttgcgtgccttgaagcctgatccctcctccctttcccttccccttctccatcccaatgccccaagagagccttagccaccttctccatccctgtgtgataaggtcttgaggagtctgtgccatccactcctccccatccatcagggactccaagaaccaagtacaaagccccttcctcaccattgaagctccagtccctggcgctatgattactgaagtagctggaatgatgtccaggcagaaatgatccatctaaagtggatgaaatggagagaggggtgcacttgataagagagagaggacaggggtaggaaactcccaggttgtagttttttctctgccaccccgtgactgagcaatctttaccaggtgacttcatgctccaagactccgttttggcccctggtatctggcatgtgtgtccagagatgctcatgggatgtgtgaatgcacacagtagtgcagccgacttaggcattctgcaggcaaactctttatcatctacattttaaacaactcaagttgcctaaatgttaactttccagaaagctataaagaccctcaggcaacagctgagggcattttaaaaccatcaggttgaaaaataagaagagaaaggaaagaccagaagcaggtgcctggagcagcaagcccttctgcctgaagataagggagaatcctggcagggaaagctgggtggtgtacagttccatagagtcccctgcttggctgcagagccaactccattctgcctttaatatacaagtgttttacctgagcgtgagtcaaatagatgttatctatactcatacgcagaaatcaacacaggatggaaatacaccaacatattcatgaaaagcagttgtccccaagtaatagatttaaggatgattttcaaagttttcttttgtcactttttaaatgttctacattctctatagtgaatgctattagaaacagaaaagcaaagcaacggtgtttaaaagagaaagaaaagagcacgtggtgttgtattagttttttaggggaggtataacaaagtgccaccaactgcatggcttaagacaacagaaaggtattgtcctacagttctggaggctggaagtccaaaaaaccaaggtgtcagcaggaccatgctctcttcaaaggccctcggaaagaaactattccatgcctgtctcctagcttctggtggttcactggaaagttttgatgttcttggcttctagatacatcactctaatcctcaatctttatgtgacattctccctgtgtcctcacattctcttccctctgagtgtatctctgtgtccaagtttcccctccttagaaggatactggtcatattggattaggacccatcctgctgacttcattttgacttgattacctctgtagagaccttatctctaaatacagttacattctgaagtcctggggattaagacttcaacctgtcttctctggggatatgattcaactcataaacagatgtgtttctcgagatgagaagttcttcctttgtaggtatgggagtcaattgagatgggacaaatgtgaagatcttttgatgttactgtgacagccagcctcccagatggttctcagtgatctgtgtctctggcattcacaccccagtgttttcacctcccatactgcatcagagttgttctgtgtgacatattgattatgtcattggtaataggttgtcctttctgaggttaggctataaaagacatttggtggcagcaggatcacttgaggccaggaagtcaagaccagcttggacaacacagtaagaccccatctctacaaaaataaaaataaaaaaattagcctggtgtgatggtacatgcctgtagtcccaggtattcaggaggctgaggcaggaggatcacgtgggatcaggagtttgtggctgcagtgagccatcatggtgccacagcactccagcctgggctacaaagtgagaccctgtgtctaaagaatgatcataaagatacataataaaaagacatttggcttctgctgtgttctctcttggatcacttgctatgggaaaaccatccactgtgtcatgaggacactgaagcagctcagcgggtgtattagtccgttcttgcattgctataatgaactacctgagactgggtgatttataaagaaaagaggtgtaattggctcatagttctgaggctgtacaggaagcatggctaaggaggcctcaggaagcacaatcatggcagaagttgaaggggaagcaggcggtccctacatggctggagcaggaggaagagagaaaagggggaggtgctaccagatcttatgagatcttatttgctaacatgagagcagcaaaggggaaatccacccccatgatccaatcacctcccaccaggccggcccctcttccaacactggggattacaatttaccatgagatttgggcagggacacagatccaaaccacatcagtgggagatccacgaggcagagaactgagccttcctgccaacagctagtgaggaagtgaggcctccagccagtagccacatcagtgagcctgcttggaaggggaccctccagctgcagtcaagcctgcagacaaccaaagccctggctggcatttcgatagatcctgtcttcattccctactgctgctgcaacaagcaaccactaacacagtatcttaaaacaacacagatttattcttttagagctctagagatcagatgtccaagatgagtccaaaggcattcaaaattaaggtatcatcaggattggtgccttctggaggccctaggggacaatctgttccagcctcttctagcttctagtgtctgccagcatttcttggctcctggatgcaccactccaatctctgcttccatccacatccacattgctgctttctcccccactgacccccttgcctccatcttcaaagacccttatgattgagtattttagggactacctggagaatccaggacaatctccccctacctcaagatccttaagatactcatatctgcaagatgccttttgccatacaagggaacggatttacatgttgccggattagatcatagacatctttgggaggactttatacacgctgccaaataccttgagccagaaccacccagataagccactcctgaattctcaacccacagaaaccatgagagataataaatgatattagatatttcaaaactctaagtgttcgggtaacctagtatacagcaatacataactagtacagaatagggatctgtaatcctgcacttgattctgcagccttgaaaataataattctggtggccgagcacagtggttcacacctctaatcccaacagtgggaggcagagatgggaggatcacttgagggccagagttcaaggtcagccagggcaacatagtgagaccccatctctaaaaaaatgaaaaaacctaagtggatgtggtgatgtgcacctgtggtcctagctactgagtaggctgaggcaggaggatcatctgaacccaggagttcaaggctgcagtgagctatgatcacactactgcattctagcttgggtgacagggtgaaactctgtctctaaaattaaaaaaaaattcataattctggatgtcttacaactttttcctcaaaatatggacatggaaaagtgtgcaaatcacgtaagtgaacagtttgatgaatttgtacggactgaaaaccctgttgtctgtctgaaataatgaagcctaaaatgatcctggatccttcagagctctgggccagtcattgcctgttcactttcagatccactcctaccccttctctgttctgctgtagaattacagaaaaggacatttcctggtttccttgacttctggtaggttctgccaatgaaaggcagtgatggacacctgaaggtcaaaagaaagggagaagacaggatatctttctttggcactgccttgaggcatccatggaagcagcagtacctccttttaatccagatcttatcagggactctcctcctccatgaagcccatttcctctgggcagcgctattgaggtctcacttcccattggatggcccaactccttggcttttttgtccagccctaggttggcagtgccttcctgctgttgctaatctctcctggctttcccaaagcattctgtaaaatccttccagcttcaacaaaacaagtaatagattcttagacatcattttctgaaaaatgaagttgtcctcactaaacaccagcagccctcgtatttcccgtgtctttacttagaaagaaggaaataggaacctgtggaccaagtacgtgctaccaatttaggtaggtgaggtgtacacaattttacattatttcatttgttccttgtaacaccttttgtcaaggaataatacagtactgtcattttaccagatgaggaactgaaggtaagaaaggattagtaactctttgggatttgcgtagctgcttcagggttcatcttgttccaaagccagttctgttcctgctgtttgtgatgttagcagtttgcatctctccctctccccactcaccagggcctctctggaagtgtgattagcttcagcttcactcggatccacacaatactcaccaatctttaaggagaaataaacctgcgaaccaactaactaatataaatatcttctttgaggatttgaataccatttctaggaggattgggatcatttaaaaatgtggcagaggctgggtacggtggctcatgcctgtaatcccagagctttgagaagccaaggagggaggaccacttgacaccaggagtttgagaccaacctggggaacatagcaggaccctgtttctacaaataataataataataataaatatctgggcatagtggtgcatgcctgtagtcccagctactgaggagactgagatgggaggatcacttgagcccaggagttcaaggttacagtgagctgtgattgtaccactgcactctccagtctgggcaagagagtgagacccccatctctaagaaaaaaaaaaaagtgtagcagagttgagagttctgatcgatgctggcagatgaagcacaggacagcactggaatgaaacacttggcttggtgagttgagataatggattctagcccctgattgcttgggtctctgctatgattgattagacatgcctgccatgtgtgaagaaaaggacaggaggtattgttgggtatttgctgaccctttagaaattgtgaaggccccaacttttaatctgtcactttctagctgtatgaatttgggacctttgatgagtctctctgtgtctgctatcacatcataaaaatagaataatactggggctgggtggatcacttgaggtcaggagttagagacaagcctggccaacatggtgaaatctcatctctactaaaaatacaaaaattagccaggcataatggcaggtgcctgtaatcccagctgtttggggggctgaggcaggagaattgcttgaacctgggaggcagcggttgcagtgagctgagatcgtgccaccgcacttcagcctaggtgacagagcaagattcactctcaaagaacaaaacaaaacaaagaaaaagaaaaaaatagaataatgcaatgaatcttcaggataattatgaggaaaggaccctgtagaatgatgaccaacttcttcccagtcgttattcctgctggagactgggcatacatttgggttttcttagggccactccaactctttcctttcccaaagtggagcttaacaccacctgctgatgctcactccattaccagtgtggcctttgagctcttgctggaacacaattcacagggcgttttttatttttattttttttttgagatggagtctcgctctgtcacctaggctggagtgcagtggcgcaatctcggctcaatgcaccctccgcctcccaggttcaagcaattctcctgcctcagtctcctgagtagctgggactacaggtgcatgccaccacactcggctaaattttttgtatttttaatacagctggggtttcaccatgttggtcaggcttgtctcaaactcctgacctcaaatgatccaccctcctcggcctcctaaagtgctgggattagaggcatgagccgccccgcccagcctacagggcttttattcccccacttcacaccctccagcgtcagcctcatttctcccaggcaagtgaccctcggacaatttgaaggaagcaatggcagttcctcatagcctttctttctgggaaagattccctcacctggcatcattggatgaaacaggaacaattagaagcaaagctggacagagccatggactgccgtcaggagacctgagcttagctctagatcttttcttggttgtgtgtccctaggcaaatgagttaacctctctgagcctcagcctgctcatctgtaaaatggacaggacaaagtgatgaagattacctctcagcatggagcaggtggatgaggagattgttcattatagcatcagagaggaataaagtatatattttttaacttgcctatgataaagataattcttattctttacagaaaatcttgaggagtgctcaaaggaatgtaaaaattgcctgatatcttaccacagagagataatagccattgctaccactttgttgcaataatctcagctcactttttatgtttctatagtacttgactctgagggtttcaataaagattaaatgagataaaatattttgaacatttagcagactgcctgtgtatgcaagaaatgtatctaaatatattcacttatttaacacgtatttattatgttcaaggtttgttaaacatttaaggatatgaaaatacttgattattttcatcaggtttcaggatataccctgatctataggataaagtacgtgttacaggcaaaattcaactccattcgattttcaagttgaagccagaagggattgctgtttgctaattctaatcagcaaccagattctaataaatacgtccttaatatttgttaggtatgctatgtgccagatgctggaaatatttgggtgtgtatctacacatgcatgtattgtacacacacgtttgcatatatacatgtttatatatatttataatagcatatgtgtgtgtaatttttttcagcaccaggctctgtaacattttctgcttgtctttgctaaatcagaagaaagcaacaagatgaattttcgtcaagtttcaaaagtgtttcgagatagtctgatctatagtgtaaattgtgtggcacaggtgaaattaactttggggggccttgggagacacctcagaaggtttgagaggcaacctccagagctgcagaaattaacaaatgagagtcttgtccatttgcagagaggagagggtcctctgaagattgagatgctctgggcagagaaaacaaacaacaaacaacagttttaaatattagcctctaattgaacatcacaagaggagatgattttaattgcagccattaattatcatatgaactgcttctcacatgggcaactctgtgatatgctccagagggagtagcccgggggtttaacaagaaatcatagttctctcaagtgatgctggggaggtcggcaagtatgcatattatctacattctacatattattgtactgatctctgtatacacgatatatatatcctccatatattacatatgtatcatgtatattatgtatgcattagaatgtataatttatcccttatccttccctcattcgccactaatagtcatacaatagcaccattcatttcatccccaaacatgtattgagtacctcctgtgttccagacactggtaatacagatgatttccctgcaagaacataagctctgtggaagtgaggactttatttgtattgccggcacctagatcagtgctgcgcctcataggtgctcaacaaatgtttattaaatgtatgcgtgtatgcatgaatgaataatatatgaatatataatatataccaggatatatggatgttgtttgtctacagtgtgtacaccattatattgtagttttagattatcccgggaatgtggtgtatatcttagtggatttctgctatctatgcatctaactatctaaatcattttgtatcctaattatcccccacctcccaatttctctccatgcttcaaatctctaaagagagctaataacagagaagactaagctcacaatcgacctcagcacacaaccccattttcatggagcagccctgagccaagcccgagcaagcgtgattgtcagatgctgtcgttgcctcccgcccacttcctgtttcatgagaggggcactggctcacttccccttctgcttgtgcatcccttccgtgtctccggaggggtctctggctggggccttgtattatctgccccagggagactgtttggggcactgcgtttgtttagcctaatgaaatggtctctgcaatcagcagactccatttggttttggagttgaagcaggaaagatttgctgattgctgattacaccaacactaaatttctccaagctttctcctcagggtgcgcccactgagtctgatgcttccctagcagatggaggatgggatgcagagggcggcaagggggcaatggtggagggtggaaggtagtggcagatccacgaaccctgtccttggtccacatactctggcctaactaatgatggctttctggttctcacctcttcttgctgtgtctaagccaactcaccttctatgcagcccttgtttttttcatgtcttttctatgtaggatagtgaaaaatcttcagagccagagtcctgcattccaatgtttttatttggtttgtgaccttggcaaatctccacagtgacctggggatgacactgttcttcctgagactccttctcctatgagaattaaaggatagctatgccactgttggtcaagtttccactctgccaagctcatttactcctcgcaaaagccctgtgagggagggtctgctactggccccatttccccagtgagacaactgagggtcagagaggttctgtaacttgctggaggtcacacagccagtgagcagcagagttgggatttgaaccccggcagctcggctccagagcctactttcacttttatgatattgtggatttgactcattttagactcctatttcttctgcccacttgcttagtcccagccgaggcccacccatccctgagacactgtgcctctttctgtctctctcctctaccctccaggaagctccctgaggatgtggactgtacaccttgctgctcctgcatgacactgacatgggcaaggttcacctaagcaaaacgaggaggggatgtctgtacccttttctcatgtctcagcacatgtgacttaaagggttcccacttaagaacccaagacctggatgcacatctcagctttgtggtctcccggcggcgtgacctcagacaggtcatttggttagacattcgttgaaccaatgcttttaggattcactgtacttaacacataacccacaatggcccagatgtgtggacttgggatagaatctaagacagaaatacagatttttctgcctctgtgtcttacaaagatacaggtgccacatctgggagaaagtggctaatgcccagtgacactgttgtcctggtccagtagaacagagtggagctggccgggcgtggtggctcacgcctgtactcccagcactttaggaggccgaggcgggtggatcacgaggtcaggaaatcaagaccatcctggctaacacggtgaaaccctgtctctactaaaaatacaaaaaaaaaaaaaaaaaaaaaaaaaagccagcgtggtggcaggtgcctgtagtgccagttacttgggaggctgaggcaggagaatggcttgaacctgggaggcggagcttgcagtaagccgagatagtgagactccgtctcaaaaaaaaaaaaaaaaaaaaagagtggagcctgggcagatgctcccagaagctgccgggattttgcacctagctgttttctaggtgcatttatgagctgacatgctgatgtcctggggtgagcaccccctccttcacagtccctcagtgtcttttgtttcctctgacagcctgggggccccaacctcgggttgtctctcaccttgtcaaggctgagatggggatttcacagttggtggcttcaatcaactgggatggactggcagctccttctcatgccaccaccacggcgtccttcccgccaccccttctccctctcatcagcttgacctggcccttaggcttactcagtctttgcctgctgcctctctctctctctttaaaatcagaaaacactggaaaggcacagacttacaataatgtgaatgggcaagccaatgtgcagagagctgagtgtgtccctgtaatggtcctcgctgacttccattggggaatgcagtcatagccccagaaagagcactggactgggagccaccaagcccagggttcagatcccagctctgcgcctttcctgagtgacctcgctgactgaccttgctggctttagtttcctcatctgcaaaataaagaaaaatgaggccgggtgcagtggctcacgcctgtaattccagcactttgggaggccaaggtgggtgaatcacttgaggtcaggaattcgagaccagcctggcgaacgtggtgaaatcccatctctgctaaaaaatacataaattagccaagtgtggtcgtgggtgcctgtaatcccatctacttgggaggctgaggcaggagaattgcttggacccgggaggtggaggttgcagtgagctgagatcatgccactgcactccaggctgtgcaacagagcaagactttgtctcaaaaaaaaaaaaaaaaaaaaaaaaaaaaaaaaaagaaaaagaaaaaaaaaaagactccaggctaagagaggggctgtgagccattcattttcacttagctactcagttccatggggagctgggaattgcgctttgaccccacatcctcaaatttctcccctcccactgtcctcaggtggtatgtatgttcctttacacagcagtccaaaaataaactttacataattagagccggttacaagaaaaatcccatctataaccccgctttgccccatccataaatattctcaattctccatgagtgttatttgcatagacttgagcatgatactgctcggatctattccgtttgcttcatgttatttcaaagaagcactccacgctgccacaattcttatttctaatgttgatgtctgcctaagagcatcaaagtgacacactgtgatttccctaaccattcccaattgctgggtgatgaggcagatcccagcctctccttgtcatcagtagcactgctgcaaacatcctcgggcatagagctgtgttctgtgtcttgatttatcccccgtaagatgaattaattaccaggaggttagatgctgggtctcacccagggtttcagactcagcaccgtggacattcaggccggataattctttgtgggattgtcctgtgccttgtaggatgttgaacagcatctctggcctctacccaccagatgccagcagcatttccccaagttgcgactgccaaaaatgtctccagacatgaccaaatgtcccctggggggcaaaatcactcttaggtaacaatcattatgtgttaaagggtagcaatgtgtaggttgcaaattaaagtcagagattttcccaagagtccagataaaatccaattagaaaagtaccagaaagtattgatcacgaagatgagcactgagaggggcgtcagaggcaccgagcttgagttccagctccgccatgaagtctttgcttcttaaggcctcagttcctcatctgtgaaatgggagaagagtaaagactcacctgctgggcctgtgaggcatgagtgagatcctggctgcaaaatactcaacacagctctggccacagaaagagctccgtaaatgcccatcgcgcttgcctgttctggagggagcccagctgggtttttcatctttgcttttgctgctgtgaggacagcaaggtgggggtgtttaggggacagacttgaaactatctttgttatgttctccccatgacctcctgcaccagatttatccttgaggctcagcttcctaaaccagactccatgacccttcttggtttttacgtttactcctccatccaagatgggctgagtatccactgtgcgtggtggtgcagattcagagcatggccctggggtcagatgcattgggagcagcaccccctgcacaggtgagcaagctctgtgtgccatgccctggagtatctattccctcctctatgaaacttggaacacctggttgaggatcccataaatctgtccgcagagagagcctctcacggagaacttaccacttcataggtgctcagtgaacactaggctcagcctggggcgtgtctcttccccagtgcatgcatgggtggtgcatttcttgcccaaggccaacgtgtgtttgcatcttctgtccccaggagaagtacgtggaggaacttgcagcagtgaggcaaaccctccagacagacctggagacatccattcggcggattgccgacctgcaggctgccttggaagaagtggcatccagtgacagtgatactgagaggtaacttgctaggggctcggcggggctgggcgcagcaggtgggcggcatcctggggagctctatgccctttagccgggctggggccacattcactgggaaacccaaagatgttcgggggctggaggcacccctcgtttacttgggtaaggagagactggatgttgccctgctggtttaacctctccttgctgttgctaaaacctctcagtccagcttaccaagcctttggtgaggcaatgtgactggaacaaggactagcgtatggtcttctacaagttccatgtccaatcttggcctaattctctcatctgtaaaatgggcataataatattaggatgaatcacatgcaattgccaagattggactatttttgacctacagactggaagtttcatatattcaatctactgcctatttcttagggctgttgttgagagttaattgagttcacagatgaacatgacagatatgtaagtgctatgtaagtggaagctatgtttgtacagaataatggacattattttacaagggcaatggctgattcaaggttgcaaagttgggctggtaattagcgagaccacccaagttcaatggcagggcttcttgcctttctcagaagataggctacttttcaccatctctgcttgaatctcaagctactgcaggccacaggtggaccgctcagctggaaagagtttgaggtatcccagctgggcacatgggtccaggctgtccaactcctgtagcattctgttcccaggagctacctttgtacccttggcttattgcttctctaggaaccacagctgcctgtcttgccacacatccctgcccccgttctagcctctgtggcaaagcctgggtagcagagaagacactttccttacacagcttttcaataaagaatctacagggtggttccctcctgctgcctgcaagctgcccctgtacacacctgagcaggccacattaaaagcctgtttttcttagtcttcctctctgcgaaggctgtttttttctgcagccaggacagtcaaacatcagtccttggaatgcatccctctttgtttccatatgaggaccctgactttagagaagttcaaggtcacacagcaaattagcttcatacactgagctagaactcaggtctgctgaagttcctacccagacctttgccattcacacctctcttaagggctggaggcaggggtagctgctgacctttgggacttgtgggtgcgagacaggcaaaggaagcagagagggttacaaatcagctctggtttagccagaaggaagaaccagacatctatattgtctatattagagctgactatgaatagtcaaggaaaaaaactggaagaaatacaccaacattctaacactgaggaaaggcgttacgggtgacaattttttttttcttcaagtttatttatattttctgaaatctgtgcaatgaacatgcacacacatctctagctctactagtactctctttaggagattttgctcatgtaagttatgtactccatacacctaattttagaatgcgcataacctcctcccttaatgcagtcctgggctggtcatagctgctgagggatttgtaacctcagactctccagtaacgatgtctgcgctcagcaggagcaagatggagagccactggactctaaaactccatgttcttggccaggcatggtggcccacacatgtaatcccagcactttgggaagctaaggcgggaggatcacttgagaccaggaattcaagaccagcctgggaaacataaggagtctccatctctacaaaaactcctttttaaaaattagccagacatggtggcctgtagtcccagctactcaggaggctgaggtaggaggatcatttcaacccagaagtttgaggctgtggtgagctgtgatctgtgattgtgccactgcactccagcctgggtgacagagcaagaccctgtctcagaaaataaattaaaaaataaaagttcatgttttgcctgtaaataaaagactttgtcttaaaaaaaattattcaatttgtgcaaaagtggcttccatgcacattccaagtattcccgctattccctgctaattggcacagctgccaaactgctggtgaaagggcaaatcctgatcttgcagctgctttccagctcatggttgcatttaggattccacctccactgccccctcctcctgttttattaattagtgtcatggcagaacttagtgtaattacaaactccttttgtcaatattacttgtttgatgcttgggctggcttctccattcatagaaacaatagagcttttgcatgaattacaccaggaatgaatggctgtagttacaaccatctttggccagtacacaaaatgtttaaattattttcacttgcatagcaagagattgcttttctagtaaacaatcaaagttaagtaaacataaccaaattggaaggaggcggagggtccatgcttgaagggtgggtgacaggctggaagaaggtgcaacaagaagcaagggacagtgtccatcaacagatgaatgaataaagaaaatgtgatgcgtatacacgatagagtactattcagccataaaaaagaatgagattcggtcatttgcggcaatgtgaatggaactggaagtcattatgttaagtgaaataagccagacacagaaagagaaacatcgcatattctcacttacttgtgggatataaaaatcaaaacaatttaacccatgggaatagacagtaggaggtgggatggctaatgggtacaaaaatgtagttagaatgaatgaataaggcctggtatttaatagcacagcaggatgactgtggtcaatgataatttcattgtacattaaaaaataactaaaggagtatagttggattgtttgtaacacaaaggataattgcttgaggggatggataccccattttccatgatatggttgttatgcattgcacacctgtatcaaaacatctcatgtaccccataaatatatatgcctactatgtacccacaaaaattaaaaataaaaacattataaaatgaaaaggaaaacaagaagcaagggacagacatctcactgggagaatgagatcccggtggtgaggtcacagaaagttgcagacatcactccagtcttggcgtaggggagaaatcccctctggctttaaagggaccctgctgtcaccctcatcctaataagagacacctttatctgtctcctctgttctgatctaccctttctgagctccatgccctggaatccaatctgaattctttctttctcacttttcatgatcttctgtctctagggacttaagtcttcctccctgctgggcgtctgatgtttttcccttgactggatctctagtttccatataacacctgtctcatagctggaagggacatcacctgcatttcagagttgctgtgaggtgtgacacgactacagaaaaccaggtgtaaagaaatgcatcttgtgcctgtacctggaaaagccccatgcaatgtgcaggattattacaatgggaagtcaaggaagaatttgagagggaataggctttgcacatcaacaagtctgattgccaattagagatctaatggttaatttctgcgtgaccttggacaagttattcaacctctctgagcctccgtctctttgagtctaagatgggttaataataagaagcaagtgaaaaagtatggcttcctagcacattaccttgcacatagtaggggctcaacgagaatcatcatcaattgcattcattcattcattcatttgataaagttttactgagcacctgttgcgtgcgagatgctgtgttaagtgcttgttttattccacttgcttcttgttatcgttattctccctcttacagatgaagagaggttgagtaacttgcctgaagtcaggcagaaatgaatgtttggaactgtgtctaaagcccagtttggttgaattgctgaggaatagagagggagaagagcctaggggtggtcctgcttttatcaaacctgcattctgatggtggagtgtgtgtgtgtgtatgtgtgtgagtgtgtccaaaaatagagtgcacagattgataaataaaacacgagaatacaattggagttacgaggccagagaacgtagtgctatgatgaagagcagggtaggcagttgtagcctcccagagaggaaggcattggaattaagacccgaatgaaatgaaggagccagctgtgggaaggcctgaagaaaatgagtaatggcagatcaaggcacgttctaggaagtgaaagaaaaccagtgtcccccgggaaggtagatgagggagcagcagccctcttgttccccttttctctttctccatcgcatcttcctctttccctttctcctacctttcttctcctctgaagatgacccatagaaacccactgacaccctcagtttcttaaaatgccccagtgccccaggcaggattggccacgtcatttgtagggttcagtgtgaagtgaaagtgtgaggcttgctgggcgcggtggctcatgtctgtaatcccaacactttgggaggccaaggcgggtggatcacttgaggtcaggagttcgagccccgcctggccaacatggtgaaaccctgtctctacccaaaatacaaaaattagccgggcttggtggtgcacttgggaggctgaggtaggaggatggcttgaacgagggaggcagaggttgcagtgagctgagatggcgccagtgtactatagcctgggcaacagagtgaaactctgtcgccaaaaaaaaaaaaaaaaaaaaaaaaacgaaggaaaaaagaaagtatgggtctccttgttaaaaaattatttaagatttcaagacagtaacacaagagcattaaaccaaaatgcaggcccttctgggcatgggtcgcaagcccctgaagccagccctgaccccagggtggttcttagggagcatttcctaattctcagcaggccttgatcctaatatgttgacttagaacttggatttgagtggaaacacagtgtagacttcagtaatatcatagaaatggggaaactgggggaaaaaattgcccatgaagtctcaacacatttcaaagaattaatattgtataaagcatgttgtctgatcacagtgcaattaaattggttataaacaatgaaaagaagtatttgtgttgctaggctgtaaatccaccgtccatagcagaacccccagctcctgcccaggccccagtctatagtctccacttgctaacagctccacgctacacttcactcctaatttcctcatcaccctggggtaagaggtttggattagagcctgagggactggttcgaggtacttctccaaacagagttctcaattataataaattcaaagccaacccaggagagaaacacacacacacacacacacacacaaacacacacacacacacacacgagagagagagagagagagagagatgcttcagctgcaggtgaggttctttgagagacttgttcaaattacaaaaagtcacatttccccatgttgggaattagatctgagcataacaggccttccaggctggaaacgtggctacgtgctcagaaagccaggtagcctatgtggcagcatttaaacgtgtgctctcctgcactagagccctgcattgtaacttgcactgtggcatcaacctccttagattaatggagaaatgctttaagccagtcacccaggcctaaagtatgctcattattcttggagggaggaatatgctggctgacacagccctgtctattcatggcccaggggctgcggctgctctgtctgtcaccttggctagggggtaaaggggtttgggcgagatgtagagaggtcagtgaatgacctcttgctcttgggtcggctgaaagtgcataagtaccagctggcccaatctgagacgaatgctctgaaaaaagagtcctcagttgctttgttgagtgtaagttggacattttccaacgtacatccttttataacctggctaaaattaggctgcagtaggacaagtggaaagatctgggtctaacggaagattctggttgctactgagggcacgcttctgagttaatttattcatgagtggacccaggctctgtccaaactgtaaagtttcttgctacctagtaggacagtcattggaacttccaacagctcttttcctgcaacttttttactttctagtttgtcccctatgagtaatgaatgtgctccaggccagggagaacagcttaaagcattcctattaatctgagaaggttgatgctgcagttcaagttgcaatgcaaggccttagtaccatataacacctgtttaaatgatgctgcatagaccacctggctttccttctagcccatatatccagctagtaggattcacagagagtcagggctccaaactactttgtctattccagcattacgggaaataatgataattgtaacaataggtaccttttcttgagaaattactttgtgcaggtactgtgctacctgtttggcatatgttatcctcaaaacaactctctgaggctcctaccattattcttcccagtttgcagatgaagaaactgagaagtcaagaaagttgccccaatccatgcagtaggtgatgaagccatggtctgatgtccaggctgaccccataacctaaactgctaatggccaagcgttgttgtcatgtcaaatgtaacctacttcctcctttcccttgtcaaggtctctgttctctgcccagtaactgccctgtcgttaaggagaacttgtatctgtcactgtgagatggggccaatgaatttacatgttacttcccaggcaacatttgcatttagactggaattgtctggcaaagactgaccctaaagaagtacagctgaagacattgaattaattatctcgctcatcatcaacaccctgtttataaattcctggcacaagttcaagttcttcttctctctccccctccccctcctccccctcttccccctccccctcttccccctcctcctcttccccctcctcctcctcttcctcctttctcctccttctccttctcttcctcctcctcctcctcctcctttctcctccttctcctcctcctccttctccatcttcttctcctctcactctgtcacccaggctggagtgcaatggcatgatcttggctcactgcaacctctgcctcccaggttcaagcaattcttctgcctcagcctcccgagtagctgggactacaggcacacgccaccacacccgactaatttttgtatttttagtagagacagggtttcaccatattggctaggctggtctggaactcctgacctcgtgatctgcccgcctcgcctcccaaagtgctgggattacaggcatgagccaccacgcctggccaagttctttttttaaaaagccacttgcaccaaggggagagaaaaccactgaccgcatgtcaggagatgagggtcccagacagctgtaccaccaaatgaatcaggaccatggacaggtcatctgccctttgggcccctgcccactcagcagaaaacaatgaatggacaccttatgtgttgggacagggggtacagtagggaacaagcagacatggacttgccttgtggagcttgtagcccagagacactttcttcacatggtaaaagggccaatgtgtttcaaacgtcctccttattgtagaattcgttttttataccaaagctaactcatgtacaaaattctagcttaggatggagtgcagccatcctctgattggagtgacagaggaaggttttgggctaagccttcctcctaggtctctcttcttgaccccttggtacccacactttacatggggtctcctagaactcgagggctccatgcaccatggtatacaaactcaagtactttccaggaccaataacctgtgacttacgtgcagtctatatggtagtgagttctgcccatgtggtttaatacttctcaggagcagacagtacaaagctccccactgcttctgcctgaaagccttttttttttttttttaaatctcctgtcccgaaggcttcattgcggatcatctcatgataaaggtgttaggtgccttcagcatttgttcgtacaataaacgtgagctatagttcccagaagctcttaattcagccttcttattttaaacatactctcattttttggagaccatctcaaatggtaggaagcatggggtccaggtcagatatcacacttggtgtggacagtatttcatcatgaatgaacaaacagaccagctggtgggtcttgacttcagccttagatattctgtgcaagtttagtgaaacaggttcatgggcaaaagcaaccagtgtgcagatactataaaaatgtaggattaataagcagctatacttccatcttttttatttgtccttgtggctagttcttttccagatcagaagcttaggaggagctagtaaggattgccgataatcttaggctcttataagattgtccctttagattcttcactgttttttttttctcccacattgtgacactgtgattaagggtgtaacagtagttagcagtgcagtgttgggtcatgcctgctgtctgcttcttcctcatataaactattggcctagtaaatgcagatcttcctgttaaggtagaaaaagcattgagattagctattgtaatagagtctggcagaaactgaaagacaaactctaaatgaagagagcttaacaaaaggactatttacaaaggtgtgaggaagctccaaggtatagatggcgcagcacctagggaatagcagcaactgagagcagtaactcctgcaaggtctgaagggagaaaaagagggtgcaattgctggaatccagaaagaaagagagtgagagagaagcctgataggaggagctctggcctttggttgagagctggagccaacacaaggaaaggcagtagagagaaatccagaaatccaggacaataagtaacttcagcttccctgtcttccctccttcctgtcaactgtcagttgcattccctattggctgagtccaagagaaagccatgggatagggaacccattgatgttgtccatacagatcagccccctgtgtggacagagtgggtcagagagcaggagcatgtggaagagtaaggagatgagaagatgcccagcatgattagacatcaaggagggaatgggtctctagtgctggggaagagccctttggaagagggtgaatctgaatgccgagtccacccgtggggctagtactcatggagtcagccagggtaaatagtaaacaagaactaacaccagtgtgtgctttgattagctattgggctataaagactttcctgagtgctggattcaagtaaagattggtgtttagtcaaagtaggtgaggaagtactcaaaatgtaagtgaatgggtgactgtgttccaataaaactttttccctgtacagaaacatattcccttgttttgggggttagaatgtgaacatctttggggaccattattctgcctcctacaaggccattcacaaaagctgcttttgttccactgcagagtctttttctttaaaagggctagatagtaaatatttagccttttcatgccatgttgtctttgttgcactactattatggtgcaaaaacaatcacagacaaaaatctctatttataaaaataaatggtaggctagaattggcccatggctgttgtttactgacttttcttctgttggattcaccaagcattgtctgagaacttctggtctgactgagctttggggctgaaggatgaataagacttgttcttggtccagaagggatgttggtcactgcctggacaaatgcatgtaaatagaagcccccagggtgacaggcttttgagggtgggagccaaggagcagcaggtgcagctcttagaggaaacagcttgatcttctaaaagaggaattgtccagattacagcagagaatactgagaagccccagcctgatgatccagattaaaatgatgtcctaggtgtctgaggtttgcggtttggctgtctgcacccacccactgaacaattgcatgctgattaggagcatgagcttaacaggcctgggatcaaaagctgtgtgacttagacaagtatgtcaggttcctaatctctaaaatggagacacatggggtaggtagatgagattgtgtgggtagcatatttgttgaatggagggatgctctctaaagaacagctaccatcgtaattagtattggagtttcccacaatgccctgggaagctgccctgctccatgtctgatttgctagcactcacaaagaacatacagctaataccttgcttgttagcaataacaatgctattaataatagcagtactagttgtactaaaacaagagtagcggtaatggttgctaccacttaattagcactatctatttgccaggaaccatgctgagatcttcacaagggttatctcacttactctgctccacaacagagccccattatttgccacattttaggaaggaagaaaggaagctcagggaaggcaagtgacttccctgagatcacacaggggcaaaggttggaagtgggattcacactcatgtctgtctaacgtcaataaccatgcttccaagcccctggcagcacgaggataacacactctttcttgtgcctcttactagtgtccagacggcagtggattgtggcagcagcggccgaaaagagatgtaagttaaccccaggtagaactgagcagctcacaagggtgagcccctggctctctctgtccagtttgcagagggaacatccatgtccacttggagaattatcagtgatgcccatgagactaatgccttcatggtcataacctatagcactaggaacatcgtattgaactgccctagttcttttagacagaaagaagcctatgccttctcatgctactgtcctcagacaccttcaatggctccctattgccccagaacagactttttacactgatgtttgtattctgcacattcagacccttgccttcccctccaactgtgatttctggtttccatattgtttatgccccgacctttatgacctccgtacctatgtgtacgtgattccttccacccaaaattccgttcttcagtccctgcgtggccaaaccctaaccttcaaagaagatgtagctcaactttcactacttgatgtctttccttaggcctccaagaagcaaatcaaggctccctctttgaaagaaaaaattattaatgctttatagaggcacagagggtaggttttattagaacctaccattactaatgctttatagagggacagagagcaggttctagtaaaacctaccctctgtccctctataaaatattaataatttttaaaaattttattgttatttatagagatggggtcttgagggacagggtcaatgttaagttcatgtggacaagaactggtgcttggcataaatagagcgtcctattaaaaaactatatattataatatatatacacatacacacatataaataatattaataaatatacacacatacatatacacacacatatacataatgttgaatgagtatatcaacttacgtggtctcattgaggacctgtgacgaccccctctctttctgtgccgctttcagaatcaggggacataaaagtagagtccctgttttaaagatgatccagataaggtaaggaaggagttaagaccttcacacttgatatattccttgaacacatcaaattcaatgccaaactttactcctaaattggagagacctcaacatttgtagtggagtgtgtatctccccaaggaagagtgccatgattaatagcatgggcattggaataaaaaggaacagggtttgcatcccaatttcatcattgactagctgggtgaccttggccaagacccaaattggcctctccaaatctcagtaattccatctgtgtaactgtgacagcactggctcctacctctctgggatggcgagtgaggttatgcaggtatatcacttagcacaatgcctggcttatgctatgggtgaatatctaattattgctgttactgtgattgtcattgtgctgatggtgtcctgcaatcttattctagggataacgtctccatcctcagctcccagccagagggcagcctgcagtcctggttgagctgtactctgtccctggccacagatactatgaggactccttctcgacagtcagccaccagcagccgcatcctcagccccaggtaagagtatctccttgctgcctctggatggctaatagcttgaagaatctcagactttgaaagttgttgttcaagtctttcattgtctctggcataggcaaaaacaagcatggtcctgaaagtctggggtataactctgccacttcctagctgtgtgactttaggcagatcctttaccctctctgagcttctacttcctcatctgcaatacatggaatataattttatttactgatccaaatggttgaagcaatgaggacctaatgcagtcctctccagagcatggttttccagatttttaaatagcacagggtgaacattttaaaaaatagtaatagttgttatagttgccttctacttaaggcacatcatactcttttttccatttatgggtaattacaggttcaaaaaatttttaataaacatattcacttaagcttttttaatggaaagtcattataaagaaattgggccagatgatttatcacctggagattttagctttattcaaattttagctttatttttaattttataatttccttaccacagaaagggatgaattcaggtgtggcctgatatgggagcctcacaaatctacagaattgccaacaacaaccgcctccaataaatgggcctttggattcacccttagttgcacagtttctatcatccatcttccttcttgcttttcagctccatttctctgagctcacttggtttcccttttcaagggtggccctcttgtaattaggagttaatggccataagtcagaaattatggattaagatatgcataattaagatgagatgctcacagtttttgtgaacagaaggcccaatatgataagactggaaaaatcacagactcacggagcaaacccagacaaccgcttcctgactcaaaacgtgtttgctttgatgcaggggttgtctttacaaaaagaagggagtgggagtttatgctaaacttttgggcatatttggcaaatggcaaatgtctggtgcatgtctgcagataatcttaggctgaaagacttgatgtagaaaatatcaaagacaggctccaagaatgggttgcttctggggagctaattaaagcaagattatctgattactgctcttaattaaaaacaaaggcctgtatgaagaagggaattgtgtcctctgtgaactccaaactatgaggactttatctcttctgaaaactaaatacctttgcgttagcctgtctgccagtggcagcaggagaattggaggcagccagagaagaatgtgaatgctcattaacataataaccaagtttcataattctaattatattagggtggataataaggatcctaacagatgaattgcagcctaacctaagttgtttggcacctgtttgaatgggagatggtagggtattacggtttcggtgcaggatctgaagtcagagctggattccaattctttttttttttcatttgctgtacatgtttaagatataattggcaatatcaatattgccaaaacaaaaagtaggcactttttacattgtaatggcctgttgaaaagttttagaattgttattctatacagagattcatctttaatcagtgttctggctgcttccaaattcactgaattctctagcactggattagaaagcataatctataggaaaacgtatacaatgtatagtttttaaagtcaacgtttttagaacaacaagacaaaccagtacatataactttcaataagcatttatcaaatgcttactatgtatggacccggacatagattaaaaaataatattccaattctttatttgcatatctgcagctgtgagattttggacaagctgcttaacttctctgttcatgtttcctcccgagtaaatcatgattgttgtcaggggtaatgtggtgatgcacaagccactctttactcagagcctggcacctagaaagagccacaaaaaattagccatttttatcagcagcagtaactatttgatgcccggaggaatcccgggagatagacttcactgtctatcttcatgttacagaagagaaatctgagactcagagaagggggagcaactgatccatgcatagatggtcttacagctcctgcagtggcccctcaggcaaggtgggtcttcagcatctcccagagagccctatccagagtctctttcccttttcttttccctttccccttccaagttcttgggcatgttcagctgctgtttggagtgaaagtgcttgcaccaagaacagggagggggcaggaggcaagggagatacttacacatctgtaagaagggatttcttgtctgtcttcctcatggccacatccccagggctggctcacagttggtgctcaataaatgtttgttgaatgaataactgaccagagcatcaaggctggaccagaaatattaattgtatttggtcacagctcagcattgattgtggcacagagagggttggtagtttactaatagcacaaagtaggtaagtggaagagccagaatttgaacctaggttggaatcccaccaaagcctctattttatttgccatgctaccacagctctctgacattcatccaggaggtagaccactcacctggtaaagtttactggaaaaatctgatctctgtttattagtactaaaactgcctaaggattattatgcaaccttcaatgttcagccaagacaaagtgctactgagcaccagatcctacgacattaagccctaaaaattatgaaccccttcctttgaatatgtttatagcttgaggactcaaggcattctgagttgcaaaggaccaccgggattatccagcccaacttgctcagtttatagatgggaaaacctgaggtctgcagagggaaatatcttatccaaatttatggtatgaactgacacagagtacaggtgtcttgacttctagctctttttaattgcacaagcaatctatgaatacttctctcaaagaacttaaaatatatcagaaggctgaaatgcccttggccaccactgcagtcttaagcttccttctcagaaggatccatcatcttcagtttggtgtatatccttctctatctttttctatatgtatatatcataaacatatacatgtacttgtagcaaatatatagcatatttgtgagatttttaaaaacataaattatataattacatgtaatgcttttcataaatttttacaatatacttctttccctcagcaatacaccttggagatctttccttaccagtatgcataagttcatctcattctttgtaattcctgcacaagctgccatgctttatttaactatagtgtctttatttcacttttaggtgctttccagatatttgatattaacttgtcaagctttgaaaaacacacattcttataaacatgggtaaatgattctctggatcaaagggcatttgcattttaaactctaatagatatgagtgtcctttctgctaggagactgtatcatagtagagaacaggactcctatttatacccgctcccatattacctggtgcatgggaagacccaataaatgagcctcttggatatatcccatttgactgagaaagaaggtcactctaaaaacagaagagagggagaaagcagtcttctgccaacaaaataaaagcattccccacattatttataaggggacgtcaactcaagagaaatacacctaaagcgttatgatttacagcctaggaatcatgctgctgccgctgataagtgcaagcgcttctggagacgaagacactaaattacctttgtggccacagagagggagtttatgggctggatggtggcagtcacactttgttcaggagtttctcttaacatctggccgcaagtggtgcctgggctgtccagggtctggcatgcttacgtcagtccctgctgcatgcctggcctctccttctcgctctccttccactgctctgtggatgagagtgcgagggcagtgaggctctcccaacttcttcttaccctgacaacacattgggcttcctgagcagggtctaagcctcatttctttctagatcctcaccccaagcccagtaaaaccctagccatggtcactcaccctgttctgcaaggtccacatgctgacaggcatgacgacctagctgtagagactgccaaggtattgtcatcgggcagtcgctgttctcatttcctgggcaattattccaaaccatcctgacttccctctgatctctccccatcactctcaggaggcaactccacttctgtttcattcaaagtaaaataataatgcctttaacttctgctgtgatgtatatgcattcatctctatttgcccccatattccctctggtctcagaagatgaggtccagtcctgccctgtctgaagctaattgggatccaggacttctttctccctaaaacactctgattcatctagtgtcacctctgtctcttgtgtcctcaactttccttgtttcagttcttcccccagaggttataaacagctgaggtcctccccatcctaaccatgtcctcatccatcaccttgctgtcctattgagttactgtttttccttccttttgattcgagcttctcagacgtgttgttaataggtaccatcttcacttactccacattcatgcctcaatttactacagcccagagactgctctgccactccattgaaacctttctcactgtgtcagcagcttccagagacacaaatcaggggacattctctagtctttatattttcctggacttttccccactgttgaacatttcatggaactctatctgcttggccttgacaagatttctgctccttggttctcctcaaacttctcttccctggtctttgcctcacgaccttatctccaaatgccagggttcacaggttactgccctcacttggctgattctctctccacctgatagctggcaattctccttttgtgattttggctctgcagctttcagcaggtgacccccaaatacagatgaacgtctttatattctcccaagttttaaatttatgtatgttatcttattgtctatactgatcaccaaccaggtatctccctgatgttttaactcagcatgtccaagaggaaactcatcctgccccaccagccctgtgttatcaggatcattgagtggttctgttattcataaagcaccacgttggagcccttgttatcttaggttatcattcccctctctcatccccatattcaacgaatccgtaagtcttgtattctaccccccacccaaacaaatactctttctgcttctctccatcccccactgccaacacctttaagtcaagctaccataattgtgctcctagactctggcaaagacctttcaactccaccctcctttagtccatcctctatactttagccagtttgattcctctaaaaggaaaatctggtttcagtggctcctcattgcctacagcaggggtcccagagtgcaggttgagggcagaagcatgtggtgggctcagagagttcaacagggcctgaccagcgggcctggaaaacatacttcaagaaagtaaagggtagatctgttttctaatacaacctctcctttactagttcctgactatgagcaagttacagtctccgagtctcagcccctccaccgttaaatagactttaataatattccctttgcagagctgaagaattaacaactgtagcaaattagcactctagagtgctcattggaaggcctgccaccaagttggtgtttaataagcagaaactcccttccatcctctgtccttcatcccagagcaggccaggtaatgctgctgtgccaaaggcatggatgctgacaggcaggaccagggaaaactaggactgggtgctccacataccagagattgcagaagtgggctaaactcacagcagaaaaccatgagcacaacagaaaacctcttggcagtgaaagtggagttttggtgagctcagttttaaatatgttaaacttcgtgtgtttggggacatccaaagagaattgtccagaagctttttaaactctgacctggagccctaaggagataccaagaaacctctgcgtaatgttaggattcttatgagtgtagatgacataaaacccatcaacctggccagagtaagaaggagcatttattgtttcctgtagctgggaaaccaaaaaggaaaatctagcttcaggcattactagatccaggaattcaaaaatgatcatggggatttggttccccaccaacctctctgctctgctgtcttctatgttggtttccttctggggcaacaagatggcggctaacagctccaaactcatgcctgcaccattctgagtccagtagtaaagagaatttctctcttcttcacagttttcacaaaaaatgcaagcctgagtgagcctgaaccagtcagaatggacaaggggactgaaggagcctcttacctttggcctaagtcagtcttctcacctggctcttggaaattcccaccaaaccatgagaacatgaagggaggaggggttccccaaaggacaatgaagggccttacctgaagcaggagaatgaggacttggtagatgaaaactataagcatagaaaatgttttccaccaagggggaagctgaatgaactacaggaatgggcaagactatgaagagaaagaatggtggggaggaaggaaacttattaaagtgtttggggtccccattcagtaaccttgggaaatctaactaaaatggtgtctcctgatcagagactttatttatccctaaatttcaatggccaatctatcatcacataattagtgatgctgtgctttgaatttattaccaagcctggctttctgctgttgctattggacttgtaccatattgcaatgtgagcatggagattattgtataaattattctcactcacataatcatcgtgattttaattactgtgtaatctttgctaattactgttgtatgtatcatttgctttggtgccgatttaacacaactgcttttcgtttggctaaaagatggcattacaacttttcctttttgcaggagaaaatttgctttctgtaaacatttgcagccccaaactcttggcttgcagttcttggtttaaaaggaaagatccagaccctaccaccagccctgtttgtttttatttgggataaggctggcttgaataagtaaaaaggtctaaattacacagtattgtctttaaaaaaacagttgcgttactttcaaagaagggcaattactctactacagacaggaagccaaagatgggtcatgtgagggctgcttaaatgatgagataagactcgtttgtaattagttcattaattatggatatgtgaataaatggtacttagctttaaaaaacagctcgttcccaaagtggggtaagcatctgatgctaatcttatttcaatagtacatttatttactggtctcggcattcttagaaatggagctcaggataattttaatccatcctggaaatacttaatgaaagggcctctcatgaatatggttttatgtcttcctaggacataaggagtctttttagttttatcagtattaggaagattagtggaaaagattttgaaactgaatgcacagaaatattaaatgcaaacacattaaccatggaccaaaggcctgagcaagtgaaaacaggtgaagtctgaatgtagacacaggatttatccttaggacccaaatccctctcagacaggtatttataggaaggaaggctgtttcctgtctagaactcgaggtcttggatggtaggtctatggaccttttagaaaatttgaggttcacctaagctgcaagtttgtagaaaactatttggatacatcgttgatggttcagaacattcttttaaaatctgtggttctctgattaagctaaggttttgttacgcaaatttaccattgaaatatatatacaggaaagtggatcttgaggaaattttcaaaaaattgatcatacctaattaatttgtaattactaacaaaatcaagactggaccattacagtgcccctacaacttccttgtgcccattcaagccaccacctcctccttcctcaaagaaacccaccatcctgacttctaacactgtatattagatatgcccctttttgaactgtgtaaatggaagcatccagtatgtcctcttttgtgtctggcctctttctttcgatattttttcaagatgcatctacactgttgcatgtagcagtaattcatttattttcattgctctatagtctatgtcagtggttctcaactggaggcacttctgcaccactacccatctcaacaggggacagctggcaatgtctggagacatttttggctgtcatgctactggcatccaatgggtagagttcagcgatgctgccaaatgtcttacaatgcacaggacaggccacatagaattatcgggtccaaaatggcaattataccaccactgagaaaccacagtcaataatatgccattgtgtgaacatagagtaataattaatttattctattattaatagacaattaggttgtttatggtttcccatgattatgaatagtattactgtgaacaatcttgtacacatcttttgttgcatgaatatacagatttctgtcgggcgtatactcagcagtagaattgctaggtgtgttttcagctttggtaaatactgtcaaaacagtcattccaatttatgtaaccataagcagtgaatgaatgttctggttgctctaaatccttgccaacgcctggttttgttatttaaaaaattagctattctaataggtgttagtagtttcaaattttcatcttcactcacatttccctggtaaataaacctttttatatgcttatatcttcattcgaatatcctctttaatgaagtgtctgagaaagtcttttgtccattatttttattcttctttggttatccatctcttttgtattgatctgtagttctttatgtattctaaatgcatgccctttataaggtatgtgggttttcttccactcagtcacttacctttttcactctcttaatggtttatttttataagaaaagttcttaattttaatgtaacccagtttataatgttttcctttatggttggtgctctttatatactgttgaaaaattatttgcctactttgaaatcatgcagtattttcttattttttgtagacattgtattgatttaccttttatatctagatacacaatgcatcatgaattgatacttatttgtgatgtgaggtagggctcattgtggtgtgaggtagggctcactcttttccatatagatattgagttggtctagcacatatattttagagaaatgatactgtccacattacacaacagtataaatttgtcataaatcaagtgatcttatgtatatacgtctgtctattctatttcacttttctatgtgtccatccttgaaccaatatagcattggaagtataagttctccatattaattattctttcaggtcagcaaatgactctcagggaaagtgccacatcatactgtattcaccttcagtgtatttccctctttgcaggatttggccttttgagtcctggctgctttgatggcttcccactgtccttaaatttgaattctacttttctggctttccaagtagctctggtgcaagctattacatctggaagctgagtgctgagctaggcttttattctcttacataaataaacatttttttttccaatgtacacttccaccaacagtgtataagcattcgtttttctctgcaacctcaccagcacctgtctttttttgacttttaaataatagccattctaactggtgtgagttggtatctcattgtggttttgctttgcatttctaatgatcagtgatgttgagcttctttacatatgcttgttggtcacatgtatgccttctttttaaaagtgtctgtgcatgtcctttgctcactttttaatgggttttttttttcttgtacatttgtttaagttccttatggatgctggatattagacctttgtcacatgcatagtttgcaaatattttctcccattctgtaggttgtctcttcaccctgttgataagtctcttttgctgtacagcagctctttagtttaatttgatcccatttgtcaatttttgctttggttgcaattgcttttggcatcttcatcatgaaatctttgcccattcctgtgtccagaatggtattgcctaggttgtcttccagagtttttatagttttggcttttacatttaagtatttaatccatcttgactattgtagaaaacagcatggtgattccttagagaccaaaagcagaaaaaccatttgacccagcaatcccattactgggtatatacccaaaggaatataaattgttttaccgtaaagacacatgcatatatatggttcatcacaacaccattcacaatagcaaagacatggaatcaacttaaatgcccatcaatggtagactggataaagaaaatgtggtacatatatgctatggaatactatgcagccataaaaaagaatgagatcatgtcctttgcagggacatgaatggagctggaggccattatccgtagcaaactaatacaggaacagaaaaccaaataccacatcatctcacttataagtgggagctaaattatgaaagcacatggacacatagaggggaacaacacacactggggcctatcagaaggtggagggtgggaggagggagaggatcagaaaaaataactagtgagtactagacataattcctgggtgatgaaataaactgtacaacaaacccctgtgacatgagtttacctatataacaaacctgcacatgtacccctgaacttaaaagttttttttcttactttctacacctagggaaacacgaactttcacttatattttcttccagtcctaacttagtgcatctaccaccccctctagaatgtaagttacttgaagacaatcactattcatctctatattgacagcatctgtcttcatgacactcaataaatgattcaggatggacgcaaggaaatattaatggatgcataatttccattcagttaaagctgcatcttcatggggaactgggtgcttttatgaatgagtctgagattttctgtcactattgccatttcaccatactctggtgagacaatgtctctgcatggaaagtgaagggatgcattaaattcacttaaatatgttgaatccaaattgaatctacaagccaagtagattttaattactctacaaatctagaattgtgttcttcaaaacattgtgaaaattgtagcagaaggtaaaagactcgagttgtagagccagtacttgcaccatctcatcagagtgtgacttgggaagttctattcccttctctgttttcctaggtgtagaatgaggggttcaaaccagatgaggcccacacctccctctcaatttgatatcctagaaattgatcacatcctgtagaaatgaaacaaggctcttggcttggtgttagaaatatggagaactcactttagattgtgtactggaagtgggttttgaatcttgtttttcagccaggagaagtggatgtgactgaccagtgagtggggatactgggttctgaattattcagcccaggtgaggcagccctttgcacattctttctgcagttccacaatcccccatctttctgttcctccattccttcattctttccattctacaagctttctttgaggcagtcctgatgctggggattcatagaagaaagacatggtctactccagaaactccagtatctcccagtcttgctgggagatacaaataagtaaatagacaaccacagtacagagggggacacaggaggctgtgggagccaggagaggccccagcccaggccagagggcggaaaggcttcctgggggaagctacagttgggctgaacattaaagggtgagtgaaaatgtttgtttgtgtgttttttctttaaatatagaataatggtttatgagaatcacctgcagagtgtcagttccttcctctctgactccctcctaactcttttttattaggctaatttccttccttccttccttccttccttccttccttccttccttccttcctctctgtgcctctccctccctccctcactcactcactcccttccttccttctttcctcccttccactccctccctccctccttctttccttcccttgctccttccttccttcctttttctttcttccttctttttttaaatttgttaacaaaagaggacactatcaactcgtagcttctactttgatagttgttagaattttccacattgactttatttctgtctttagctcctcctctacatctatgtttaaacacattttccttcttccttccttccttccttcctcccttccttcctccctcccctcctccttcctcctctcccttctcttttcctttccttccccttatgaaaacaagttgacaacatcacaacagctctccttaaatagtttcgcatctttcttctaagaaggacattttctaacgtatcagtatcgcacttaggaaaattaacaaatccataacattatctaagatctcaacttttatgttacccaattatcctaaaactgtcctgtatcactgtatttttatattatccccttatgtatttatttttcaaatttaatttttaaaagcagtgggtacatgtgcaggtgtgctacaaagatatattgcatgatgctaagattcaaagaatgattctattaaagaatgatactcattatatttgattatgcttctttagtctcttttaagaaaaataatagactttttagttttaagctgttttaggttttcacaaaaagagcagaaagcatagagagctcccatatatcctttttccctgttctgtttttcttattattaacatcttgcattactcctccatctcttttaaatgagaacgatccccttatcaccacccagctccaattttactgttttgtttttttttttttttttttttttgcgggggcagggggtgtagagttccaggggtgacttgaatgggcaactctatgcaaaaatcactgaccttagtccctggtagccagtaagaatgtgtaggtgaagtcaaggcaaattctgctgagtcacataaggcatgcaggcaggtgtccactcagggcagctcgatggattggtttgtaaaattgtcaaagactcggccccgaccttaagcatcagagagaacagcaagcaagccttgagagcgaccttgtctcataaaaactgccatattgtaaggaatgtaggatattcactgtgtctgtttcctgactctattccccatgtcaggagtggccaggcatggggacagcatggggacagattgctgctaatgtcacctcctcctcacttccctgctcccttggctatccttcccccaaaccccagcaccctccttgctttgaacttccctctcagctaggggtgggggagcttcctaagcctcagttttcttgcctgtgcaatttaggtatcagcccttgctggtcaagggttttgcagattgaataagctaagaatcaataggaggaatcttctgcttttgcttggagtgtctttcttgagccatcgccgccattgaaatcctacccttcttccaaagcctgactcaacccacctcgtcaagaaaggctgtgcatggccaggcgtggttgctcacgcccataatcctagcactttgggaggctgaggtgggtggattacttggggtcaggagttggagaccagcctggccaacatggtgaaaccccatctctactaaaaatacaaaaattagctggatgtggtggtggcgagcacctgtaatcccagctgcttgggaggctgaggcaggagaattgcttgaacctgggaggtagaggttgcagtgagccgagattgtgccattgcactccagcctgggtgacaagaatgaaactccatctcaaaaaaaagaaaggaacgctgtgcacccaggcaccagtattgactgctgtctcccttgccaatctcttgctgcatttatagtctgtgcttcacagtttctctggaatttcttgcattgctgacccttctccatggtttttttccagactcaacacctacactgctctccccaggaggggagggcagcccatcttctgctgctatgtgctgaaaacattataggtagacagaccagcatgggagtctcagctctgctccttctcagcaagcccatttgcctgtcttagcctcagcttcctcatttataaaatgggacgataaagggcagtagagcagagcagttgggagccatgggcctggggtaggactccttggtttaaatccatgttctcccacttattacatgacaaattactgattctttctgagcctcagttctgacttgggaagattgcaatatctgctttagaggactgttgtgagcgtaaacttgagtaaagtctgcaaagcctaaaggcataatacatgataactctaatgatgtgctatttacctgcacaccacagtggcttagtaagtgcctcccattccctgcataatgcatagtcctgggtgccatgtcaacttttgttacagactctctgttgttattttggactcagttaccaaatattcaggtcatcttcaaagagcatctggtttcccatctcaggcctcaccagtattaaagaacatcaatatgtttttaatttcctctttaatttcagggagtggatgaagaacggggggtgacagcacgctttgggggatgattcacggtgtcattaaatctgcattgagtttcctgtagctacaattggcccaggctatgaccacactcagtcctgggaattatgttttgtttgttttgctgtgtgattaagtctaataacagtaaatccagcatctccttgacttggactttcttggttcattacatcgcagtggatcttgaaaaatatgtatgtgtagatgtaagttcaactggttgagtttcccgtcagccttctgcccagtaggtgtgtgatgtagtggaagaagaagaatgggattcagatctggcccaccagggttcaaatgcaggccctgccacttagcagtatggccttgagcaaatgttttctcaccactgagcctcagtttcctcatttgcaagatgggatgatgcctctgattttgatgcggtgatgcttcttagcttgatgagatgctgcatacgatacatgcagatataggtgcctccttctttgttcttcaccgattttcatggagcatctgcttctgtggctgacactagagataaaatgatggggccccattcataagataatctgaaaggggaaggggtatggtccaagcaggagacactgtctcagacactagctcgttctgaggctgaaccaaccacttcagtctccacttcccttctctgtgctgttcacagtaggctcatacataggaattgtttactcttgaacatctgtcctcaatctggggacttctctagcactgatgaaagaggtcattaaaagcaatcagacaagggttaagattttaaaatttatgttatactgttatgtcaaaggattaactttgagataaataagtcatgtatggaagtttaactgtagtgtcttttgcctcattggtagtactgggggtaatggaggtagaagtggcttccactcttaaatactgaatatgcatatggcatgcatcatctctcatttctaacaagaccctgggacctagggcagtgtcattctcactcttacacctgtgcaagttcaggcttcaaaagataactgggggcccgggcaccgtgactcacgcctgtaatcccaacagtttgggaggccaaggtgggtggatcacttgaggtcaggagttggagaccatcctgaccaacatggtgaaaccctatctctactaaaaatacaaaaattagcctggcatggtggtgtgcacctgtaatcccagctactcgggaggcggaggcaagagaatcactcgaaccctggaggcagagtttgcagtgagccatgatcgtgccactgctctccagcctgggtgatagagcaagactccgtctcaaaaaataaagaaaagaaaaaatacctggcttggaatagacagagctgggatttgaactcaggtctctctgcatctgaagctctttttttgcttttagccttgcaggttagaaagagtggcaatttcagtattcctgagttttcatgtcctagtttacctaataaacttctataacttgaagcaacccatacttacagcattttcatataaatacccttattcatcagttcatttaatcagtccagtatttattggaacctagtatgtgacaagcactggagcatgattcataacttgaacatacattttattgagcacctactatgtgcctgaggactggcaattcactcatgtatccaacacatgtttatggagcacctacaatgtgttagggccctggtgcttccctcactcactcaacacaaattcattgagcacctactgtgtcctaagacattattctatagacactggtagcagtgaatacaatagataaaaatcctgccctcatggagttcttatctccacagcattgcaaggccaatctagtttccctcatttttcagctaaggaagctgagggttagagaagttaggcaatggtccccaggtcacatggctagtgagtggtgaaaccagacttggttgccagctgtgtgtgcttgcagaggttactcagcctctctgtgcctggaggtcataatccctatctctcagggtggctatgagggtaggagccatccgtttgctctctcctatattcctggtatccagcacagcacctggcgcacagtaggtatctagtcaggggtagctgttgtgaccaatgactatttcatccactaagttatagaaccagccccggcatctttgtggctggatgcttatcctctggctctttcccatagcaggtataccagaaggatattcctttttggacagactacagggtgggcagaagaagtctccaaggcttttctggagcctctccttgaagagtaacagtgcccctgcctatcctgcctcatagtgactctgagagccttctatacgtcatccctctccctggcccaggctctgggaagcaggcacggtaacatgttgattatctgacatccctccatcatgatgatggagagttccatctgagccacaccgacctggtcctgtgaggacagctagaaaaaaaaaaaaaagactcttactggtccccggatgaagtcagacaggatgtgtttgaagtgtccagtgctgggacaggaatggggatgatcatccagcctcactcagcagaacttgggatccttatcccaaagcctacaaaacggcatctgaattcagattaaattcttcagtctctatacagaaagaagtggatgcaaggaactttataccttgagaggtggtgcagacaggaagtagaaaaagcacttgcagagatgtaggtggatttctgcatgggaaagccaggaagaagcacttggccgtgcttcttgccctctcttccttgtctctcctcactcgacccctactgctcctctccagccccctaggagtctacactacgtggcttgtattcctgttttaagctcaccagctgaggtttcaaaggcaccagaccatttcagaaaggtaggactcagctcactccaatctcaagacattagaccccatgacagccaggctaggcctgagtggctgtgctgggacatcttggcttccatgccttgtagaaggcattgctcctcaagggccccagggaaggcgagtggatcttgccctgtgccagcatagctgggaaccttcctggcttgggcccagcaaacctatggcctctgtacctgattgccagcactcacagactgtgacctccagatccccatttctgggcagctggctacttcgccatggaccccagcctatctcgcctttttgttaaagccaagatggcagatccttagttgccggcctgaaaggcctctgtttcccctctctccttcttgcgtttgcctaagtctccttccttcttctccatcaccaccgcccttctgggtctccttcctctttctctccatctcatttcaacttctttcctgtttaaactgcctcctcttctttcatgctctagccttccttctcttcttcccacatttctttgtcctccctccacttttcttatcctgactacctcttctttctcatctaccttgattgaattcgacagcatttgctgagcatctactacatactgggctcagtgccagttccggaggtgcagaaatgagagtcagcaagacactgtcagttcagacttgtggtctgtgattctccttcctcctacttttatgccttttttcccccctatgtttttggctcatcttcctcctccctcctcctcctcctcctctacctcctccctcctcctccctcctcctcttcctcctcctgggacttcttcaccctccgttttcatgccctgccctggtgtccgcagccagcagtggcagtgggagctagggtgagcaggatggcagagtcccgggagattcagtgacaggagccctcaatgttgccctcctcaggtggcaggcggtggatgagacagagcatccaagacactcattcatcacacccgcctcctttcagggccaggacaggatggaaatgacttttgtcagttctgcggcagcccactgcccctggcagctccaagctgtttattaataaaaagtaaggaagaaaaaaaatacaggcgtgtgaatgccatcttgctgtgtattcgaggagggattccaaagcaatgaagttgacaaatataccttcagggaatcacaaaagagccctccatctcctcttccagcccatgtccagctatgttgggaacagacaagaaataggaaaggagggagctgctctgggcaaacgtgtggcttttgttttagcacataggaaccaacctttcttcttacggtgagacagaaggtcacttgcccattcattcttctatgcatccctctttgaacttcaattgaggcttttattgagtccagtgtggggttgggttctggagattcagaaattaaatagtagtaatattgattgcctttaattattaatgattaataaccatttattattggttataaattattcatcataaccactaaccattatttgggtaattaggtgccagagacagtatcaagggtgtttctttcactgtcccagctgccccaggaggaaggcaccatgactaggggtcggggagtagaaggagtactccgggtagaaccactcctgcaagacccagaagcagggagggcttggcctatcccaggagaccagcgtcctggagcagcatgagcaagagggcaggaatagcaagcctgatcacacaggagaaggattgagggtgatggtcagagagagaaaggaggtagctcctccacattgccaccttgacacccaggtcttaccgtcaccagaccgctgctgtaaccctcctccacccatctgacatagggagtaaggagaggcagatgatcacagccagctctatgtcttgtcctcatgaagccctttagccgggcccatcattgccatggcgatctcacacaggcccccagcctggggagctcctgccagacctggaggagataggtttgtgggatcactgaagctctgtcctcaggggcgctcaggaaggcagggtctaggtgcctgtctcagtctcttctggctgctataacaagaacaccatagactgggtggcttataaacaacagaaatgtatttctcatagttctagaggctgggaaatctaagatcaaggtgctggcagttacatttgttgtctgattcatagattgccatctcactgtgtcatcacacagtggaaggggtgagggagccctctggggcctcttttataagggcactaatctcatttacaagggctccaccctggtgacctaatcacctcccaaaagccccacctcctaatatcatcatattgaggattaggtgtcaacatattaattttcgggggagacaaacattgaatctatttcagcccccacctatttccctgggaaagacactgctctcctaccccagccattccctcccgtgccttccatggccatcacctcaagggagctttgggttggcttccttcccagattcaaaagcccattgggtcactgtggtcagttctatttctcctaaactgtcctgtgtgatcaggagtggaagtggtgttacccaactgggtaagcaagaagtcttcctcaaagtcttgtagcagaatctcagtcaccctttatacatagagttctgaatcctacaatcgtcctgattgttacagttccagcaacaaagcactcagaggcagggaccccatgattggaaacccgcgtgtgcatcgccctcagcatctcttcaggcctgagcccacagtggctttatctgcagtgccaacactctgacatttggcaacttttttacttttttaaaaaataaattataactttggtgaggggagggaatggggtcgtttctcttagagagaggacaaatagattttatttattaaaggaaaggttgatggactccagtctctctcctttgaatgatgccatttattttacagtctataatttggtcccactgtgagcctcctacttttcagaggcaaagtgtttttggcgctgctgccacaaactccctctgcataaaaaccacgtctggtgtagtcccagaatagaaaccgtctgtcctcttgtgtatagtcttggttttaagttgatttcatgtgaatctttcccttttgggggaaaaagattttacctacaccgtcaccccatgaaacaatcagggatgtcatggggtatcccgtggagacacatatttgggtcttgactctcagaagccccacttggtgggactgtcctctaggcttggccccaaataaacaaacagcccactgcatgtccccttccggtcttgaagaagcaaactacttatttcacagtaagctctgggatgataggtcctatcatgtcagatatgatgcctcataaatctaattcatccgtcctagctgcagttttaatctactcaaatgtacttagctgggtttaattatagatagaaattgcattcggaaagcaacaagaaatcatttacatggcttgaatttgcacattaaatcatatggttcatttgagagtgcggtagggatggtatttccaaagaaaaataatattagtgcctgtgcttaggggctctcacaccgattgcacaaattgtatgaattgcacaatttctacagactgcatttttcttcttggcacaggataaacgaagaggctggggacactgagaggacccagtcggcattggcactgagcagagcccggtccaccaatgtccacagcaagacctcaggagacaagcctgtttctccccactttgtccgccggcaaaagtactgtcattttggggacggcgaagtgcttgccgtccagagaaagtccacagagagattagaacctgcttcctctcccctggcttctcggagtacaaatacatccccgctgtcgagggaaaagctgcccagtccttcagcggccctctcggagttcgtggaagggctccggaggaagagagcccagagaggccaggggtccacgctgggcctagaggactggcccactctccccatttaccagacgactggggcctccacactaaggaggggcagggctggcagtgacgagggaaacctctcgctgagggttggggcaaagtcacccctggaaatcgaaggggccgctggtggtctcttgaggtccaccagcctcaaatgcatctcttcagacggtgttgggggcacaaccctactccccgaaaagtcgaaaacccaattcagttcctgcgagtccctcttagaatccagaccgagcatggggagaaaactgagctctccgaccacacccagggacatgctgttgtcgcccacactgcgtcctcggaggcggtgtctggagtcctctgtggacgatgcgggctgtccagaccttggaaaggagccgcttgttttccagaaccgccagtttgcccacctgatggaggaacctctaggcagtgacccattcagctggaaactcccaagcctcgactacgaacgcaagaccaaagtggacttcgatgacttcctcccagctatccggaagccccagacacctacctccttggctggatcagccaaaggtgggcaagacggttcacagcgttcaagcatccactttgaaacggaagaggctaaccgttcctttctctcggggatcaagaccattttgaagaagagcccggagcccaaggaggatcccgctcacctgtctgactcgtcctcatcctccggctccatcgtgtccttcaaaagtgctgacagcatcaaaagtcgaccaggaatcccacgacttgcgggtgacggtggcgagcgaacgtcccccgagcggagagagccagggacggggaggaaagacgacgatgttgcgagcataatgaagaaatacctccagaagtaggaaccagttcaggtaaaagcaacaggctggggctattcttgggggaatgagagttcaccttgcagccttggggagagcaggtgccactactgtccttaatgccacaaccgatttctctagagaccaagatttttagaggttttagctgaagtcatgtgttgatggatgcaaagcttttcagaacccctctgctgggtacctctacttccttgtactttgaaatgcagacacatcagaaagtaagaggttcctgtgggataccgctaaagaaggtgccagatgtagccgggcgcggtggctcacgcctgtaatcccagcactttgggaggccaaggcgggtggatcacctaaggtcaggagtttgagaccagactggccaacagggtgaaacctcgtctctactaaaaatacaaaaaattagccaggtgtcttgacgggcgcctgtaatcccagctactcaggaggctgaggcaggacaatcgcttgaaccagggaggcagaggttgcagtgagctgagggtgccaccactgcactccagcctgggaaacaagagcaaaactctgtctcagggaaaaaaaaaaaaaaaaggtgccagatgtttaaagttacctcaccctactgtcattttcttttcttaatgtcattccacctgggtttgaaggagctgtgatggcgttctgtccacataatgacagaagatccgtggtgggatcacagacatgcaaagggccaagttggaagagaccttcagaatagtggagtccacttgcattgcatatggagagaaactgaggccctaggttcaggggggagggaacaagtacaaaaatcacagagcaacaatgcaggataagtaactacttgctgcccttcctccctctcctagcactcatcctgccactcatctggagtcaaggtaagaagaggaattcaggccgggtgcggtggctcacgcctgtaatcccagcactttgggaggccgaggcgggcggatcacgaggtcaggagatcgagaccatcctggctaacacagtgaaaccccatctccactaaaaaaaaatagcagagcgtggtagcgggtgcctgtagtcccagctactggggaggctgaggcaggaaaatggcatgaacccgggaggcggagcttgcagtgagccgagatctcgccactgcactccagcctgggcgacagagcgagactccgtctcaaaaaaaaaaaaaaaaaaaaaattcattgctaaccaaggcttacatttattgagaggacacatcagacagtcatttagtactcctgatatccccaagcagtggtgaatgttatttattcccatttaccaggttgacagactgagtatcagaaagattaaagtcacttgtacagaatcaccagggcataattgggtttccagctctagaatccctacatttatctttaaaagttttccctagggacacattccaggcatcttcatgagtgaaattagagctgtctgatagcgtatgagccttcgtaaatctcccagtcactgaatctcagaacttgctgcagctcaaggctctgatggtccagcgactgcacatggctctcagggtgcacctgctgccacccccaggcctccttgacccaaatgaggcacacgtcctctatttctttgagagacagcctcagcccatcaaaaagccattgccccttccgtggagacaggtttggactctatcagagcaaactaatttgacttaacatggccttctctctgctctcaattaccgagtaaagatctgatattcatttacattattatgctctcggggacacagaaagcagtttcaaaggccaagtaaagggcacacatccatgaggggaacagtccttagcagaagtcatcacagaacatcttgtctctgccattccgttttaaactcaagtcctccttccctaccctgagcaaggttcttctccaaggatgctagtttttcagctatacaatgcaacacctccaacgatgcaaatgcatggtgggctttggaaccaaacaagaccccccaaagctcagttctgccctgtaactagccattggaccctaggcaagtgatacagtctcaccaagcccctgtgtcctcagttggaaaacaggggtaagaataccaactacctaaagtaacgctgtggatttcatgagaatatgagagattcctggaatagagcatggcaccccatggatgcagtaaatgccaggttactttggaatttttggacctttgggaaatctatcccaactttttctccttctgccacctacactctgccatccctttctgtggagttgctacagtaacgccacctgggtatacagaattccaggccctccaccccattcattgtctctatcaaaatgtacccatcttcctggccaggcacagtggctcatgcccataatcccagttctttgggaggctgaggcaggaggatcacttgaggccaggagtttgagaccagcctgggcaacatagtgagtccccacctctacaagaaatacaaaataaaaaattagctgggtgtagtgacatgcacctgtaatcctagctacttgggaggctgaagcaggaagatcacttgaacccaggagctggaggctgcagtgagctatgattgcaccactgcacactagcctgagtgacaaagtgagaccctgcctccagaaaaagaaaaaccttacccatcctttgtcccattcatcaactctgacctatgtttgcttccagcctccttgaagctgcccttgaagacttcccgactctacaataacttggagacagagagactggccaggcctccccggtggccagagccagccagcatggccaccctcaagaggcgagatgagcccacagaggcatatcctgcggggatgctgggctcccagtgtggttggcctgaacaaaataaagtgttgactcctgggcatctgtgccttctctatggccttgctacctgggattccagagagttgatggggtgcagataggggtaggactgttagaatagaaccaacccaaactgtgtgtagtttggggtgtatacttctatttctcttcctacatgtctacatgccatgaccttcctcctcctcttcacttggccagtttcagctcacttcctccaggaagtctttcctgatatatcaaactgaaacaaatgctcctcctccatgctcccttaatccccatgcttgtcgattatattcctttgccaattcatttctctatcctgtgtatgtataagtgtgtacaagcattcaagaaactgatgaatgatgaatgaatgaatgagccaaagaacaaataaatgagcccacacaccc

SEQ ID NO: 1773 - DNA, 612080 bp, Homo sapiens
tataagtatgtcccaaatattgtatgggcaagcctggagagttgggggcatatcagagaggctgcttggaagaggtgaccaagagctggccatgagaatgagaatgaaatttctttcattctcaaaactcatgcatgaaacaagctggaatgagaatgaaatgaacagatgcaacgaggctggcattcttgctaaaccaaatactaggggggcagcttctttacttgggggactcagcagtgtgttcttttttcataccctttaccccgtgatctggggtcatgaggagcccagacctccaccttgaaggcaagagatgagaaattacctcagcactgatttttctcattcatttaatgagctttggcccaaaatatccgtatgaatcagcagaagagtagttgtttattttcctactgtttttgagaaggaaaaggacccaagctggggtcctctgagctttcccccaacctgacctgtttgttaacagtctgcataaagccattggtcacagcgtgaatttgtgtcaaagaagcatttgaagtggtttgctttttttcctctttatttctgtggggcattttttagaccaattgatttgcaggaactggtagggtgtttctttgttctctctctgctacctggcaggtatcaagagaatgttttctctgttctttcagaagaaaaataaagtctgaaaattcattggtctttgatacaagcctgggctagttactggggtcgggcaggccaggtacagcttcattaagggaatctggtgatcaggatatgtcccccaataatgggagttgctaagtccccaaggctgtcaggcttagcaaatcatacaggatgcccagttaaatgtgaatttcagataaacattgaataatgttttagtataagcatgtcccaaatattgcacagggaagcctgaagggttgggagcctatcagggcaggctgcctggaggagtggaccacaagctggtcctggagtgagagtgaaagtagtcagatgcagtgaggccagcattcttgctgtaccaaatattgtgggggacatatttatgaaaaaaattatccattgtttatctgaaattcagatttgactggatggcttgcattttctttggcaactctacaacccaacttcaacccaacttcatccctggctgagccctcctccttccttctcctcctagccagcccccgtactatgattaattctgcttctgtttcatctgtaacagctggttccatctccactgaaaactcactggcgacagtggagtctgacgtagtgatgttcgaatcccagtaccagcggttaagctgggtggccttaagcaagtgacctcatctccttgggcctcgattttttccttttcgaaaactaggagagcaagagtccaccttgacctcaaatgaaatgagataaagccaatgaagtacttcggcagtgcctgacacttccaatgtcagcccttcttcttcttctttcttccttctttctttttcttctctttctcctcctcctcctccttcttcttcctcctccttcttcttcctcctcctcctcctcctcctcctcttcctcctcctcctcctcctccatcatcaaggatggcagcattgggcaagttgggagggcttagcctgctccccaacagcaagacacgctacctagccactcagttcccaatccatgttccttggcagcacgtcttgttttccctcttactgaatttatctctattctcttctaattcatatttttaatgaagcatctgtttaaaaaaaaaacaaaaaactaaattatggctgggctcagtggctcacacctgtaatcccagcacgttgggaggctgaggcgggcggatcacctgaggtcaggagttcgagaccagcctggccaacatggtgaaaccccatctctactaaaaatacaaaaattagccaggtgtggtggcacgtgcctgtaatcccatctacttgggaggctgaggcaggagaatcactgggacctgggaggcagaggctgcagtgagctgagatcacaccactgcaccccagcctaagtgacagagcgagactgtctcaagaaaaaaaaaataacgaaattactacatacttcctatggagaaatcagaaaaaacacaagggcaaaaccaaaaaccagaatacacacacacactcgagcaaaccagaaaacaagcgccattcacctcaccaccctgagaaacccactggtcctatacctgcaggtgttcttccagtatttttcctgcaaatattttacataattcataacaaactgtatatcattaaaactttctggccgggcatggtggctcatgcctgtaatcccagcactttgggaggccaaggcaggcggatcacctgaggtcaggagtttgagaccaggcagaccattatggtgaaaccctgtctctactaaaaatacaaaaattagccggacgtggtggcgggtgcctgtaatctcagctactcaggaggctgaggcaggagaatcgcctgaatccaggaggcggaggttgcagtgagccgagattgcgccactgcactccagcctgggcgacagcgtgagactccgtctcaaaaaaaaacaacaaactttcacaaatattatttttaatgaccagacattcatggaggggacgtggttcaccgaactgctgtttccctaatgtccatttacatggttttatttatttttattttttaattatactttaagttttagggtacatgtgcacaacgcgcaggttagttacatacatttacatggttttaaacctttttgtggttcttagtgataaggtgggcgtctggcttgtattaccatctccgactcccaaacctccgtctaaggagatgtctccagttatcgtctttcctgttgtctccttgctaacagtctcccatctctgatcacactgtttgtttatgatttgtctcccctcggccctaagttccatgagggtgggagtcttacttgtcttgatcactcctgaatagacaaggcctagcactcagccaggcatacagcaagtgctcagtaaaggtatgttgagtaaataaatgaacgagcatgcccaactcaccaccacttaactaaaatcacatcttttcaattttcgaatcgtttgctactgtggtcagcagagatcggttaattaaactttattttctccccagtatcatttcactaggtctttggggatctcatgtctgcctttggacccactccttgggtcctgggagctggggcagttgctgggaatctctgaggacccagagaaggggattagaaagcctgggggtcccatccctcagtcattgtgggcagcctggggtcctcaaatctgggctgagtagtactgtggacccagctcagtgggtgaactcactcaaccccaccatcagtggctcttatttggggatggtcgctagaagctcattgtcaatggatatttattgatcttattagatgccaggtattggcacacagaaataactcaactgggtctcacccatcaagtgactcacttttgggaggtggtgatgggctgccatgtctacatcaacagatcattccaagctggagagatatgtgcctgagtggaggtgtatgtaggctgaggccaagctgggaggaggagaggcatatcagggagagctgcctggcggaggcaaccatgagctggagctggactgagaatgaattagacaggtgcagggaggccagtgttctggctacactgagcacctgatgcaaaggtaaacatgaatggccagccaaagcaaggaccccagggtaaaagtgtggagatccccagtgtggcgctggccgggtcctcagaggctgtgtgtacccggtgactgccagtttctcctcttagtcctcacactgtgcccttgctgcctgccacattgcagcttgtaaatggaacttacttgagatctgccaagcaccaggatacatctgaaatcacaaagctttcatattattttcgtcttctctataatttcttttttgcaacctagcctaattttttttttaaatgtgcccagcagcagtggtaataataataataatccttgccacccagcagtttgcttctggctgtcacattccaggccttggcccgaggcacatttattttttatgacccagttgtcaactgttagggaatggtgcccaaatggaaggatgagggatcactcactcgtgccaggggctctgccaggagcttgcttttacttaattctcccaacggttctttaaataaggaattatgatcatatctgtttttcagaagaagtagccaggctcagagaggtgaagctacttgcccaaaggcacacagcttttaagtggtggagtcgggactgggatccaggttggcctgactttaaatttggtactttcgttcttcccactgtcatctcagatcacgattcagatcgtggctgaagacaatgtgctctaaggtctggtccacgttcactcttgggtcacttctcccagcctcagtttttcacctgtgggatgggtaaagcaacacccttggatgacaccaaggattgggggctcagtgacacttactgaccgtgcccttccccaaatgggtggccttgggcaagtaacttcacctctctgagtctccattgcctcctctgttggttggagagacctatgcctgcctcgtggggaaaaagcacccagtacaacagaatacgtgctcagtgaacactttctctcctctccacttaaatggactcttgatgctgagataagaagtggattggtgagatgctgagcgacgggtagggcagctcctggctgtggactgacacctgtcctgccctccctgcagtctccatgaggttcactggcctgtgcgggcacctatgtgatgtttcttttttttttcttttcttttttttttttttttgagacagagtctggctctgtgcccaggctggagtgcaatggcgcggtctcggctcactgcaacctccacctcctgggttcaagccattcgcctgccttagcctccctaggagctgggactataggtgcgcgccaccatgcccagctaatttttttatttttagtagagacggggtttcaccatttttgccaggatggtttcaatctcgacctcgtgatctctctgcctcggcctcccaaagtgctgggattacaggcgtgagatgcattgaatcagtgtccagcattttcctccccaagttagctcccgttccgggaggcagaggggtgggaatccttgggcaggttggttgtagaaacatccttccattcagttcctttacccctgcccaatgtctcccagcccatggtgtgtgctctgtgtgtcatctctttgcacacctgtccccttcagtggactgggagccccttgagggcagggtcatacccgattaacttgttatagagtatggggcatcaacttgggcagcaatggggaacggtgtctctggaaggtggaacagcctgggtgaaggcatggaaggagagaggcagcagtaagtggaaaccaccgtttattgagtaccactgtgtgctggcctctgtgctgggtgctttacacacataaactcatttagtcctcatagcagccctgggaggatgctaagatatgatttccattttatttatgtattttgtttgagacagggtcttattctgtcatccaggatggagtgcagtagtgggatcatagctcactgcagccgtgaactccttggctcaagtaattctcctggctcagcctcccaagtagctggggctacaaggacatatcaccatgcctggataatttttatatattttttatagatacgagaggtcttgctatgttgcccaggctggtctcgaactcctagacataagcgatccttccaccctggcctctcaaagcactaggatgacaggcatgagccaccacacctggccttatttcttctttgaagaagtgcaaactgagcctccatgcacggggcaagggacttttgcaaagtcacatggttgggagtgcagagtctagagggcgtccagctctgactccaaatccaaacctggcctctctctggattgtaggaatctcctgggcgctctaagcccagcctggtttaatggagagagaatattttggattttattttcttttaccaaattacctgaagactttgattgaccttgagactttacctcagacaaaccctgggcatcttacaatttgaattttatccattgatttttaaaaattgaggtaaaacataaaagtgtataacgtatactaattttaagtgtacaactcgatgtttatattctctctcccatattctttgtctctctcttttttttttgagacggagtcttgctctgtcgcccaggctggagtgctgtggcgcgatctcggctcactgcaaactccgcctcctgggttcacgccattctcccgcctcagcctcctgagtagctgggactatgggcacccgccaccacgccaggctaattttttgtatttttggtagagacggggtttcactggttaaccaggatggtctcgatctcctgacctcgtgatccacccacctcagcctcccaaaatgctgggattacaggtgtgagccaccgcacctggcctttctctctctttcacccaggctggagtgcagtggtgtgatcgtggttcactgcaaccttgatttcgtaggctcaagcaatcgtcccgcctcagcttcctaagtagctgggactacaggctcatgccaccatgcctggcagatttttaattttattgtagagacagggtctcactcttgctcaggctagtcaactcctcccacctcagcctcccaaagtgctgggattacaggcatgagccaccacagctggccatgttattattattgtttattatttatttatttttttgagatggagtctcactctgtcacccaggctggagtgaggtggtgcaatcttgtctcactgcaagctctgcctcccaggttcacgccattctcctgcctcagcctcccgagtagctgggactacaggtgcccgccacttcgcccggctaagtttttgtatttttagtagagatggggtttcaccgtgttagccaggatggtcacgatctcctgacctcatgatccatccatctcggcctcccaaagtgctgggattacaggcgtgagccactgcacccagccaatgttaatattattaaacacacatcagcaactatctgccagatcaagatacagaacattcctccttccatgaaaggctcctttgagccccctcccaggcaatctccatcagaggtacccatctcactccagactaattgtctcaacttctcttaccatgttagtttctcccattcttgaactttgcataaacagaagcacatgggatgcaggcttttgtgcctggcttctttgactccacactgggtctgtgagatgcctatatgtggctgcgtgtctcagtggcttgttctttttcattgctgtgtagtgctccatcgctgtgctctgggtataccactctttgtggctccattctcctgctgatagacatttgggttgtcagttgacttattctgttcacttgacttctttctgttttcatgattttgatccaaagagtttcttttgtcagggcactctgcagaggtgtttgaagaacaattggctctctggaaatttaagaaactatgactgttttcatgatcctaatcattttgaatcagaaacatatatatttattgatccatgtcttctgttcagaaaaaagacattgggaggggacaaggaagagaaaggagcaaatgagctttagtggaagttttctcattcttctcttcacacaagctacctggtagatggtggaatccttctgtaatttaaagtcaaatgctcataggccacagtgggagccataataaatgtgtgggcactgtccttttggcgccctttttctgctactttgagatctcataaataacagagtatgttgctaagatgccttccgtccctctgtttgctccagctgcagttgctaggttgagctcctggttgctagggattttgtgatcctgtggcggcccagaaatatgatggatcaatggaacatgcttttgctattaactgaaatgtttcccaagcaaatctcttaatgtcactgtatgctttgacgtcgtcccaattggttgatgattcttgcaagtttcccagttagaggaagtggcttgagtggaggggacaagtatcttggactgggaatcagttcaagaatcagaaaagcctgcttctagtcttgtatctgatactaatttgctgtgtgaccttgagcaagtgttacccgctctctgggcactggttgctgcaaaattcaaagacttgctggctttaacagcttacagttcatcacccaagttctctaagcaggccaagtgcaaatcagtttctcattatcggctggtggattattgacaaaagaattcccattcccggctcacttcctttccacccagcaggcttctgggctgagtgtccttggccagatggtgtgtgcatagtagcttcagactaattttaatattcaatcaaacataattggaatcataaatcttaaaaaaaaatcctataatccataaacatctgatcatgtcattttctgtttccttctgttaaaatctttggcaggctgggtgcagtggctcacgcctgtaatcccagcactttcagaggccatggtgggaggattgcttgagtccaggagttcaagactagcctgggcaacatagcgagaccccatctgtaaaaaaaatgataataataaaataaaatcatctgggcatggcagtgtgcacctgtagtcccagccacttgggaagctgaggtggaaggatcgtttgagcccaggagtttgagactgcagtgggctataatcacaccactacactccagtctgggccgtagagtgagaccctgtctaaaaaaaaaaaaaaaaaaaaattagcagttttctattgctgcacggaagacagaaaacaagtgccatttcctttagtgggaaagctcagttggtggtggctacaagaagcagtatcctgaaaggaatctggactcactggcttgctgtaggatcttgattgattaatgatgtctgttatgagctcaggaatatcgtgggggcacgtatcagtatttaccaatcatgactggagtttaaagcccacgccctttagtatcatggttgaggccttcaagggtggcccatgctggcttctccagctttatcttctccccatctctatctgacccacctccaaaaataactgcttccagacggcgtggtggctcacgcctgtaatcccagcactttgggaggctgaggtgggcagatcacttgaggtcaggagttcaagaccagcctggccaacgtggtgaaacccttctctactaaaactatgaaaattagctgggtgtggtggcgggtgcctgtaagcccagctactcaggaggctgaggtgagagaatcgcttgagcccgggggcgcggaggttgcagtgagctgagattgtgccgttgcactccagcctgggcaacagagcgagactctgtctcaaaaataaacaaaacaaaaataactgcttccgtcgaccacctattgtctccccaaatcccctttgctcatgtggttccctttgcctgttgggacttctattatattaaattggccaactctgcctatttatctttcaaactgctatcacaatttgatctgctctatgctattccctttggctgtcttgggtgggattaattaccccttcttcctctgatgtcccatgattctctgcatagacctatagcacaacttaccctacagagcctacctctaggccctacctatagaccctatatggcctatgtatcaacctgtacccatagcctacctaccacttagcccttttcatacttagttgcttttatgtctctttccagttctaccttgagagggcctcaaagtcaaggtctgggctttgctcatctttgcatccccagaccagagccccgcatagagcagagcttccataaatctgtaatgcgtgcacacatgaaggaataaaagccacactgcatttcaaagtcagagaaaaatgatttggataactttcccagtcgcctgagtttgtctgtcagtactcctcagcttaattgtgggtaatttattgtggcaataaaatgacccccgcattccttcgagacggagctcagcttcaagttgtgagcttgtgttttctccatcgcgatggccttgttttcttcctctctccctttgcccgcagcctgaagataaacagaaggcggcagctgcctttgcccagctccagggtgccatggagatgctcggcatctcagagagcgagcagcgggctgtttggcgggtcctggcagccatctaccacctgggtgcggcgggggcctgcaaaggtacgtccttcctgccgggctcacctgggagggcagctgtctcctttggcaggtgcctgacaaggcccttctctcggagcggtgggaacagggtcaatctgtcaccttctatgtctctgggacttcccttggggaggctgctgaaactaggcgtcgtgaggaggacacagggctggcttttcaagcaaaccttctagaccagctctgtccacaagaactttctgcaatgatggagattactgcggttcagtgcagtaaccactagccacaggctgctactgaacacttatatatagtagtgcgactgaggaattgaatttttaattgtatttaattctacttaatttaaatttaagtagtcataggtagccagtggctactgtactggcagtacagtagggcagctctagaatatgcaagggaaggttgggtctctgcagtaaaggtgctgtgtttttttctttttctttttaaaattttcattgagatagggtcttgcattgttgttcagggcagtagtggtgcgatcatagctcactgcagcttccacctccttggctcaagcaatcctcccgcctcagcctcctgagtagctgggactacagctgtgcacccccatgcctggttaatatatatttttttatttttttgtagataggggtctcactttttgcccaggctggtctcaaactcctaggctcaagcaatcttcctgccttgacctcccaaagtggtgggattacaggcatgagccactgtgcccagccaaggtgctgtgtttctagttagacatcctggagatgttccctgccacatgccctgaaactgatcttgtatccttgtccccatccttaagtgtctgcttgcgattttccccattttgacctggtcttccaagtggttcctgccatccccctagttcttaccctctccgtatccaatcattcactatgttccagagatagtctctgtgacatcatttctgtcctagtttctctatccttactgttatcaccttatgcggtgtttacgtttgtgtgtgtgtgtgtgtgtgtgtgtgtgtgcttggataggtgcagtagcctccttgctgatacctgcattcctcctcctacccattctcatcatgaccatcaggttcctttctacaacatagacccgtaatgtcattctccgcttagaatcctctggaggctctcccttgcctccaagtcaaataaaattccttggcttggcattcaaagctcctcacctcctcacctcaaaagctgctcccttttttggcaatatagaaggttctggggagagagtggggatgaagagcaagggtttctgccttcatggggcctttggtgcattgtattatgattgtgactttgtctagctcttatcagtggctggtggcttcctttgggcccagagcatagaactggaagttgcttattgaatgaacatgtgtgtgaattgaggtctgtcctgggactgtgcatggattctggctgacattctgggctgttaccttggcgggggcagtagaatcttcgagaaggtgctggtgcatcctttccgtcatccccacattcccgggccctgtggcctattcctttgattctcatccatttgagccacatacattaacccattgttttgattttggaaatttgtagaagtcatactgagtcaggagtaagtaagatggggattcaacagttgatccaagccaaggacagacatgctgggctggggcaaatatgaaaataccaaatgccacttgtttttccaaaaatcatccatggacattcacaatggcaaagatatggaaccaatctaagtgcccatccaccaatgagtggataaagaaaatgtgagatatatatatatacacacacaccatggaatactactcagccataaagatgagatgaaataatgtcttttgcagcaacttggatggagctggaggccattattctaagtaacttgagaatggaacaccaaatatcatacattctcacttacaagtgggagctaagctatgaggatgcaaaggcataagaatgatataatagactttggggactcaggagggggaggttaagagggggtgaaggataaaacactacatatttggtacagtgtacaccgctaggggggttgggtatactaaaatctgatcaatcaccactaaagaacttgaccaaaaaccacctgtacccccaaaatgattggaaaaaaaatcagccgtgggccatgctcagcgcttggctgtttgggcatcaccactactttgttcagggaactgtaatgtctctcactcaacgtcctggtcactgaggccaacctgagtcagaaacagacccttagacagagatgtgggaacatgttgcatatttggggaaggaccccagaaggctgtggcagggaaatgggaaaatgacacaggagagggaaggcaggtagtataaggtgcatgaaggagtggcttacccctgggaaactgaggctcagtccagctggggacccctgggagactctgaggaatatgcctcctggttgtcctatccaagagacaaggaagttgagatatttatccagagactaagggggagccccctggcttattagcctgtcaccagggaagtgtaggagctcaattttattcctgagtttctcctcctggggcagagtgggggggcccccgccccctgatgtgggctcaaggacctgacccatcacatcagtgcatctgatgataagagaaagtcacttttataaatattttactaatacttgatgatggcaataatttctgccagtcctccccctatcccacgttataaattattttaagaagagctgccgtcagtctgcctgggaggcctgcccgatgatttacttacttatatattctgctttgaaagatttcataataggttgctctaaaatcagctattaagaatttcaaagtcgtacataaatgtctttgctttgtgtcataacagatcattttgaaatatattaagaatcattttcattaatcaggtttttttttcattaaaatgatactcccttctcagtgtgcctggcttcctaactaattctgagagccccaatcctgtttttaaaaatcaataatagttccctttggggagaatttgggccttataactggacacagggtttttgaactgttatagcaatgacaatcaccactaatattggcctggtgtttgacagtttcaaaagcacttatacctctattatgcccttggattggattagatgtatgtgctaacttaatgggcaagagtcaggagtcagcctgctggatatgaatcctggctcagcctctctgagcctcagtctcttcctctgtaaaatggggctaatgatggtacccactttgtaggcttctcgtgagaactgaaggagtcagtggcaaaaactgtggtacacaggacttggctcctggcggggtgtttcataagggttcattttcatccgtctcattttatagacaagcaaacagaggctcagagaaggtatgccactgatctggtatcacacagccagtaccttccagagtggggtttgggccattctcattttcctggggccattgtgctgagtgtttatagacccgatgatgtcaccacctccttagaacagcctgggaggggtgaggactgttacgatgcccattttatagggaagaaactgatgcgcagcagagagtttcacgcatattcctcaggacatagagctaaagctagagatgggatttggacttaggtctgcctgagctctgagccctgagaccagcctctgggaccacacctcctacctcccacctcccaagtaccctgtgttcctgcctatggcaggcctacaattcacctcaattctgagactatcctgagttagcagagttaacacagaccctgcaggttaaggattcaatcctacaagactgtctccacttcagatgccagctgcaagtacccgacctcccatacttctagccaagtggcttttacatagtgagttctcatgacccccttctcttgtctaataattcactagaatgactcacaggattcaagaacacactttacttacaaccactgctctattataaaggatacaactcaggaacagggcaagggatggggagagggcagagactcctgtcctctctaggcatgacagccgacagcctcccagcactttgatgtgttggaagctctctgaaccccatcctttaggggtttccatggaggtttctctatgcaggcatgattgatcaaattattggcaattaactcaatctccagctcttctgtcacatcttaaaaagaaatcctatagctgggccaggcacggtggctcacgcctgtaatcccagcgctttgggaggctgaggcgggcagatcacaaggtcaggagatcgagaccatcctggctgatacaggaaacctcatctctactaaaaaaaaatacaaaaaattagccgggcatggtggcagacacctatggtcccagctactcaggaggctgaggcaggagaatggcgtgaacccgggaggcagagcttgcggtgagctgagatcgcgctgctgcactccagcctgggcgacagagcaagactctgtctcaaaaaaaaaaaaaaaaaaaaaaaacccctatagcctttagctattgccctctaaacacccatccctaagcaatgctttcccccagccataaacaaccatgaatctactttctgtctgtagatttccttgttatggatgtttgacatgaatgcaatcatgtaatatgtgcatatctttgttgtcttttatgactggctgctttcttttttctttctttttttttttttgagacagagtcttgctctgtcgcccaggctggagtgcagtggcgcgatctctgctcactgcaagctctgtgtcccaggctcatgccattctcctgcctcagcctcccgagtagctgggactacaggcatgtgccaccacacccggctatttttttttgtatttttagtagagacggggtttcactgtattagccaggatggtcttgatctcctgacctcgtgatccgcctgcctcagcctcccaaagtgctgggattacaggcgtgagccaccacgcctggctgtgactagctgctttcatgtggtgtagtgtttgcaagagtcatctattttgtaggatggatcagtattttagtcctttttattatggctgaattatattccatcatatggatataccacattttgtttacccatggaccagttttttttttcttttattcttcctgagagctgggtcatagtaactgctcagaaaattctagtagaatgtatgccccaaactggcttgcacaacaggtaaaattaggcccattttgtaaaggagagcccagaggcagagcggttctgtgatgggtcaagtatgtatgtgtatgccaagaagactagactttgcagtcagccacctccagccaagtttcagctctgccttttaatggatgtgtaatcttgaacaggtcacttcccgtatctaagcctcagttctctcatctataaaatggggacagctatgataccttctctatagggtgaggagtgatgaaacgcaacgatgttcataggaagccattagttcagggctttgtggttctggaaatgtgtctgttttgtttgtcctgcagatcccatggtagacataaaccagtcctctgggtctgtgtccccagtcctctcttaaacttctagccaattactctgaacttgttggggtttacactattttgacctcaacttacggtaagaaacattttacctcttgacccagtgaacacacacacacacacacacacacacacacacacacacacacatattttatagagactaaaccacagagggaatcttctgtattcgtgagtttgaaaaaagaaaaacaaaaacacgccaacactggcaggtagctacaaccatgcccagaaactcaccgtggtaaatccactttctctgcagctacaaatcccattttgggttttgtttcacctttattttgatttttaaccttatacagtctctccacctggccaccagagtggcccttttcacacaaaacccagcccacaccattcctctgtccccatgcctgcccaggttgctcagaggcaagctaaggcagccacaaagatctccaagcttccacggaataggggagcaatgattcccaagcagtctctgtgctgagttacttgctagatcaccggacctgaggaaatattcaagataatgccttaaggtgagtgtggtgcagttgtggctcagagaggtggtgtgacgtgcgcaagggcacacagctgggaagtgatggagcacaaagctgcttgaacctaaggctctcaggctttacacagggaccaggacccttcttagttacattagcatagttgaggttttcttctgtgtgtgtgtgtgagagagcactcctgaagtctaagcaattctcctgtgtgtggaaggtagcttttggcacaagccaggtgggctcaggtggacaccctccatataaacttcttggttgtccagggcaactgtactttgctcagcctggatgtcagggggtggccctgctctgtctggcaaggtcccggcagcgagaaggctcctgaacttgcattagatgttgcctgacagccttggcagatggggcactgtcaggactgtgagatcggatatgatggaagaccgtgggcatcacccatagacccctaattgtctggttcacctaggatgtccatgctgcgcaaaaggtgtggtgggcttgcctgctgaggagggctcagcgaagggcccatggctgtgatgggcaaggagatgctcatctctcagctcctctggtgtctggaggtcaagtatggcctcccctttccctcactcctcatgtacaggttctgagcgtgccctccctgtgcccagctctcagtggggatggaactgggcagccccatgttaaggcacccttcccatgccagccccacgttgtgatttagcacatggcatcccattcgctcctccagataaactcatctgcattctgcagatgaggaaactgaagctcctccaggagaaaccacttgcccagggcacacaatgaggctgcacccgagcttggactgggactcaggtctgtctggctccaaggcctcttccttccactgcagcatgcaaaaaggatggtcaaaggacaaatgttccctgtttggggactctcaggttggaccagggcaagatcgctgtggatttattcttggagcctcagctgggagccctagagctctctccagggatcctcgtcttatgatcacgtcacccaattggacataatctctgtcctggaagcctggaatggcttcccagctagtctcctggcttcccttcttccccatcctttctaccccgatctgttctcatgccgcagccagcaggaactcccaagttcacacgtttggttgggttacttcagtagagctaccgatgaccctgtatgagggcaattccagctggtctggtccctgcccacctctccagcctcagtttgcacccatgatgctgtggctcagctgcagaggatgtttccagtttgactctcttgctattccctgcaagagctgtggtatggcagtcttgtcctctcccgctgtccctacttccctttgtcaacccctcagctcttgattcgaaagtcactgcccccacaagccttccctggccctgagcaaggtctggttttcctgctctgtatgctccaggcattccctggccacctttatttatttttcatgtgggacgattgattattggattaatgtctgtctcccatgctgggctgtagctctgtgagtacagaggtcttgtctgattctgctcatcgttgcatccccagggcctagcacagggcctggtacatagtatgtgctcaataggtatttactgagccatgtgacttcttggcaactctcaaaggagggagaggttgccctggaatggaggtgcgatgagggatgtgaaggggttgtgcacttaatcacattggcaggtgaaggagagggaccatgcaggaggacagacagacaagggcactgaacgacaaccactcggctactgtgggcatcccctcttgccctgactctaggacacctcccatcacaggacaggtggctcctgggcttagtcagtttattacagatttgtctcgagaggctgggcacagctggcctttggatcttagaagcctgctcttgtggtggcaatgagactgcatccctccctctgcctgcatagtatccacacttcctttctgtctctctggcttgccatcactgatgggttcctggggaaggcagcgggagggggctctgagggctggcaccacatggcaggcagaaaacaccaggtgatttgacatcgtggttgatttgctgttcgccaaggctcatggctcaagccatcactccaggtccattagacaacaattcatccaagctcatgcttctctcctttggcaaaaagtggcctgtggaaccattagctggtgcttgtgtatttcgaatggcaggcaatggatgctctctggagctaaacttggtaaagagagagtagggaggaggggagagctggcttcccagaactggacagagaagcatttgagtccaggctccctgatctcctggcagtgtgattcaccctgtgtcagtgacttttcatctcgttggacctcagttttcttgtctgataataactccacctaccttctacaatcattgtacagtcagataataaatgtttagtacttggcacatacgaggtattcagtaagcagtaactctcttttctttgcaaagcattttggttgtcatttctttctgttggcattaaagcctgcctctgagatgggcttggtgagggttgttaaacccatttggtgagtgaagaacttgcacctctcagaggtgtggctcctcacctaaagtcataaaatgaaacttctgtgctagagaacagcaagttcagaaccagaatccagttctagactctcagctcagtgctctttacacagcttagcagaaggcccgagaggccaagggtagtgtagggcagtggttagagcacagtctagagtgacacagatctggactcagattgaagtaagaattccagcactggctggctttgtggctgttctgttacagtgctgctgaaggaatcagccccaaagcccatggcttgaacaatcactttattatttcccaaggcttctgtgtatctgtactttggaagggctcaactgggaggttttggcttggggtctctcatgtggctgcagtcaactggtggctgatgaagcgtaggaaggctggaatagcccatttcccaggcttcatgtggtctcaggtctctccctgtgggctagttgggcttccttatggcatggtggcttcaggactccaagtgcaagtttccaggaagcaagatggaaggtgcatcaccttttctgagtggcaacacttctgccatgttctgttggtaagaatcgtgtcacaatttcaaggatgagcgaaaccaaattccacccctagatgaaggagcagcaagattctaggacgtataggatgggagctattggcgtggccatatcttgccatagtggccttgagcaagtaacttaagctttctgaggctcagaaaactgaggctcagttttctgagcctcacaggtctgttttgcagatgaactgagatgctgtttgccaagagctttggggtacagtgccaggcatgtaagtaagagttagattttaaaaatcataatgttgcaaagtttccatagccaatgcatcccggtccctactgtggtggggatggaatggctcctgagacttttgctctctgttttattaccagtgcccccgaccattctctgagacccccaaaagaccttcttcctacagaagagtaaatcaaggatgaactctatgtcctctttgcagcaagatacgatttctctgtcttggggcctcttttcttgtatgagattaaaatcagacacaatcctcttcccaggaatgacctctgttaaaatcctctccaagttttccctgttctccacctcagccccaggctggggatcactttgcataaattctcacttttaattctcacagcaaccctgacaggtagggaaggagtcaccatttttgtggtccaagatgctgagtctcaggatcttgcaatctttgtcaaagtcaaacagcagcatgtgatggggccaaggtcagaactcagtacctgtctgcctccaaagttcttgctcttctccactacaaggccacccagctggccaagctggtgggtacattctgggtgctaggatctccaccctctctcctgagagcgcctcctcagctccatctaatctccatccagtccccaatttggaaggttgtccctctaagcagaattgaggagagctcagactcggggctaaaggcatggggtctggaaccaggctgaccagtgttcaaccctgtttctcctgcatggtccaggtgactcctttgacctgtgagactcaatgtcctcatctgtaaagtggggataatcagagtgcctgcctcctagggttcttgtgaggctgacattattgaacttgagtatttaaagctgtgtcattgctatcattggcattattgttattaacgaaaaatcagtccagggcccaggagagttttccccagcaacttttagaagaggctgacctgggcggttttttttgagacagagtcttgctctgtcacccaggctggagtgcagtggtgcaatcttggcttacagcaacctccgcctcctgggttcaagaaattctctgccttagcctcccgagtagctgggattacaggtacctgccaccacacccagctaatttttgtatttttagtagagatggggtttcaccatctcttggccagtctggtcttgaactcctgacctcatgatccacccacctcagcctcccaaagcgctgggattacaggagtgagccaccagcctgggctggtctttaaccttctctgatccctgtggtcctgtagctgtaagagttgatgtgcatctccctggagaatcagactattggtccacctgcctcctgtccctcaccacttgacagaaatgacagtaatgttcggaactcaaaatagtgacaaggatgagcaatgcttgtcttgatgggggctttgcttggtttcctttttctctgaaggcccatgggttatttagtttatttgtctctcacgaaatttgccagtctacttgctgctgacccattacttaatatacgacgcagtcagaaccaaatatatcccagcgaggtgccccatgatggggttatgaagggaggctgctatctagctggcacctcactccccgcctgctaccatcataaagttatcagtgctggaatggatggggctgtaactcagggagccaggaggtgctcatggggaggagagacaatatcaataatgacaagggcccagtcccacacagaactgggataccccgacaccagtagcaaggacggtccatccaggggtaggaagaagtggctggatgctcttcaagctgtggtaagacctgagtgtagatggtcagtgatagtaacagagggactgttaacataacacaatgaccatatattcaagagctttgggaagtgttttaccagtcttattttaaagcaatcatatgaggaatacgtcaatgttgtatgtctataaaaaatggaaatagtccagaagaatagaaagtttaaaaaaaaaaaaaaggtctttcctcacaccccagtgccaaatcccattgctatgaaaggtgaccactgtgaacagtttggggtatacccttccttcaggctttttttttttttttttgagacagagtcttgctctgttgcccaggctggaatgcagtggcaccatctcggctcactgcaagctccgcctcccgggttcatgccattctcctgcctcagcctcccaagtagctgggactacaggcgcccaccaccatgcccagatgttttttttgtatttttagtagagatggggtttcactgtgttagccaggatggtctcgagctcctgacctcgtgatccgcctgcctcagcctcccaaagtgctgggattacaggtgtgagccactgtgcctgtcctccttcaggcttttttttttttttaataggctataattttttttttttttttttgagatggtgtctctctgtgtcacccagggtggagtgcagtgacgtgatctcggctcactgcgacctctgcctcccagtttcaagcgattctcctacctcagcctcctgagtagctgggattacaggtgtgcgccaccatcccagctaatttttatttatttatttgtagaaacagggttttactatgttgctcaggttggtctcaaattcctggcctccagtgatcatcccgcctcagtctcccaaagtgctgggattacaggtgtgacccaccgtgcttggccgactttaattctgaaagcattttagatttacagaacaattgaacagaaagtacaaaattcctacataccgcttctccctgtccccacagctctccctattactgatatcttgtgatgaaccaatactgatactctattagcagcaaaggtccatctatactctttctgttgtgttccttgatgggttttgacaattatataatgtcatatatccgttgttagtatcatacaggataatttcactaccctaaactggctagttttgtttttttcttaaacttttttttttcttttgtgagactgagtctcgctgtgttgcccaggctggagtgcagtggtgtgatctcggctcactgcaacctctgcctcccgggttcaagggattctcctgcctcagcctcccgagtggctgggattacaggtggccgccactgtgcccggctatttttttttttttttgtagttttagtagagatgtggtttcaccatgttggtcaggttggtcttgaactcctgacctcaggtaatcctcccacttcggtctcccaaaatgctgggattacaggcatgagccaccgcgccaggcttttttcttaaacttttgatttgaaataattatgcaatcccaggaaattgtaaaaatcacacataacattccatgaaacctttcccagcagcccccagtgagggcgtcatgcatagccgcagtacatattgaaaccaggacatcgacagcggtgcattactgtaatccaagcagccgtatcttcaggcctcaaaactgagcatttaactacatctatgcatttaacacatatgtggattaagtggttggttattgctttttatgccagtgggttcacaccacctttgttctatgccctttgcttttttcacatgtcatatcttgccttgggcctctttccacattgcttcatagtgatattcctgattctcttcgtcagctgcaggggactgtccagaatgaatggacctctgtgtatatgacagttctgttcatgagcattcaggttgtttcttgccattttggtattataaataacagcacactgaacatccttgtgtacagacagttgtgcgcattttggaggcatggtttcctggcaggggaactgttaggtcaagggtgtgtccagtgttcaacatttcaatgaacccacccaattcacctccctggatgttaacacggacaggttgactcatttagccctcacaaatctatggggtaaatactatgaggttatcatttccatctgtaggtggggaagctgaggctcagagaggtgcagccactaattcagggtcacacagtcccaagtggcacaaagctggactctctgtctgccatgcactgtgtcattgggggtccaaggaaggcttggcatttttaaagggacttgctctttccactttaaggatgctacctctgtcctctcctccaagacaggcctggcctgtctgcatctctgggctcacatctattttcttaggtgaagaatgcggggctcagaagagcccgaccaggtgcccatctggtggcttctgactgcagctcataactctgcttggctctcctccaattctgagaggcttctcccttccttctccacctccatcccagctgcttccaccccttaatgaggtgagcttcaccctgtaatgaggtgctccaagcccagagtacatttacttcccctacatttttcctgagggtgctgattagagttggtatctgggacccagctggctgggacagctttcttcaattcttcaagctctgaattaaagggtgtgaagagtggtggagtcaggagaagcgggagagctgcagggctgggcctgggtggcttctctgtgcagagggccttggacaagcaagttcagcctcccatggcctcaacttgccagggctctgccagttcccatagagatctctctgcatggttgaaagagccaaggagtcacttgcccacttggccctaagagcatccctgatgggtggagagtccaagggctggaaagggacttggactgcagtcagcctaagccgctctttgaacagggcagggaccaaggctcagagaagggaagagactttctcagggtcacccaatgaggctacaggggactcgaatcatggtcacctgactcctgagccagtgttctgttgatcttgtttgactctgtccctccttccctcctttctcctctttctcttccttctctcctttcctcccacctctcttcatccttctcttccctcctcctttccttctttctcatctccttctctcttttctcttcccttccttctttctctcccctcccctcttccctcttctattctcctctttcctccacttctcccttccctctccctcctcctcctccttcttccttctcctcctcttcttcctcttcttcttcctttttttttttttttttgagacggagtttcgctcttgttgcccaggctggagtgcaatggtgcagtctcagctcaccgcaacctccacctcctgggttcaagcgattctcctgcctcagcctcccaagtagctgggattacaggcatgagccaccgcaccctgtccctctcccttcttttcttctcctctgtgcctattggatgataagccctcaccttccaagatgaaatttcagtggaattaagaaagataaacccaggctatcttggatggtggatgatgctgggggcaagaattctgggcaggagacaaccaaagttgagggtggtcagctccactcaagggtttctagaggcagagacccttgaactgaatcttgaaaacagaataaattaaggagcgtgctctaggcagaggaacctgaatggcaaagacacagtggcttgattcagcatggagcaggttcagggtcctccttctcaatgcaaggcctagggcctctgtcttcctgttcataaagcatcagcctaagggcccctgcactggtgctgtgaacctaagggctctaatggagacaggattgccatgtggcctagcatcctggagatttcattgatccatccttggacccagtaccctcgaggcctgtcacctcctctgccccattctgcccaaatgccttcccacggctgcagaccctgcatcctcctccctgccccagctggtgacttggctctcaacctgacagctactgcaaccaggtctattctgggctgcaggcagggatttattctgcattttctgagcatgtagaatttattcataaagctggaatgctgcttgggatgtaaacaattaaatattttttaaaaatacatgctcagaagtggcgatgctggaagacggagctcactggtagtcccacaccttgggaaggtggagtgaggagattaggacacctgcgggaccctgatttcagactggttgagccactcacttgttgagtggctctgtgaaagttcctacccttcttttgggtctctgtctctcctaaataataacagtagctcacatttaatcagtgcttgccatgctcccaggcaccgttctttttttttttttttttttttttttttttttttttttttttttgagacagagtttcactcttgttgccaggctgaagtgcaatggcacgatctcggccctctgcaacctctgcctcccaggtacaggtgattctcctgtctcagcctcccaggtagcttggatccagacactattctaagagctttggctacttcaacaatctcatggagtagatgctattatcttattttacagatgaagaaactgaggctcagaggggagaaagaacttgccaaatggggtggactaggtgctctccagggtccctttttccttgattaccagataccctattcacccctttttggaagggagatagtgatggctcagtgagaactccaatatgtatgagttctggactcatcattcagagacaaagcataacaatactagcaataacaatgacagtggcgatgatgatggaatgaattgttaatatttactcagaattcatcttctgccagacatgatttaagtgctttgtatggattattccatttaatcctcataactctgtggtagattatacccattttatggatgagtaagtgaaggctcagagaagtaaagtaagttacctaaggtcatggacatagggaggggaagagcccaatctgggaccaagaggttctgtctttaaatcctacacccttattctttacatcactgaattgcagggttcataccaataaatggaattcataatcatgcctttttgtatggttgttgcattgatgagattatgtgcttagcacaggctcagacgcatggtgagtactcagaaaatgccagctactcttgggcttcccttggacccaggaaatagctttaaaggggacagtttgatagattgaatggcccctgctcagcctgccttggcgaggggcatgtgaatgtggaaagagcattagaggggaccatctagatctgggcttggtcctggactctaccttgctagctgagtgatctcaggcaagtcgtgcatagacttgcagctggtccattctttgagcctttgcccctgcaggtgccccatgtgacatcttccagccaaggtctccctgacaactctgctcctcaggttgggtcacctgctctgggacacactcctaggtagcttgacacattcaatgtcttatttcattcttaaaacaaccagatgggagaggagctaccccattttacagataaggcaactgaggctcagagagctgatatctcctacttgagatcttgcagccaggttgaaattatctttggacaatcagcttccagttctttccacaattcccaccacctcaaagatgcctccttatccatctttctcctccagcttcttgatcaaattagtttgagagacaccccaccccctcaacaggctcccttcctcttgtaaattccgcatacatgttggcatattcaaggttctgacaagtcctgcaagagggaaacctgttttgctgagtttagtttgatgttgctccaactgatttgtccataaagccttcttttcccccaaacacctgctcatagtccccagaacactgggaatggtttgtgtgctgtgttctcagttgttaaggttcgggcaatgattcatgttggattatgcataactcagcatcaatttatagatggcacatcggccaggcctttggacaactttctccaaacccagtcaggtggaacaatatgtccaggtttgtggggctgcatggcacctgagggcagcaggacctggaaggagccctaagaaacaggaatggatttgaagttctagcctctaagaatgagaaggttacattttccatgttctcaaaaatagaacttttctggttgtccctgggcagaaagccacagctgcctgaattggattttctcccggggtttctctttctgacccatttgtcatttttaagggaggaaatctctgagtgggatcataatagagttgacatttactgagcaggttgcctgttatgcatcctgcccgtataacctcattcattcttcttttatttattattatactttaagttctagggtacaggtgcccaatgtgcaggtttgttacataggtatacatgttccacattggtttgctgcacacatcgacttgtcatttacattaggtttctcctactgctatccctcccccagccccccacccccagacaggccccaatgtgttgtgttccccgccctgtgtcaatgtgttctcattgttcatctcccacctatgagtgagaacatgtggtgtttggttttctgtccttgcgatagtttgcttagaatgatataacctcattcgttcttcacaagcactccatggagtgaattctgttcgtcattcccattttacagaggaggagactgaggctcaaagtgttgacatgactttgccaacatcacgcggctgtaagcagtggaggtgggatttgaactgaggcagtctgtctccagaacattgccttttcctgtagcagctacagccttttagacttatctcttctctacaggcagcctccttcctcacaggcctccgaattgtaaacctctgtgtgaggaaaagtgaaccagatgcagcaagattataaagaagtcacataatgttgagtaattcagcaacagcacagctattgttggaaggagaaataacttggttattaataaatgcaggaggccacagtaattgatagcaattgaactcatagtgggtggggaaaaacagctatgttatttctctctctcgctctcattttgtatcgacataaagggaaaaacctgcctttgcaggtggatttgagcaactcagaaacggcagtttcattactttcccttgttccttttcctcccttcctccctttttctttctttctttctttctttcgttctttctctctttctctctctttctttcttctttttctttttcttctctttgtctctctttctgtctctttctctctctttctttccctccttcttttcttttctttttcttttctctctttctttctttctctctctctccttccttctccctccctccctccctcccttccttccttcctccctccctcttttctttccctttcctttccctttctctttccccttcccttccccttccctttcctctttcttctttttctctcatttctcttttgtttgttctctcaattcaaatcccagcctgcctcttaccaaaggagtgacctgacaaatggctcaggtgaggcagtttgcctggggtcacctggttaggtaactactctttcagctaaatcactctttccaaaaccactgtctcatggatcattagatccgcaagagattctgtaaatgcattctgaggccaactaagtctgaacagaatttctccttcttacagattcataagatatactttaaaggctctgagaagtcctgcagttaagaaacttatttaaccaagcaatgaccaaattgatatgatacaatattcatttatttcccagtgatactgatgaccattccatagaacaaccactacaaggtgcacctttggggaactctgatccccacctgtgtggccggccactctgccctgcttcacacccattctccaggagggcagtgaggaagggaaatggggtaggaaggcaggaactgtgggcccatctgccatggggacctgtttctccctagcaacccgaaaaatggctgacaaccaaaagcacagaccagaaatgatctctgcacttagctttgggatttccttgtctcctaatctccttgcctcctggtgggtggagagaaaagtacctggatagagtgtgtgatcccctctggagtgggctgggggcaggggaaaatccacttcccccaatggggagttccctttgaggaataatttctgtcctttctctctgtttctctctctctgcctctccctctttgtgtctctctgcctctctcactttggttttatcttgtatcccatcttcccttgctgtggctttgcaaagagctgatggtctacatggatggttccttgagcatggagcctgagatcagccacagccgggcagaaatcacatcttgtacctctttgcacaagaattttgactttactgggtctgttctgcatttgtgcactgcctcagagggttttggtgagatgaggcatggaaagcctttagctcagtgcctggcacataggctatgctcaacactcgatggcttgagaagaagtgacctcagctgactcagaagctctggggtgtgacccacatcccaagtgcaccaatccattatccattccacatggcctctttaaaaagcagtgaatagacaagaacctgcaggggaagtctctgcagccagcaggacaggataatcccttctgggctgaagggtaccctccttggttttgcaggtggagaagggaattgcaattttttgagcaccttttctgggccaggcactctgctgggtatctcacatgtaaccatctcatctccttcttgcaaccctatgaagaggtgttgggggttttaagattccgtttcacagacaaactgagtctcaaaaaggccgtgtacctggctttgtgcgacaaactgggaatagcagaaacaggaattggacccagatccagtttgggccaacacccatgttattgcccagttccttttctccctgcctcaggtgccaactcagggttcttgacctcccctgggaagagactttggtcactacccatgtccaagcaaagatagaagaatccatgggattggattttgtgcaccggccagccttcggggagctgatagtagaagatgcttttcctggcaaagctccctgtgtgcccacctggattgcaccagcagcatgcatctcagctgcacctgcaaatatcccccctaggtcaggcaggatttagagagtccagccagcatccattaaccactcttcttttcagaaatatcaattgccaatttcctttatgacttctcccagctcgttgaggccagaaacagttgcaagtgtttagagagcaggcatggagtagagcaagaggaggggacaggacctcacctacctagaaagacatctcctatttagttcactctcaatccccagcacaggaagaagaaagtctcattcagtgctaatagcctttaatgcctctctctaatatttgcttcttaacaaagagagagcagatttcaggctcacaggtaacagtatttaattagaatctaatgacattattgtgcttgtgtaatatttgtttctactttctatttgtggcaggtgataatgaattctcatttaacatagtgtgataatatttctgtttacagtgtatttaagtgaagatgaaaagtgagtccatttaaaagtagagtcacaaagatatggcaaaaaagatgatatttgaaggactgattttggtgaaaatgtagttcttccacttagtatcagcctgttttctggtgacttctctcaattagatttttaatctataaaatgggattaataatagagctttttaggactcttgtgaagatttaataataacaataataacaaataactacaactaataagtactgagctttttccatgtgtcactcctggaacaataacccaggcttttcaactgtaaaagtcatgagctgaacaaagacgcaatgttgaataaaatcaggtaagtgaattagatcacaccatcatcaccatcatcatcactatcatcatcactgtcatcaccatcatcatcaccatcatcatctccatcattttttaaagtgacaggatttttaaaaattagccatgttacctgagtctcagtttcatcatctataaaacgagcatagtctgtaaaatgaggttaatacagtgatgctcttgtgaccagtgcagagtaattggcacattaggaggatgtcagtaagcaatatctatttgtaatgcccttagtgattggggccagacctcttccttgggtagggtcaaagtcctagataaagtccttttccaaatttctagttttgccataagccagattggttcttcaagctgtctacttgaagaattgggccctcacaatctctttctgattgattgaaaaatccctgttggtggctgtgattcttatttcaaagaaggaaacacatttataggaaaataagagatgaaagagagaactttttttagttttattttttaagttgacatataataagtgtacatatttatggggtacatagtggtgtttctaaacatgtacagttatcagggtaattagtgtatccatcatcttgaacaattatcatttatttgtgttaggaacattcaatatcctccttctagctatttgaaactatataatatattacagttaactacagtcatcctacaatgctatagaacactagaacgtatttctcctatctagctgtgattttgtgtcctttaacaactctctccctatccgcccacttacctccccacaaacccttcccagcctctagtatgctctattctgctttctacttttatgaaatctttttttttagcttccacatatgaataagaacatgtgatatttgtctttctgtgcctggctatttcacttaacgtcctccagttccacccatgttgccatgaatgacaagacttcatgcttttttatgtctgaatagtattccattgtgtatatataccacattttctttacccatttgtctgttttggacacctaggttgattccctctcctggctacggtgaatcatgctacagtaaacatggggtacagatgtctctttgatgcactgatttccttgggataaatgcccagtagtgggattgctggatcatacagtagttctatctatagttttttgaggaaagttcctactgctctccatagttgctgcactagtttacattcccaccaacaatgtctaagagttcctttttttttttttgcatccttgccagcacttttgctttttgtcaccccatcctactggagtgagacgatacttcattgtggttttgatttgcatttccctgatgattagagatgttgaacattttttcatgtatttgttagtgaaaatgttttaaggacgacactattatttgttttaagaagtcatttattggccgggagtgggggctcacgcctgtaatcccagcactttgggaggctgaggtgggcagatcatgaggtcgggagatggagaccatcctggctaacacagtgagaccctgtctctactaaaaatacaaaaaattagctgggcgtggtggtgggtgcctgtagttccagctacacgggaggctgaggcaggagaatggtgtgaacccaggaggcggagcttgcagtgagctgagattgtgccactgcactccagcctgggcgagagtgagactccatctcaaaaacaaaacagaacaaaacaaaacaaacaaaaaaaagaagtcatttatttttctatggattaaaaaagtagtgctcaaccatggtagaaaatttggaaaataaaaaatccctttacctagctgtgatggttaatatttagccatatttcccttttattactttttacagcagtttagaatgatttgcacagttgatatcactatgatatcattttctaatctgcttttcacttagcattcaggtgtaagcattgtccatggtatgcacagtcttcactgctaattttaaatggctttataatggtccaaagagtggctctccattgattctttaatcccgtctggttcctctccccaccccgttacattccagccacactggtttgcttggcattcctttaacacaccatgctcatttctaccccagggcctttgcactgcctccttcaacctctgaagcacttcgctggttctttatgtagtacctccttctcacctttcatagctcagttaatacatcacgtcttcagatagaacccactttgaccaccatagacaccaaacaactcctttggtctctcttgatctcagcaccctgctttagtttctgtttggcagagggcagagggaactttataattttatggctggaaatgatcttatctatttgtttacttgtctgttgtcacactccctcaatggactataagctccatgaggacaggcaccttgtctgtcttgctcattgattttggtggcagacacagtgcctgtcacatgaggggagctcagtcaacatgtacacagtaagcagatggctagttggatggttggatgtgtgattgtgtagcaggacgagtcacagacaaaactcctcagacaccggattaaagaaggaagaggtttatttggccgggagtgccggcagacttgcgtcttaagagccgaactccctgaaaaagaaattcttggcctttttaaaggcttacaactttaaggggtccgcatgaagaggtcgtgataaatcgagcaagctgggaaacgtgactggggggactacatgcatcagctaacagaatagaaagttttgcaatgctttcccatacaatgtgtggaatttacagataacacaagtagtttaggtcaggggttgatgttattattattacttttttaactcctagggccgggtggtggtgccaaggttgtctggctatttatcttacttctgtttgtttccaactttttgctttctctttcctactgtcttgtgaactaggcaaggttgggggaggagggcagcaggagtagtagtggtctccttccttaattggatgaggagttgaaaggataggtaggtggcttgcaggggatagtgcatgcctggatgggtaggtaaatggatatgtgggtgggtgaatcaatcataattttaccaaccatcccccaatttcacagttagagtgcttccccatgatatttttaatcgctttgaaaaagtaagcaatgcaaatggcgaggaagtcggataagcaagtctcttgggaaatccgactcctccagggccattgcctaggggcccaggcctgggcagttgtccaagctcccggctgaggaggctggcctggagattgggagggtgctgagattctccgaggtcctctcgggtgttcattcaccccatgcccaaggcctcactgccacgcctctgttttgtcccctttgcagtgggtcggaagcagttcatgaggtttgagtgggcaaactacgcagctgaggccctgggctgcgagtatgaggagctgaacacggccaccttcaagcaccaccttcgacagatcatccagcaaatgacgtttgggccaagccgatggggcctcgaggatgaggaaaccagctcaggtacatggctgctgcctctttgggtgagctgggcccccctctgggccagctcctggggatacaccagcattctttaacttttttatcaaagatttgttaagggcctatgctatgaaggcgtgtgttagatgcaggggaagccatcgtgggtggaaagggaccggtcaatgctaatgctcaaataactatctccattcagtggccatgaaggctgctgaaacctggcagggagccccgcgctgtggggaggggatgccgtgggcagggccgatggaccaatgcatttccatcggatttcgtgtttgttgagcacctactaagtaggggaaagactagtctttctgtttgagggatggaaatcccgagtggctgctgcgaggtggagggatgggagaagatgagggtggagagcaaggtgtggtccgctcactaagggtttataaacgagggttttcattctcaggcccttgggaagccgtggagtggcttaggcagggggatggcatgatttggctttaagaagctcagcctggatgaaggttggggagtgagtgggagacaggagacccactgggaacctataaaaatcaccaggtgataggtggtggtcggaagtgctagtggagacggggcgaggtggacagattcaggggctagtttacaagctgaggtgatagcatgggccctaagagaaagacagagaccagcagtggctgctaggattttggccccagcagctggaagaatgaggatgctttgaactgccgtgggggaaaaacaggaggactttgtactgtacttgcaaggatgtgatctgctgggtcccaagtctgcagcctctgtgcatctttgggagctctctaagagcagctgtccttgagacagcagagtttggggttaatgagtaggagtgttgtgagctgtgattttggggcccatctcttggagctcctttgcacctttggagctgcttccaccttccagggacttcggcgtgaggactgatgtcacttggaccccattggccctctatgtctcctttcaggtctgtgctctggtgtgaactgtggttttcttgaagattacctctcctcttcgacatgcacacacattcccagaagcatacacacacatgcttatgcacacatggtgtgcacaccatgtgtgcatcacacatgaacacaccacacatatgcacagcacaacttgtgtatgcacacatgtgcacagataccacggaatcacacacatgcacagacactggcacacatatactgcaagcatacacagcacacacacagatatgcgtggcacatgtatgtgtaaacatgtgcacagatatatatataacacatgcacataccatacaactacacacacacgcatagacacaagcacacacgtgcacacatatgcacaggcacaaacaccacacacatacttaaggatgggtgcatcacacacaggcacagacagatgcagtcaccactttgtgagtctgagttaacctctcaggctgaggtctcaagagtagacattaagcaggcaggggaccttcgggcttaggagagatgctgggaggctgtgggttgcctagcaacagcccaggttgggggtggattcagaggaggggtgggaaatgctttcggggctgcagtgggctgcctggaatgtacaagcagaattactcctccaggcactagtgcgcactgatttggaaactgtgttttcaattttttagatagaactgaaacttaagggacggaatttgtgatctgatcccctacactcctcactctgctttgttcaatgcaccctaatcaaggctggtgattttaatgggatgcatatacatgcgtgtgtgtgtgtattcgagcaaaatcaagtccacaactgtaattatagtttttgagcctttatattcctcctaacgttctaggtaggcacttttccaatctcattcagtattcttcatacctgactttaagcattcctttgtatgggtagactacaaattacctaacccattttctattgttggtcactcaagtcatttcaaaaagtgatttttgccaatttaatcaacaattggaagaacctgtgtccccagaaagctttatttctctcaatatttcattagaataaaagcctaggagtgaaattattaggtcccagtatacgaacattttatggcttctaatacaaaattgtcaaatttctctccagaaaaagggaatcataaacatttactgagtgtctgctatgtgccagacactggcaatttaaaggtcagcaaacccagggacagcgcctatcttcagggcacgcccagcctcatgaaggagacacaggttaataaaataactatactagaaagatgatgctatgggaagtgctattagaagcaacacagagctgggaattggcctagtggtggtgatggtggtagtcaaggaaggctttcctgaggaggtgtcatttgggctgaaccctgagtgatgagcagatcactctggggtgaaggtagggcaggttacataggacgctgtaggccctgaaaggacacttagactttgtcctaagaacctggggaaataattttagcagtggagggatgtggcaagaaaagaaggattttctaaattgagtggtccctactgctctgcagtgatgtccttggccccaggcaagatccctaaccaagaatgctgattctgtcctctttcccagggctcaagatgacaggagtggactgtgtggaggggatggcctcgggcctgtaccaggaactctttgcggctgtggtctcactcatcaacaggtaacggggccttttcctaggcacacagttggcctcttgcaggtgcacagatgaattcacataccgggcagttgaacaaagtggcagtttttgagctggcgagagggtttctaaggtggacagtgctgggtttaacttctaccttggccacccactggctgtgaggtcggcaaatcagttcacttctctgatctccctttcctcgtctgtacaatagctctcttcccaaggactgttgtgaggattaaaagaaataatgaatttaaataactcttcctggccaagcgtggtggctcatgcctgtaatcccagtactttgggaggctgaagtaggaggatcacctgagatcaggaattcaagaccagcctggccaacatgacgaaaacctgtctctactaaaaattacaaaaattagctgggcgtggtggtgggcgcctgtaatcccagctactcgggaggctgaggcagggagaattgcttgaacctgggaagcagaggtttcagtgagccgagatcgcgccaccacactctagcctgggtgacagagcgagactctctcaaaacaaaacaaaatgaaacaaattcttcctaacagtgattgtaaaaatgccaataataaaatctaagtacttttgagtggctactgagggccagggattgcactaattgtgtaacctgctttgcatcattgaatactcacatgggcccattgtacagaggaggagactaaagcttgaaggggtagaaccgagatgcaaacacaatgccaccttctcatgtcataccttcagttcccctgaatagcccaatacattgctctcatccatttatttttcaaaattgtcttgctggggatgggagcaacatggtagaaatttggagtgggctggggtgtgcctctgatgtgtgtctgcggggctgcaggcaccaggagcctctgttttccatcgttacgcacaatgcactgagcccatgcttggaaacccttttagcagttttttcagcagagctaattcagagcctaggcaaaggcttgccttcctcctctgtgaaagcagaaagcataattaggcttctgaaatcctgttaaagggatgaggctggcgcgtagcaacagagcagccgggtttctccaagttgtcgtggacacagaatcaactccctctgacgctgctgaagtaattaccatctgagcccacagacatattatctagaaaccaaggggatcatgcgtgcttagagagggagtactgggaatgggaaatgaactgctggcggaggaaactgccttcaccagtgaagggcagctgcttcaaggtttgggttctcagaggccacatctgtgaaatgccgcatggatgatcaaagtacctactacagcatttataagcacctagtaggtgtctgtcttgccaagaataaaccgacttcatcttcatgcatgtctgtgtggtggctgctcttattatccccattttatagttggaaaaccttggcaaacaacagaagaaccaaggttcaactaagggcctccaaagctcctagctgatcatactcgtggtgatgagagcaggtggcatttactgagcactaaccacatggcaaactttgctttcacagccatggaagcttatcacacccaaccctcacaacagccctctgagctagtcaccatcattaactgagacggtggctaagacggtggaggctcagagaggttgggcaactctcccaagacacacatcccctctgtcacagagcaaggattgaagcccacatgtgactggctccaaaatctcttaagtcctaaattttgatgtgaataatccctgttgtgtccacccctacagattcatcaggagaatacaaggaggtgatagcttgaaagaattttgtaaactgatgtattaaataaaatagttttttgattttaataggcctctgaagaaagaaaaggagggcctaggcttcatatggtagccaacttctgggtgaccttaagctagtcatttttttttttttttactttgggccagtgggaggcagtttaattcctttagtccttatagctatccctgggataagcctactcacccccatcctcatttaacagttggggaaacccctgctcagagaggttaagtagcttgcctgaggtcacacagcctgtaagaggtgagcttggttttgaaaccagttctgctggaggcttggatcagtgtgctcctagattccatgccatctcagacattccacctctctcttctctccctagatccttttcctcccaccatctctccatggcctccatcatggtggtggactctccaggcttccagaacccccggcaccagggcaaggaccgggcggccacctttgaggagctgtgccacaactacgcccatgagcgcctgcagctgctgttctaccagcggacctttgtctccacgctacagcgatatcaagaggtatgcctgggctggagcagggctttcaccagagctccgtggatggtgtaaggtcagatgggaaggggtgggattcccattccccaggagcctgcagcttcaccctgtttggttcaccagagaacaaagccctttccccaggcctggctccccagacctctgttgctccctccacagcccagcctccccctgccaccttctgaaccccgcagcccagaagcaccaaggaactcgggcttccccagtccttgcttccacggctgtcctttctttgggatgactgcttcattctctcccacttcacttaagcagaaggctcctccaagagtcagtctgcatctgcccagggggggaatgccctttgagtcctgtgggtgggtggcagcagtgggctccacacccctctgcagcacagcacggtgagtctcacaaagttgaaggtacatgcatcacaaaacccagcaattcctcttctaggaggcacctgagagaaactctgtgtgtgaaccaggaagcatgtacaggcatgatcctgccagcccttcttttttcataaaaaaaaaaaaaaagaggttaagttgaaatataaggccaggcacggtggctcatgccttaatcccagcactttgggagcccgaggcgggcggatcacctgaggtcaggagttcaagaccagcctgaccaacgtggcaaaccccatctctactaaaaatacaaaaattagccagactcagtggcgcacgcccataatcccagctactcgagaggctgaggcaggagaatcgcttgaacccgggaggtggaggtcgtggtgagctgagattgcgccactgcactccagcctgggtgacaaagagagactccatctcaaaaaataataataataatataaaataaaataaaataaataaaatttacaaagaaaagtgcataaaccagaagcatatagctcagtgaatttacccaaatgaacatacgtgtgtctctatcacccacgtgaaaatgagagtattttcagttccccatatgactcccaccttcttccctgaaggtgtgaccacttttattccaataagtaccactggcagaatattagaaatggccatattgttcaccagttgaataatatagaataataggtattgaagttccagtcatttttttggttggtaataaaaataaagcaccaacataaatgaatctcaaacagatgatgctgatgaaacctgaggtctgatcctaactctgtcgcttattggctgtgtggccttaggaaaggcactcaccctctctgaccctcaatttttttttttacgtggaaaacagagataataatacttttgtatcagttatgatttgccataataatgctgcgtaataaactacccccaagtgtagtggcttagaaaaaaatcttcggttgttgctcacaagtgtctggatggcctgggcagctctcttggtccaggatggttcttgagcttgtgttcagattcaggtgtaggttggggtagatggctctgatgatcttggcagggctcgctcatgcgtgggatcagctggccatgaacggatctaggcaggccttgtctggggtaaccttgtccctgttccacaaatgtcccatcctccagcaggctagcttgggctgtccttgtagtgctgggcagggttccaagagagcaaacagaagcgtgcaggggaccttgaggcctggacttgaggcctgcacagaatcacttccactgtgttcggtgagtcacaacaggtctaaggctgagcatggattcaaggggtaggaaaacaggctccacttcttgatggaggcactgcagtgtcactctgcagagagtatagatacagggaagtgcagagaaccagggttgttttagatcattgttaccagactccccaaaggggccgttttgaacatttaatgaacaagaataaagagtgtaacagctattttatttttcccataatatttcacttatttctgattatcaatgtaatacatttttaattaaaacgctggaaagttcatatgagtataaagaaactaaagatacaatctcctttggcgcttctatccagaggcaaccattgttactattctgtttcttttttgtttgttgtttgttgttgttaccattttccctttattatgttgtccgtggattttggatcttcctgtatatatgagtttgttgtctgtcattttcctcacagtattacattattcacataacctccctccacttacaaatcttagtaaacctgcttgcagtggttagatctgattgtattccctctcctatagacatcagggtagtttctaagttcaaggctttataaacaatactgcagtgaacatccttgtccacagcatttcctggacatttctagtgattttttaaaattttttgttttttagatggaggttcgctcttgtcgcccaggctggagtgcaatggagtgatctcagctcactgcaacctctgcctcccgggttcaagcgattctcttgcctcagcctcccaagtagctgggattacaggcacctgccaccacgcctggctaatttttgtatttttagtagcgatggggtttcaccatgttagccagcctagtctctaattcctgacctcaggtgatccgcctgcctcggcctcccaaagtgcttggattacaggcatgagccacagcatccggcttctggtgacatgattgtggcaactattattccccatagtttacatttgttacttccagcaccgaacactcagcctagcactcattaggttctcagtaaatattttaaaagtttggaccgagttatcagtttctgataaagctctcagcatgacggctgacacgctgcatgatgagcagaatgtcattggagtgtggatttacaatctttcttcctacacaaaggctaaaaggtgatgaataaacaaacaaccccattagcaactggaaaaattaattaaacagacatttctccagagatttacaaaagcacacaaaaagaagctcaccatcacaaatcgtaagagaaatgcaaatccaaaccacattgagacaccacctcccacacactacaatggctactattaaaaaaaatcagaaaataacaagtgttggggtgatgtggagaaacttgaacccttgtgcagtattggtgggaatgtaaaatagtgcagccgctgtggaaaacagaatggtggacctcaaaacctaaaaaaatagaattcccatgtgattcagcaattccatgtctgggtatgtactgaaaagaattgaaattagggactcaaacgggtatttgtgcaccagattgcaacattattcacaatagctgaaaggcagaagcaactcatatatagattgcaattgacaggcgatggacaagcaaaatgagatacgcatattacgagatacgcacttactaggaagtattattcagccttcaaaaggaaggacattctgataaaatggtacatgctggatgaaccctgaggacattatgctaagttacataagtcagacacaaaaggacaaatactgtatggtttcacttacataagctacttagaaaagttgagatcagaggcacagaaagtaggatgctgggggagaaggaaatagggagttaagtctcatgggtacagagattccgttttgaaagatgaagaaagttctggagatggttggtggtgatgggtgcacaacaacatgaatgtaccttataccactgaaatgtatacttaaaatgactaaaatggtaaattttctgctatgtatcttttgccaaaatttaaaaaaacgatttttttaaagggccaagaggtgatggaaatcctctccgctttttccttcttcagaagttttcttcccccttcagctcgctaaaagtgctaacttttaaatcctgttattttccaggaaggtgttcctgtgcagtttgacctcccggacccctccccagggaccaccgtggctgttgtggatcaaaatccctctcaggtaacacagggcccagccaatccaggctctcagatgccagttggccatattgaaatgctggtggatttgagtcttcagtctactagttgtcaatgccgtgtgcacctagagtcaccccgggatcattggcaacgtggatgcctgggacccaaccccagattctgtgtaaattgttctgagggtatggcctgaacagtggaaatttaagcatcatcaggttgagaactgctgctgtcctttatgtctgagtctatgtcttagaatagactcgtgcctgggagcctgaggcctgagccaaagtgagttcagggctcatggccagaggccaccagccactctggcctggaaaggtcagatgtttgaatgaaggtgctgtgcccagcagagactggggaccttgggcactggagaacaggggaccatgttgggttcagggccctgaactcatctgggggcagacaggcgttagtttgagggaaactgagtctttacctcactctctccacccctagaactcactttgctaccccagatctgcacctctgctcgactcagaactgcccttgacaatttcacttgatttttttgtcttcctcttcacattttattacaaaagtgcttgggccatgaaacctgccatgcttgggtccagtcttggtgaccttgggcatgttacttcacctctctgagcctcagtttcctcatttccagaatggggatgctactttttctgggttgctgtgaatatcaatgagatattgcacataaggcacctggcgtgatgcttggcacacaggaggtgccctgccggtggcatctctcctgccatctgacactgcaggctgcccctccccttttcttccttccttgtctcctgctgaccagagatggcttgcaggctttctcttggcacacagtgggctgtacccatcattgcaaagccctctcctgtgtaagcccagctgactgttgtcagtgtgttcttctggttggcatctgtctagttcatttccttccacactgtgcttcctcacctgtgcctctcctaggaaagggtgggcctgaagggctgatttagcagtgttggctgggaagggcggggtagtctccagggcctgtggctgcaaatagctaccttcttcttctttttttttttcttttttttttgagacagagtctcactctgtcacccaggctggagtgcagtggcacgatcttggctcattgcaacttctgcctcccggattcaagcgattctcgtgcctcagcctcctgagtagctgggattacaggcatgcaccaccacacccacccttaacaactattttctgaggaccttctgagcgtgggctggctatcagtttcagccccaataaagaaggccaaggtgaaggatgcctgggatccagttccagctctgcatctttgactgtccatccgggagaccctggatgtgccccttcccctctccaggcctctgaggggtgtggattcctcagggtgaccaactgtcctggtttgcataggactttcccagctttagcactgaaagtttcatgtcccgggcaaagtaggacagttggttactgtgcatgttgcatttcctctataacaagttggtggcctttttttggttgtgccaactccttatgggccctcagagaggccctttaaactccccaggcctctctcagtttcccatatgcaaaattacagggttgagtagatggtctctgaagcttgtggctagatttcaaattctacgtcagtgctattgactcgtgttcaccttcttctctgaaatgttctttgagtgctttttttctcctccccaagattttagtttaaaaaatacaaggacttcttagaggaaacgatacagacagaattaatcctttctcgtttgtgcacaaatagaccagctgcctgtatgtatctagaaatgtgtaatttccagagggttccccttgttaaatccccaccatggccctccaaggaaggtattttcagtctccattacacaggaggaaacaaggctcagagaagtgtagtaagttgcccaaggccacacaggaggtgagcacagaggcaggattcagacagtttgcaaatgagaggttgctatagcttcaacactgagagtctggggtgattgggagcatggttttgggtaggcacgttctgagtcctgacacttgggacttggatgctctcattccctatcggtgggaagagaagcccaagacaggcttctgatgggtatcagggcccttcagtgaatcctggttctcccagcaggtccgcttaccagctggaggaggtgcccaggatgccagaggccttttctgggtcttagatgaggaagtccatgtagagggctccagtgacagtgtggtgctcgagcgtctgtgtgctgctttcgagaagaaaggagctgggactgaaggtaaggaagcagggggctggggatggggcctgagtccagcctgggtattagaatctgttcttctctgctgcagggaaagccctgacaaggcctgcacagaggctccaacgtgcagaggtgaatgtgcatgagcctgtgtatgctttcattcattcaagtattcagtgaacgcattgagcagccactatgtgctgggtactgttccatgtgttagttaaccagcctggcgtgggccagtcctcatggggaaggcacaagctcacagccaagcacatgcgtgcacagtgagcctgcaactgcactctaatggggcgcatcagggcgtttctcatttttctggtagccagtgggagatgcgtgcagatgcatctaacagagagccaggaacacgatgcaggacaagtttggagatggcttctgggctcagactgcagaggctgttgctggtcatgcaaaggtcttaaccctagagcaacgagaagccatgaaggattccaggcagtgggaggcatgatgagcttcatgttctggaaagttccctgaggttgtagtgtgaagatatggtaggaaggcaggtggtcagggtgagagaggagctggcctgccccaggaggtagaaacctctggaagtgtttagcaggtaaagtccatagcacttggtgggagttggattggtggaagggggagcaagaggggagatgaaggcgtgaaaccagaacaaagtgatcatgagatttggtatccatgggctccaagttgaagtccagttatttctgctttcccctgcatgatgtggggcaaacctctcgtagtcttagttgatgtgcttttaaaattgggaaagaagtcacccctggcccttttttctctagaatttctgctacgatgattgggtaatattatgtgcatgcagagctttgtcaccggggtcaaggtgttgcaggtttattgatgaggatgaggatgctgatggtgatggagaacatgattctggggttggggagtgttgcatgtactgcactcagagcagcatacgcagctttatggatagctcctggtaggattctgtcccacacttggagatacatattcttattcaaaaactgagttccagaagtccttgtgcaaggtcacccagaggagagaagggtcaaaagacagattcaaaacatggtttgtctggatctgagactcagatccctacaacactaggcacttaagaaggcaaatgtagtggccgggcgcagtggctcacgcctgtaatcacagcactttgggaggccgaggtgggtggatcacttgaggtcaggagtttgagaccagcatggccaacgtggtgaaaccccatctctactaaaaatacaaaaaattagctgggtgtgatggcgcatgcctgtagtcccagctactcgggaggctgaggcaggagaattgcttgaacccaggaggtagagtttgcaatgagccaagatcgcaccagggcactccagcctggacaacaagagtgaaattccatctcaaaataataataataataataataataataataataataataataataaggcaaatgcacttagtgatcttatcagtcccaaccctctttgaggccaggatatgtgctcgcattcattcattccttggtcccttcagaaaatatggatggagcacctaatatgtggcagccactgtcctagcccaggagatgcatcttccagcagagaagagacagtaaggcaggtgcatccgaaaggagaagactgaggactgtgactctggttgaggtcactgagagaatgaggcttggtagagaagatgtccaaggactaggttctgggacattcctatgtcaaggtgtcagggacaaggcaaaaaaccagcacaggagactgaggtgtggccagggaggcaggagggaaagccaggagaatatgactccctggaagccacaggagggattgaccttatcaaatgcggctgaaaggtcaagtgaggtgtgtgctggggaatgaccattggatttggcctcgttgaagtcattggagacatagacagatgcatcttgatggaatgtttcgggtgattgtccaactggaacagtttataagaaattgggagaagagccaaccatccagtgagtgagcgccggcagaagcttccagcttatggtgaccagcagagacctctgtccgagacattcatggtagattcctgtgcccatatcaggacaggattgtctaaccagtgaagcagcaacagcatctgatgcctcctgcagctctctctggagcaagctcacagtgcaaattcctaaattattcccagagagctcggctctgccagtgactggcgcagagctgacttctctgcccatcatggaggcacagtgcccggtgttctgggggcccatgaaaatgttgtttttcatttttttaaattttaaggtcaggggtacatgtgcaggatgtggaggtttgttatataggtaaatgtgtgccatggtgatttactgcacagattgtcccatcactcaggtattaagcccagcatccagtagctcttcttcaagatgctctccctcctcaccctacgatgtgcccagtgtgtgttgttctctcccagaaaatgttttaatttctggaaagaaaaagaacttttaggccaagggcaattctttaatatatgcctatatattaaattatacacacacacaaatatatatataaatatatgtaaatataaatatatatatacatacatacagagagagagatggagtttcactcttgtggcccaggctagagtgcagtggcgcgatctcagctcactgcaacctccgcctcccgggttcaagcaattctcctgcctcagcttcccaagtagctgggattacaggcacctgccaccatgcctggctaattttttgtatttttaatagagatggggtgtcaccttgttggccaggctggtctggaactactgacctcaagtgatccacccgcctcggcctcccaaagtgctaggattacacacacacagtcatgcaccacatagcagtgtttcaggcaacggactgtgtatacaaatggtgattccataagatgataataccgtatttttactgcaccttttctatgtttagatacacgagtacttaccattgtgttatggtggcttacagtattcagtgtggtcacatgctgtacaggtttgtagtttggagccatgggctgtaccatacagcctatgtgtgtggtaggctctaccatctaggttggggttagcatgccctatggtattcccacaaggaccgaatcacctaacgatgcagttcttagaacatatctccattgtataactgtatgtgtgtgtgtatgtgtgtatgtctgtgtgtaaatatatgtgtatgtgtgtgaacatgtttgtgtatatatatatatatatctgtgtctatatgtgtatgtgtatatctgtgtgtgcctgtgtgtgtgcatgtgtgtgtatgtctagttgtttgtatatgtgagggtatgtatgtagtgcatgtgcctgtgtgtatatgtgtgtgtgcacctgtgtgtgtatgtatgagtgtatacatgtgtgtgcatgtgtgtatatgtatgtatatatgtattagtgtgtatacgtgtgtgcgtgtgtgtatatatgtatgagtgtttgtgtatatgtgtatgagtgtgtatatatgtgtgtgcatgtgtgtatatatgtatgagtgtgtttgtatatgtgtgcacgtgtgtatatgtgtgtgtatatatgtatgagtgtgtttgtatatatgtgtgtgcatgtgtgtatatgtgtgtgtgtatatatattttcatggaggaaggtgcccatgaaagcaaacgtgcctagggcccaggaagttgtgctgcggccctggccgtgctcaccctgcaggagtcctggcatttacttaatcctggcaatgatggaatcccctccacacaggctggggtgtgagatgtgtctgcccctttgctagctggggaaggagaatgaatgagtggcagaaactgctagttgtggagcccttggttggagccaggcctgtgggctttactgcaccccagctacagggaggtgactgagtccttgctgaggtccagtggcttcccagggccctataggcgccgagcacagggctagcgctgaacctgggttgccttactgcaaaggccagtcggacttgtgactttccgggctgtcaaagggacccctgtctctatgtatgatacgggctcaagagtggagattttggggagcaggggaggcatctcactcagatccaaaagaagccaagagaaagagctggggaagcccaggctttgggccccagagccctgagctggcttctgctcaccgctcaactgcactgttggcgactcctggaaagtcccctcctggttctgtaggatggcagtcctggtgaaacccgtgggctgtggcgaggatggaggtgctgtttgcacggagcatttccacctccccctccttcagctctctgctcagaggtcaccctttagataccttccctgccctgtctgaagctgtccccctggcagcctcgctaccccatcacaactccctgtttcttccttcagggcccttgccagctctgtgaagttgtggttgtttctctgcttgcttgcctgcttgttgccattctccccacaaccctgggcgctccccgaggacagttgctcctgttcactgtctccccagggccctgatcataacaaggccatatgtgcatgttcctctcctctctcctgtcaccatcacacagctctctttgctgctcttcaaacatagcatgcacattcccacctctgggccctggcttcagcagctccttctgcctggagggcccttccgccacattccagcccagtgctgctcatggactttccctgacctctttgtaaaaagcggtgacccctccctgcctgcgatcctggctccctccctggtttttctcttccccactgcattggtcaccagggcatgtcccacacttgctcatcagtcatttccccttggggaaggccagctgcatggtgacaggggcgaggctggtcacctctgtggggatgacgcctggcacagctggcgggatgaggtgcacagtgaatactttttacaaaactgatgaatatgtgaaaactcagtgatctagaatcaaggaaatgtattatcaaagggaatgttttctggatcctgccttgtaggtaaaagagacggaaagtagggttggaagcagaaggcatatggtagggtgaggctggagtgggcagaaggggatttggctagatttgtggcccctccccttttatccatgaggtctatggtgtcagtcccagatatccctagcagtgtgctataaagccctcagtacccaagggagagactctgtccatatcctttgccttaaaccccctgagaagacacattaattatgacattttggttaaaaagaaaaaatagttctcttcctctattgctttctggttggctctgagttaatgagaacattcaatcatccagaacacttggggcattccggctaacccagggctcgctgttcatgacctcatttccttacctcaggtacatttgctgagtgttcccacaagggccagcagggactgggatcaactctcatggagcccaggcacagtggacagtcaggtgacaggccctcatcaacctccgagtgtgacctgcagaggctgagggggccctctctggggggttcaggctgctgggggaggtgacagagtctgaagctgtgagagagatatgctggataaggctccatcttccagaagtatccatggggctcctgaaagccaaagacttcatgggaaatgctttcatggacaaaattgtggaataaaagtcaacttcaggataaaggagtgaatgaggggaacaagcaggcctggaagctgggtactgttttccaggacattgcctgagaaatgtggcatttccgtgtgctggacaccatcctggacagaggcaggcttttggaccagcagacctgtggcctcatcctgctgtgccccattagccaaattgcctcatgtctctgaacttcagtgtcatcttctagaaactagcccagagatgctaacattaccagccagagtgaaatcactcatgctagcatgtccagcagagagtgctaggagccggggcttagcaaacatcaacatcctttcttctttcttccctgtcccctactcggtcacgatcctcattcagagctcagccctgtactggctgctgagcctaacaatgagtcaaccagtccctgctctccagttgcttctaggacagtggaaggaggcagccaggtaaacagatacctgtagcattgtaaatgcagcacggacatttgcgccaaagcctggtgtgtgctttgtcaccttactccctgtgggtgctttactctcccattggaaggggactttcttgagggcagggactgcacagctctgaaagcgtcacaggacactcttgaaacagggaaacttcactttgctagaagggttctgtgctggtaacttccgttatcctggacaggggcaatctgggaagtgagcacacagtacctctaagcagccacacaggtggcagatgccacgccctttactcctacaaaggctcacgaaagccgcagactctcacactgctgtattttgcagagagttccaagaaatgcaggtcctttgtttcctagcttactggagtttagaggcagcaaattaggatttgaggggaagactcaggaccctagtgcatgcaagtacgttggcaatagcaggatgggaaagcaaagtaagatcgttccgaatagatccaagagtcatgataatctgaccactcttaataggaatccatctgggggccaggtgcggtggctcacgcctgtaatcccagcactttgagaggccaaggcaggcagatcacttgaggtcaggagttcgagaccagcctggccaacatggtgaaaccccatccctactaaaaatacaaaattagccaggcatgttggctcatgcctgtaatcccagctactgaggaggctgaggcaggagaatcacttgaacctgggaggtggaggttgcagtgtgccgagatcgctccattgcactccagcctgggtgacaagagtgaaactccgtctcaaaaaaaaaaaaaaaaaaaaaattcatctggggccattcagtatggagacagctatcccaaacctgtgactgcaacctgtgagcatcacaatagttagagtaatattataaatgaacagcaatccattaattaattaatccatgcattcattttgcaagcacttctggactctgcatgtgccaagcatgatgctgggcactggggatgtgaacataaacaacactttgtgattcgggaacatcagcaaaggtttaagtgcagtcaagggcagtgacaaccattactgctgactgagtgaccattatgtgcccggacactatactaaaatattttacatacattatctcctttaagccataagccactctgggaggtatgctttatttaatccacattttacagacgaggaaactgatgctcagagacttacggggcttggcacctttcacacagtaataaatggtaaagaacctaggatttctctagcccccaagatcaggcccatttttttctcccaccctgtctcttggaaccgatgtgcctgtatctcccaaaagtattccctgtatttatttggttgatggtattcaaaatgattttacgcggcataaaactaaatattttaaaaatatttcatcataatttccatgcatatcagaaaataaacatatcttgcacatcaaatcggcaatatgatgcttcttttaaaatgaatgtactgtacttgtgaaaatgtaagtcgatttaaagaaaacatcaagtaaatcacagtccaggtgatacgtggttatatatatagaaaaactcgaggagatcgagtgtacggatgatgtttgggaaaaacaggtgtcctagatttaagaaagcaagaaagaataaaatccactttggaaataatgtacacaaattcactacagcaggagaaatgtgggtgccttcgaccatgagcgttagctatctggaaacacgttaagatggatactgtgcgtttaagggatgccagctgattgcagagtgtcctcaacaggctccagcactcatgccaccatgtctgtttccagggtcctctgccctgcggacctgtgagcagcccctccagtgtgagattttccaccagttgggatgggaccctgtgcggtacgacctcacgggctggctccacagagccaagcccaacctctcggccctggatgcaccccaggtcctgcaccagtcaaaaaggtgagttgggtcagggttggggacggggatggagcattggaggcactgtgttttccttcccacctaaactaggcagtcactacaacacagtgtgggagggccagcccaggaatcccatccctccataatggagcaaagaaccataacttgaattggagcagtgcagtgtctccctggggccagagtgaatccagctgaggagaaaagctggcctcctggggaggtggaacaaaagctaaaaagctgtgacttcttattttggcactttgcctttcattaagtatctgagagatgatgtgactggaacaacttttatggacattcaagaactaggggttcataaaactgaaatgatacgttttgtagcgttaaaaaaaagctcaccatgttccctggctgctcagcccagagtgctggcgtgaggccggcagcattctctgcttttagttcagaggcttattggaaaatgctgtgtgtgtgtgtgtgcatgcacactcccaagttcaatgctggaattcctcaggggtagagcttagagacaagaagagaaactgagacgaccagggaggtgctggtgtctcagatgggcaccaggatgagaaagaaccacttactcactactccctatgtgccttggatcagcataaacgctttatgagtatcttctgaatccttatcacaacacaagatccttagtcccattttacacatgagaaaaattgaggccccgagcagtgaagtggcttgcctttgctcacacagcagaacagtggcacagccaggacccaacttgagtctaagagatgcttggagaattcccagaacattatgtcagagctgattggaaacccacatccaggagtggggctcgtgaacatccagctcctggagagagattcaggccagggctggggcaacaggagttgcgagcacacagaggactgaatgatgacccaggtggcacaggttgagtctcagccctgccctttgtcacctgagtgaccgtgggcagtcgctctccctcatctcggttgtttctgcttcctgtaccataaataagagcaggacgatgctacaagactcagcggctgtagcccagctttggggacaggaagatgttcagattccgtttttccctcttttaagctacatgacctggacctcagtttcataatctgagaaatgggaatgaggttccaaagctcccatgtctgatctaagaaggctttggtgacgtaaagtagcagatgacctattagagagcccggttcgtagttggctcatggaagagggtaggccactctgctttactggaacagacacttgaaaagctggcacccttggccgggcgcggtggctcacgcctgtaatcctggcactttgggaggccaaggtgggcagatcacgaggtcaagagatcgagaccatcctggccaacatggtgaaaccctgtctctactaaaaacacaaaaattagctgggcctggtggcgtgtgcctatagtcccagctactcgggaggctgaagcaggagaatcgcttgaacccgggaggcggaggttgcagtaagccgagattgcaccgctgcactccagcctggcgacagagcaagactccatctcaaaaaaaccaacaacaacaacaacaaaaacgaaaagctagcatcctggccactaacctcagaatctgtccatgacagggatgctgagagaaggcactgtctgctcaggtatcaggctgggtatttatttgacattatcttgcagctccagaaactgtgtgcccagcctgagtcattccttcttgcatgaaacacatggcacgtgcctactgtgtgctaggcctggtctaggaatagcagagaggactttgacctctaagagagtacaggtgtcgtagcattgctgtaggtatgtaagtgacaagaatatccataggacagatgctctaagcctaggcagggagggagcatttgaaggtagaagacgggcatcaggaaggagctggcatttgccatgaagcaaagcctcacctggcaggaggggctgtgaatgaaggggagcagctgggacacatgactgtagaggaggctttaggaagccgaggagcaggaagcaagaaggcttgttccctttgccaccacccaggccaaggctttcccaagaacctcctaaagctcctctctcttttccctcctccccaccagagaggagctgcggagtctattccaggcccgggccaagctgcctcctgtgtgccgggctgtggcaggcctggagggcacctcccagcaggccctgcagaggagccgcatggtgaggaggacctttgccagcagccttgccgcggtgaggaggaaagccccgtgctcccagatcaagctgcagatggtgagtgggcaccctgtctcatggtgtcctggccttcactgcctccatcctcatctcctctgggctgagtcatgtgcctacatcatctctaacctccccagcaaggccagaggggcgagtgtcaccccacgctccacagaggaggaaatgggggctcccagcagcaatgaaacttggccctggtcacacccccaggaagtgactgatccaaatctgaggcctaagcctgtgctgcttggtgttgagttgagaggcctgggggagttcccagaagctatgaatgccctcttgactccagtgacacatatgagagccagactagccctgtctgccttgctcaccactaggttcccctggggcaaggcggcaggacccagctggatgtaaatgtggtacctagacctggaatgtgaatccgtgaataaatgagaacatgagattggtcaatggccaggctgagcagaaatgagaatgggctgagacaagggaaggacacctttaaataaaccttatagtggccgggcgcagaggctcacgcctgtaattccagcactttgggaggccaaggcgggcagatcacgaggtcacgagttcgagaccagcctggccaacatggtgaaaccctgtctttactaaaaatacaaaaaattggctgggcgtggtgatgcatgtctgtagtcccgctacttgggaggctgaggcaggagaattgcttgaacctgggaggaggaggttgcagcgagctgagatcgtgccactgcactccagcctggcaacggagtgagactctgtctcaaaaaaaaaaaaataaagaaagaaagaaaaataaaatggacctcctagtgcgttatagtggaaatgcccttagtccgagtcctgagttctagtcccagctgttctgccactggtctgtatgacctggggccactcacttgctctctccatgcctcagtttctccatctgtttcaacaagaaccattatttctcatgagcacaaatcaggctgtaggtgggagctccttggtgtgggacataggggccccaaagatgctcaggttgggcttaatgaatatttggagagggtccagtcccctttctgtgtctctgtgagacaactggccctgacctccctctatttggtctaggatgcgctgaccagcatgatcaaaaggtcccggctgcactttatccactgcctggtaccaaaccctgtggtggaaagcaggagtgggcaggaatctccaccaccaccgcagcctggtagagacaagcctggggcaggtggacctctggccctggatatcccagcactgagggtccagcttgctgggttccacatcctggaggctctgcgtctgcataggacaggtaagagacagctaggacacagcaccttgtctctgactcctgggacatgtccacccaccagtggcagccaagggatgggagcccctgccatgtgctaggagcttcacacccagcatcctggttactcttcccagcagtcttctgagatgaggccactgatgctcagagaggtggaagtacttgctcatggtcacattgcctggacgtggcagagcctggatcaggacccagctctctttgagtctgaagcccactgtttttttttttctttatttcttctgaaaacacacacacatacacacacacacacacacacacacacaaaatgggatacatgtacagcacgtgcaggtttgttacataggtatacatgtgctatgttggttggctgcacctgttgaaaaagcccatattatttctagaattgcctgtacactcctagaaaactagggctgtgtcttccttttagccatgaatttctaaggagcattgtcttgcaacagagggtggaattcctgtgatgagtgatattttgatgttcacgatgctcagtttggtttgggaggttgctgtgatcccaggagatgatgatatgacttgatgagggctcatagcacccagggatacgggaggccctgaggcctaaaggagggagcttcctactctcactgggagtttggggaaagctcacagtgatgtaataccatagtcaggccttgaagcataagaaactgtcacctctggcaaagggagggaacattaggcagagggatcagcaagtatgaaggatggaggcataaaacgggcaggttttcagggaagtggattcagaatgagtgaggagttgtgggagaagaggctgaggcatccaccagcgcaggctgggaatgcctctgttgggttatcaccaggtccacctggggagatgatgggctggcagggggatggggggattctaatcaagggattgaagtttttgggtctgtattttagtaagaaaatgtgcacctgatgtccccacattagctaatcttaggagttgagtttgatctcagtccttgctattcttttctgcctctcagtctccaaaggccaccacactgactcccctctctgacagttagaaatggctcagacaaggccatgctctctgcagaggacagggtggctgggacaggcagaagtctcaggtgagcacctcatttggttaaagtctccgtggtcactagtgccctagtgtatggtcgcttctcccatctccccctgctgggttaataagggacccctgggcacagagtatttgactgggagcagctagaagcaaagatgagaccctcactccgctgagcatatcaatgattttccctcccacccgcacagccgcagaggagggagacagataatgtcacaagagaagagggggatggtcacagccagtggctggtcccccacacttaatcgattctatttggctgcttggcaggaagtgctgggcctttgcaggcaccatgggcctgggtcagactgttagaatgcctgtgcgcacgcagggtcagggtgtcccgttcctgtgttcacgtgacctcacgacaccatctctgttctcagcacagcctagctcagccatgatgagctttccaactaagcgaagggttgatatctcatggtagaaatgtccaatttctgtctcctagacctggttcatttcctctttttatttctattgtaagtcatgtttgtctctttcacactcacatgagatagatttgtatgcatacacagatacgtcaaatatttattatttggaatctgtgcatatataatatatatatgcatatatacacatgcatgtgtgatgcatactcatgcatgctattgagtacctactacgtactagacactgtgttgtcacctatactaaatgagatcatttttgctgtgctaaaggtatgtagtaaacattcattcaacattacctatcgtgcagcctggtaggcacagctccaactctggagggaaatggtttggccttgattctggccaccacctctcaccagccgtgtgaccccaggaaattccctagagcttatctccctgtcctctcctataatagctcatatcgctgaaggctgctatggggctgggtgcgtcaataagacaataaagcttagaaaagtggcaggttgtggaagaacacataatacccattagccacttttactataattgtcatcgcatttaatcctcatagtgaccatgtgaagatagatcttgttatctcatctgacaagtgaagaaattgaatctcagaaaggtgaatcagttgtcccagtcatggggctcataagcacagagacgggacatgaatgcagataggtgtgccctaaaggaggctggtaacctcccaggtcccccatctctgtgctgtctgcatccttcaaagctggtctgagaccctcctcttccccaggaagtcttccaggattagccacacaaacaattgctgttcttcctagttgatgcatctggcttattgtgaagtctcaaaagtggagtgagattttaccataccttttctgatccagtcacttggggggtcttttttaagcagttgaggctcttcttgtacccagggaagagtctaaacctcgagacctggaatttgcgctcaatttcctttgggacctggtctctgctcgtctttggctactctccgctgcctgggtttgagtcccagctgagacagttactattttgtgttgtgtaactaggtgaattcatctctctggggctcaatttccccttttgtaaaatgaggatgataacataggcccatgagtgtctataacacgaggaagttgttaccctagtgatttgcacacataagctctcagtaaatgctggctgttactgtggactataaaataattttttttcttttttgggacagtgtctcgctctgtcacccaggctggagtgcagtggcacgatcgtggcttgctgcaacctctgcctcctgggctcaagtaattctcccacctccagagtagctgcgactacaggaacgcaccaccacgactggcaaatttttgtattttttgtagacaccgtgcccagccttggaatgtatcttatacttccctgttctaggtcttgtctgtacagccccctctgcctagacttctcttccataccaagttattttggaaaaccctatggcttcttcaaaaactgaatctaatgtcattttctcccaacagcttttcaggtgccccttctcttcccagttccccacatagaaggatgcagttgcgtccaccctgcatggtagacttacaaatgcccttagatactgcccaatgcagcatgcttcacatacagtgtatggggtggtaatatgtgttagacaaaacactttcctttgtcaaacgggtttgggaacctctgggctaacgttgggaaactcaaggcttatcaggcatctcccctgcatgagttctcagagcctttgacttggatgctgacatggctcatggaccttccaagaggcggatgagtgtgcagctttttcaaactttcagtggagcattttatagggttcgtgttctcaggaacacctctgggaagtgccaatcaaatatagtctcttaaattaacaaatggagaaactaaggtcccaagagatgagtccatgcagcaagttagtagccaggctaggaagcaggaccctgcactcctgtctaggggtttagggaactgggctgggtcttctcatctggactctgtgctcttctcctgcctgctcctacctccctaggctatgctgaccacatggggctcactcgcttccgccggcaattccaggtgctggacgctccactcctgaagaagctcatgtcgacctccgagggaatagatgaaaggaaggtaggtggagcacatgcgagaggggtgaaggccctagatatggatatgttggttattggacatgttccaaggctgggcacggtgagtggctcatgcctgtaatctcagtgctttgggatacccaggtgggtggatcacttgagtccaggagtacaagaccagcctgggcaatatgactttgactaaggtccagtgggctcatgttccataagggattgccccagggggcatctggaccagctggaatctgaaagcaggaccatgggggcagtgctgagggcagcatgaggtttcactcaaattcttgctctagaccaaacccccacaacaatgtcacttgggacccgactcagcccagaatgacccttctgacccctagataaggaactttaggaaaagaataagaatagagtcatgagaagagagcatcccagctaaaagggaccctagcaaggtgaaaggtcatcatttgcaaagtgtgttccattcagcaccagcaccctggggtggtctatgaaaagagggcttcagggtccaaaatgtttaggaaatatttacatcagggccccatgtttgagaattctgatgaacatcactccttagggcctttgcacgagctgttttctctgcctggagcactcgttccccgaatctttgcgtggctggtgtcatcttgctattcagatcccagctcagataccattcttcatcacatcctcttgttttgatgtttatgtagcacttatctgaaataatgtgaatctcctctgtgttttctggcttacagcaagagctcaataatgtttttgttgagttaatgaatgaatgaatgaatgaatgaatacccagacctaactttgtattgttgtccctgtgtgtcttctttctccaactacaccgtaaactcatggaatctcatctctacttccagtgccaaactttcaataaatgtttctcttgagaatggccacaggcttatcgatgattagagagcttgttagaatttgcaaagccctatttcatcttcataacagccctgcaaaagaagagctattacactccatttacaaaagagaacaccacgtttcttaagatgaagtggcactcctgaggccacacagccaggcatttgtgggtttgctccttggactcaagtttctcaattccaggggaggatagtttaaagagcatagttcataaagggaggtacttcaaactgacttgaatttgattcccagctggggctgtgtgaatgtaaactggttatgtcatctttctgcctcagtttcctcatgtgtaaagtgggaaggaccacaatgcagaaaatacataggggatccacataatttcaggataagtgctacaaaaactaattaaacaagaggatgtgatggaggatgatagctgagctgggatctgaatagcaagatgaaagagtactccatgaaactcgatggagtgttctgaggatgacatgtaatagtatagttcatgtaccttacacaggtcctgggacatagtaagggctcaatatacattaaccaccatcatcaacatcagcagcagcaccatcaatatcatcatcctctttcaaatccagggcgatgacacacaagcctcacagaccatgtgttcacaatcctgttgcaactgcatgtgcctgcgtgtgcctgagatcatcagcactgcagtcctcaatgaatgagtcagaagactagatgtaaagtcacaattcttaggtgtcttcttagttcttctttgcagtgggtaccagggcacaggccactttcagtagacaaggcaatgccttctgcagggccctcctaactcactatggaggggacatcacccccagatgtctgtggcacagggctgtcccttctctgggtagtggcccattttggaagccatgaaattctgcctgacttggtgccatcaaccactctgtagcagtcttcgttcatggggttccttattcttggtctctgaaaatttgacttcattcagaggggctgaatggagccactgagagggtcttgggctcctctgtggttgaaaatggtgcaggagtcaggtgtgggggagtttttttgtggaggcaaagggtgtagcatatggaagtgtttctactctgaatgagtcagcagttctctgttgtagccaaaccaaaaccacctccatacacgctagaggcctcagaaaatggaaaattacaaggagaatggacttggttgggaatttttgcttcttcttattctttttttatttgctcacaaattttatttgctgcagcatagaattttggtagcaacgaaaagaaacatcatcctgcctcttatgaaaaaactgataaatattcatttgccaggccacatgatatgccatgaattatacatgaacacgtgcttgggtgggcaaactatcagtttctgtgtgcaaagcagttaagacctcaggatttaataagacaaggttgacagctagaaaaggtcaatattgtcattagacactagacggcagcagaggggattcattgtcagggtgtaaaatgggtcttggtgaagtcccctgtgggtctaacatgtggggtctgaatgttggtgtttcatgccaagactgtttcccaatgaagtactctcatttggtgggtacctgatggatatattgtgttcctgaaacaaaaatagcatatgtcttttatcacagatgcataaactctcattataaaatatcagacatactatgaaaaggttacagaaccatgagctaagacagtattcaaaatataattcccactctgggaatcatcctcatttcacagcgtaggcagctgaggccatgaccacccagccaggtagtagtagagctgggatttgaactcaggctctcagattcctgacatagggcttaaaaaaaaattatggtaaaatacacatagcataaactttactgccataaccatttttaagtgtgttgatcagtggtattaagtacattcatatttttgagcaacaataagcaccattcatctccataactttttcgtcttgcaaaattgaaagttggtacccattaaacaataattcccgattcctcctcccctcaggctctggccatcatcattccactttctgtctctataaatctgactattctaagtccatcatagaagtagaatcatgccacatatgtcctttcatgactggttaatttcactttgcataatgtcctcaaggttcattcatgttgtggcaggtgtcagaatttccttcctgaggctgaaaaatattccattgtggatgtataccttattttacctgtccattcgactgtcagtggatgtttgggttgattccatgtttccttttcaacttttattttaagttcgggggtacacatgcaggtttgttgtaacaaacttgtgtcatgggggtttgttgtacagatcatttcatcacccaggtattaagcctagtacccattagcccattagttatttttcctgattctctccctcctcccatccttcccctccaacaggctccagtgtgtgttgttcccctctatgtgtccatttgctttcatcatttagctcccacttataagtgagaacatgtggtatttggttttctgttcctgcattagtttgctaaggataatggcctccagctccattcatgtttctgcaaaggacgttatctcattcttttttttttttttttgagatggagtcttgctttgttgcccaggctagaatgcggtggcacgatcttggctcaccgcaagctctgcctcccgggttcacaccattcttctgccacagcctcctgagtagctggaacttcaggcgcccgccaccacgcctggctaattttttgtatttttagtagagacggggtttcaccatgttagccaggatgatctcgatctgacctcgtgatccgcccacctcggcctcccaaagtgctggcattacaggtgtgagccactgcgcccggccctcattctttttttgtgactgcatagtattccatagtgtctatgtaccacattttctttatccagtctatcactgatgggcatttagggtgattctatgtctttactattgcaaatggtgctgcagtgagcatacatgtgcatgtgtctttataatagaaggatttctattccttcagctatatgcccagtaatggggttgctgggttgaatgtacaaatatctcttgaagaccctactttctttcttttttttttttttgaactcttgttttaggttcaggggaggtacacatgcatgtttattatctaggtaaatttcatgttacaagggtttggtgtacagataagttcatcacccaggtaataagcatggtacgcaataggtagtttttcagtcctcaccctcctcccactctttaccctccagtaggccctggtgagaccctgctttcagttttttggggtatatacccagaagtggaatagctggatcatatggtaattctattttaaattttttgatgagctgccatacagttttttatagcagctgtaccattttgcatttccaccaatactgcacatggatggcaagttctccacattcctgccaatgtgttatttcttgttttgtttttttgatagttgccatgctaatgggtgtgagatagtgtctcaatgtggttttgatttgcattttcctcatgattaggggtgttgagcatcttttcatgttcacacaggagttgaatagaagccctctgagggcaggcaaagtatttagtgcagttcgttacaggacatgccattcatggatattaactttaaataattatcattaatttcatccaactttaaccaagtgcctgcttttcaccagatcctgtgctaggcaccagcaacttccatacagagctggctttgggacaccccaggagatgccactaaaacatttgatgtttccaagggaggtgagagtggggcactcagggaagacatttcagaagtaggtgatgcttgagatgaggtttgtgaaacactctggaggaactgagtaggagaaaggttacaggacattctcatgttgggtacaggattgcaaagatctggagtcatggaggtgcatagatagtttcgtggtgctggagcataaaagatgccaagtgccaagtaaaggggctgaggagtttgacagaagcaaattctgggttcttgttagccaagttagagagtctgggctttatcaggtgttcagtgatgctcctctgaagggtttcagcaggggcgtggcatagcagacctgatctttgtgacttgaactggcttcagcaaaattatgaaggaagcgaagtccatgctgcccattccatggtcctctctaggaagcagtgtcctcttgctgacctctggctattccagaggcccctgtctcctctagacacccaggcacatactgaagcctcccaaatgaccctgtcttctccctgtaatcatcttcagttccattcctgtctcccaggctacctcctctggttagatgatgctttaacctacaccaaagcctacatagagtgaatacaagggtggaatctcaggcaggtcagtgaaggcactctttcagctcaccttggctacgtcccagattctggtcccttccatttttctgctgctgaagcaggagttgccaagtctatctgatcgatgtgaggaaacccttgggcctgccctcctccccgcaaagtgtctacagtgttgattgattttagccggcaaaatctctgtccctgaggacttgatctgaagaacataattaagggctgtcaatccgtcttctcaaaggcagccactgttattctgtctcccaccctggcagacactcccagtttcctgtgaattcatctcaagagtctttatctgctgggaagaaacccttatgagcccatggccagggagggagctgtctgctctctaggtgctgaataattattcatgggctcccaccaccttcgctcctgaaatttattcatcatccctttcttgttcaccttgctgtctccctccagtttgggtctattgttttgtttgttttttgagacagagtctcgctctgttgcccaggctggagtgcagtggtgctatctcggctcactgcaacctctgcctcctgggttcaagtgattctcctgcctcagcctcctgagtagctgggactacaggcatgcgccaccacgccaggctaattttagtacttttgtagagacctggtttcgccatgttggccaggctggtcttgaactcctgacctcagatgatccaaccaccttggtctaccaaagtgatgggattacaagtgtgaaccactgtgcactgtgagctgggtctattgttttaattattttacatgttttccactcaattttaatcaacccaatgtaattggtgtgtgcatgtgcatttggtttttggatagtttctgcctttttccaggcatttcgtttataggcttgagcataaatagttaaaaaacagacacagttagcacccttatggaatgatttggccacttgtgtgagaggctcagtggttaaagtatgtgatttagagtcagatagacttgagttcaaattgtgtcttcttccatatctctctctatgaatccacgcccttgatacttgatagctgtatgaccataggcaacatatagtatggcatagcaaagtgtctggtacattataggaactcaacatatggaagccattggaccatggtgtgggcttcatgggggcaggtgctatatggacggcagccaaatggttcacaggatgagtatcctattccatagacacagattcttcatatcaaactgttcattgaggagtgagttggggaagcactttgcagctatggctcttcattatttctggagtctctctgcctgtctggcatatacagccaaatgtgagatgtcagcccatatgcttttcgggtacactcttcttgaacattggagagaaagctctttgcaaaattctaggaaacaatggaactctgtaagtgggggctgtgggttggatgtgactgaaatcagttagaccccaaaatctgggctcaatttgacacaggctatcggaattttcctacttaaggtggagagatctcaggtttgccaagagccatgtttgctgaggtgtaatgttgacttacagtgaagacgatgacccatctatgctcaatgcctgggatgcttcactgaatgaatcttactagttgtgaattcgaagtgggatagcttaacaggttaaggatacagattctggagtcaggctttctgagcacatactgtgtctaatctgctcactggctgtgtgacatttgacaagtcactcagcctttctttgacttagttttattatcttaaaatggcatactaatagtttctaatactgttgataggaggattgagcaatttaacgtattgacatggtgactttcatatacacagagtaaataataaatgtaatcaattatgattttgttgtaaaaatagtaattttactatttctatggattttaatgccccttctatacaatgaaggctttaatatttgccttaaaaacctcaaataattgttaagataaaatattttttgattaatagtagtagatatttaatcaactgatcatctctaaactacatttggatagtttttgattttctgactattatgaaaaaggatgttgtgaacatttgcatatcagtctttgcacagaaacatgtttctactttttttgggtgcattcttggaggagaattgctagtttatatggtaaatttatgtgtaacttttaaatataacttttaaagaaactgtcaagttatttttcaaagtggctctaccattgttcatcctcactggcaatgtgtgagggtttcattttctatccttatcaatacttggaattgtttgcctttttgattcaagccattctgttgtgtgcaaagcggcatctcattgtggttttaatttgcattttccctaatgatgttgacttttttttttgcatgtgcctagtagccattttatctctttttttgtgaaactctattttttttgcccattttaattaggctgtttatcttatagagttgtactagttctttatttgttctagacataattatttatcagatgtatctttgaaaatattttcttccagcctgtggcttgtcttttcattttcataatgatgcacagagatttttatgaagttcagtttactaattttttaagtgactggtgcttttttcatatctaagaacgctttacctacccctcggttacagagatattctcccattttccgctacaagatttgtagttttagctcctccgtgtagacatttgatctattgtgtgttaattttgtgtatggtgtaacatacatgcctatattcatctttctgcatatggatattcaattgtcccagtaccatttgttggaaagactattatcatttctcccagcgaattgtgttggaacctttgtcaaacatttattggccataaataaagagtttattttcgtaatctaaattcattctattggtctgactgtactaattagtagcatctctttctttctgcctctttattccttggtcagtgtaaataaacttcatcagttttgtcttttcaaaggacaaacttttgatttcactgattttttttctctgttgtttttctgttttctttggttctattgtcttctattgatttccactctatgttacttccttcctttcacttgatttgagttttctctacttttcctggtttcttaaaaaggaatcttgctcaaattattggttcaaaatccttctcctcttccaatatacatggttaaagcatacattttcctcaaagtactactttggctgcatcacacaaaaattttcatttagttcaagatattttctaattcctagtgtgatttcttctttggcccgttgtttattaagaagtgtattaatttctacatatttggaactttctcaccttttttcttgttggtttctaatttaattccattttagtttgagaacatatgttatatgatttcagtacttttaaatttatttttgtttgttttattgagacttattttgtggcctaatattatatatctaggagagtgttcaaagtgtgcttataaaaaacatgtattctgtggttgttgagtagtctatagatgttagttggggcaatttggttgatagtattgttcaagtcttatatatcattgctattttttttttttttgagacagggcaggctcttgctctgttgccctggctggagtgcagtggcacgattatggctcactgcagccttgacttcctgggctcaagcgatcctcctatttcagccccctgcgttgctcagactacaggcatatgccaccacacctggctgattttgttttttagagatagggtcttactgtgttgcctagtctggtctcgacctcctgggctccagcaatcctctggcctcagtgtcccaaagtcctgggataacaggcgtgagccactgtgcctggcatgttgctatcgtttatgtttaattgttctgtaaattattgagagtcaggtattacgctctccaactattaatgttaaattttctatttatcctgtcattctatgcatttttgcttcacatgttttggggctctgtggttaggtacagacatatttataatgccgtatcttctggatggattaaccctttgttgctataaaatgtctccctttgtttctagtaatgatttttgttttcaattttaaacaaaatttaaaacaaaatttgtctgatattagtatagccactccagctatcttatgtttagtgtttacatgatagatcttatttcattttcccccttccaacctatctttgtatctaactgcatctcttacagatggtatatagttgaatctttttacaaaatccagattgacaatctctgcctttttattaaggtgttcaatatattgatctgtaatgtgatttacattatagccattttgctattttctgtatgggcttcacgccttcttttagtcctatcctccttcacttccttcttttgtgtaaactaggtattttccaaggggccatttgaacaccccttctagtgattgttctacggtttacaatatgtattgtaattcaagatgctccacttcagattaatactaacttaattctgggaaaatatagaacctttgctccaatatagctcacgtcttcctcctaccttagtgatactactgtaatacacagtccaccctccatatgtatctgtgggttctatatccatgaactgaaccaacaactgactgaaaatatttggaaaaaaaaggatggttgtgtctgaactgaacatatacagacttattttcttgtcacggttccctaaacaacacaatataataactatctgtatggcattttacattctattaggtattataagtaatctagagataaagtatacagaaggatatgagtaggttatttgtaaatactgtgccattttatataaaggactcatgcatctgcagatttttgtatcctttggcggtcctggaaccaattctccatggatactgagggataactgcagatcacatctatatatgttaaaaaatcaacaataaagctttatgattttcttttatttaatcttatgtcttttaggtaagttaagggaagcaaaggaaaaaaatgaagatttttacattttcctatgtgtttttgttttcccatgctctttagtccttaagtatttgaattacgtgtgatatgataccttgcatcctgaaggacttcctttaatgtaagtgaaacagtaaggcaggtctcatagcaataagttttctcagcctttgtttacctgagaaggtccttacttcaccttcatttttgaagaataattttgccagatacggaattcctgattgacatgtttgttttttcctttcagcacttctaacatgtaatctcactgcattctggacttcattgtctctgaagataagtcagccactaattgttttgatgcttccctttacacaataagttattcctctctttctgctttcaagattttcaatagtttataataaatcttggggtggcttctttgtgtttattctatttggaattcaatgacccgctaggatgcatagactttttttttgggggggggtgtcaaatttgggaagtttctagccatcatttttcatactttttaaaatctttgtctttctcctcttcttctgagactcctgttgtgcatatattggcacgcttgatttgccatacatatctctgaggctctatttatttttcctccttcctatttctctccgttcttcaaattggatagtttctattgatctattttcaagtttgctgactctttcatttgacatctcagatctgttgttgagtccctttggtgaatttatcatttcagttaatttacttttcaaatgaagaagttccatttggatcttttaaaaataatttctatcttgttattgacattttttatttaaggagtcattattattacactgtcctttaattcattaagcattgtttcttttagttctttgaacatacttataatagctgttttgaagtgtttggctgttaagtccaaattctgaacccacaaagatactttctactgtttcccctcacccttagtttggatcataattttacgtttattgcacatcctgtcatttttgctgaagactggacatcttagatgatacattatagcaagtcttcattctgatcttttcttaatcatttagtattataacttgttttgactaaaattacaggatctgtctcctcatggtgtgggaccactgatatctctgcccaatttttaaaaatttgtgtttttattttaaatctgacttcccaggagttgcgcctatgtctgcatagcttagagtcagcagaggttgttatcaaacatcttgaatatttgaggcttttccattttcctgttggatctgtgtgggggttgggaaatgtactcagcattcaggcagttcccagttatgcttcaacctctacgttctgtttggccctttcacatagtttctgcctgtacacatggcttcatgttcaaataaatagggatatgtagatagtgagggccttttccagtctctcttattcttgtgtttagcctggagccaggaatatgtgggaacttatcaagcccactgtggctgtcctatttcctgtgtctcctgttaaatttctggcatgtttaaggtccagtgcttgcctcaatcaggacaacaaccttaggcttagctgtgccattggccttcctcatttgtttcctgccaaaattgctactgtttctgacaatgctcccaggtgtgggttttttccatgctttgctccatataggtgagccccttctggaagcaaagctgttgtttttcacagctgcctcaccctggaagaactactgcagagagagagagacagagctggggtgggtggtgagtgggagaacctgtaatcaatattgccacaaactctcactgtttctacctgagatccaataggttttcttgaataaatgcttctcattttgttgtatcccattgtccaatttccagagtattgaacctgtggttgttggaaattttatccatatttatcttgttttggggggaggggagaggatttattaagctccttcctccaccattctggaaatatctcccttatatgctacttatatgaccttattaaatctccactacatccttgtgggacaggcgtgattacaccatgttgtagaaagcaaactgaagaccagagaggaggagaggcttgctcagggtcacacagctagtgagtggtggaactgatcccagcgttggagggtggagaaaagatcaggagctgattccttgggttcaaaccccctaccatcacttcctaaacacgtgagctttgccaagtcatttaattgcactgggcctcactttcttcctctgtaaaatgggcatgaattagtacctgctgcagaaagttggaaacaaaacaagttatgtgtaaagcagttggagcagggctcagactcaaaaacagactgaaaactgtgttttcttggagaaaaatggccacatttgactcacgaaaaagcagcattttatgctgcaaaggataagtttcaattacctgggcaattccagtacatggaagaggtgattccataaagacacaggacaaggaggaatttcttaacagtcacttggatccttgctgtgtctttttccaccaactggttgttggacaatgattatgttatgttgaactaaatgaagtgattgatatttgacctaaaccaatgacagtttcgtatggttcaatctaattgtaacgttaaatggggataaaaataacagcatttaagtgcaaagtaatttataaagtccttttcatatagtttcaattaattctctgaattgctgtatggtccaggcagggaatattctcaccactttgcaggtggggaagagggtcagttgtataatttaatacctgcacttacccactcatgccactgtttgaatccaagctttgttgtatgtaaaatgagatcaacagaacagaatatctgtgttagggctaatgttctcagctacatagacatctaaagagttctcagaaagcaaagagctggaaaaggagtctcagttatggtgggttgagcatgtgctttggcagggtttgaagtgtatctgagaaatgggggccttcattcatgttttgcagcactgttccaaggttttgaccaaaacagaggtgactataaggatgaaataactcctaacatttattgagtgcttactatatgccaggtgctatgtagccctgcacaagcacagcctcagaattttctgaaacaggtgccgttattgtccccatctttctgaatggagtctgaggctcggagtaaagcacttccccaaggccacacagtttatggagtgataaaaccaagatctgaacccagatggatctaactctggatcatgattttttttcccccaaaacatctgccatagactttacctccaaggtacacttagaaaaatttcattggtcatatatttccttttaaaaattcatccatcttatcttcagtcaattttttattgtttttttttcttcttatgtagagaaaaaaggcattatattttggatatattggttttattcatttctaccacctacagctcccttggaacatgtttggctaaaatgtgataagtgaaaccaccgacattttggaagagtgtcatggaatgttcttccaggaggttggaagatggagcttccttcctgattgcagtctgggactagactattaataaggattttttttttgatatcttaggaagttttctgtgatgtctttgacccatggaattgaaactcatttactaaattactccagcctcataataccttttgcttcctgagcattgcaattacttttctgacagtttattcttaaaatagactttctgattttcagtgagtgaaagaccaatgagggggtagtatgagggtgggtgggaggggaattggcagtcactaagcaaccaggcacaacctgggtttatctgagagtccaaatctctggctgattgtttcaaagcctgcaccactatttgacaaggggaagattccattaaatggcgattagtccatgctgtatccagaaatctctttgagtaaaattgtttctcctgcatggggctgcttttcctccctatggaatctctctggtttgggtgtttattcattcagtcatcatatctattgggctcctactgtgtgtatagaacagtactataggctgggcacagtggctcacacctgtaatcccagcactatgggaggctgaagcaggtggatcatgaggtcaagagatggagaccatcctggctaacatggtgaaacctcgtctctgtgaaaaatacaaaaattagccgggcgtggtggcacatgcctgtagtcccagctacttgggaggctggggcaggagaatcccagcctggtgacagagcgagactccgtctcaaaaaaaaaaaaaaaaaaaaaaaaaaagaatagtactatagtgcgtacagaaaacacaggctcctctgccataatgtagatcaggcaggtgaggttattgaccatgtcatttatttagcaaatatttgtgggagtgaggcagtcaccagcaagagcaatgagagaagcatagagcggggaggctatcacaggaggacttagtgaattactaggcacgcagtactgttcaagacatagctgtggccagaaagaacttaatgggaatctgtctctgccctgtgtgcaaacttgtaatcttgaaaaaaagccccttcatttagtttttgttgtgtgtgtgtattaaaatatatataacataaaagttaatcttaaccattttaagcatacagttcagtgacagtatattctcagtgtggtgcaactatcacaacatccatctgcacaacgctcttcctcttgcaaaactgaaacgttatacccgttaaacaataagccttcatttccccctgtctccaacccctagccaccataattctttattctccatgaatttggttactctaagtacctcctttataagtgaaatcatgcagtacttgtccttttgtgactgacttatttggcttggaataatgtccttgaggttcatccatgttgtagcatgtgtcagaatttccttcctttttaaggctgaataatattccattgtatggatagaccacatagtgtttatccattcatccatcaatggacatttgggttgcttccacattttgggtattgagtataatgctgctatgaacacaaatatataaatatctcttcaagaccctgatttctttctttctttctttcttttttttgagacggagtctcgctctgttgcccaggctggagtgcagtggtgcagtctcggctcactgcaagctccgcctcccaggttcatgccattctcctgcctcagcctcccgagtagctgggactacaggcgcccgccaccatgcccgactataattttttgtattttcagtagagacggggcttcaccatgttagccaggatggtctcgatctcctgacctcgtgatccgcccacctcagcctcccaaagtgctgagataacagccgtgagccaccgcgcccggccaagactctgatttcagttcatttatgtatatacacacaagtgggatggccagatcatctggtaattctatgtttaattattcgaggaacctctgtactgatttccctaacagctgcatcctttatttcatttcgtatctttggttttctgctctgtaaaataggaggatgaaacaaattggtgtgtgtatgaaggcagagtggatggcacacagtaggtgctcagcacctgcaccttcctgtgtgaggtggggctctgttagccaaagctcacagacatgtggggtcatcctccgtcctggcgcatcagccatcgagccagcttgactttcccctttaggatcctcctaccttctatgctgtctaacttctctctaattttttccccaggccgtggaggagctcctggagaccctggatctggaaaagaaggcggtggctgtggggcacagccaagtgagtagagctgctttcttacaacattcgcccatcacatcagggacccagagatgacctgattcttgtcctacctcaattgtctattatctctgtacgtctcctttttcccaaactgaaggtagagctaatgattttctgccctgcctatcttacaaggtcctggagagacaatgtcataatatgagttgaaatcacactgggaaatatcatttcttggaggcttcactcctggggaccccaagtggtttggaggaattagcattctggtcctcaagatgaccttctgagtctcagaaagagctgccataaaacctgagaagaactgctcatcttcactcacagccttttaacttctgctttgcaaccagctctaacacagctatagtcatagctgatgagcagcagtaagggaaaagaaagaaggggcttgagaggaaagcccgtgattattcaggttgacagaaatagcttttcccaaactggtgttgagcccaaagctcttccaaatatgctcagatgtttagaacagaatttcacacttccccgatatgcttatatatgctgaagttttcaaggtgggatacatggtatttagggtttctcaaactatttgactgtggaacccccagccttttgtttgtgtggaatacctagtaccatcttctggagctagtgttccatggattatagtttgggaagtggggcacggagattgtaaactcaaggaccaaggagtgggggcaggggaaagggacacagtttagaaatacaaactagaggccgggcgtgttggctcatgcctgtaattccagcactttgggaggccaaggcgggcagatcacctgaggtcaggagttcgagaccagcctggccaacatggtgaaacccccatctctacaaaaaatttaaaaattatctgggcgtggtggtgtgcgcctgtaatcccagctacttgggaggccgaggcaggagaatcgcttgaacccgggaggcgaaggttgcggtgagctgagatcgtgccactgtactccagcctgggcaatagaacaatactgtgtctcaaaaaaaaaaaaaaaaaaaaaaaagaaggaaggaaggaaggaaggagggagggagggaaggaaaactggagaggaacagaccaaaagaaagactactccacacatttccccacctagttacttactggttgatgaatgccatctaagaaaactttgtcaatggccttccacctccaggagctatgtgaggtggtgggagggttctgctctccaggagcccaccagggtggcattattggctatttgtacttcatggagccctccctatcatatgcatccgtgagagtggtcctttactcagggagctcacagtcatctacactggctaccacccctcagcccaccctaaacacactagtgtctccccactggcctcttggtcctgctaaggtatatggcggaacctgttattccgctgtgatctcaagatactttatcctgataggagttgcagcatcccaagtctttgaagcctttttcaatagagagagtaaacctgtcagttactggactcccacgcactatgtgaggcaacttcacgttttgttcttctttgttcctcactcacagtcttctgtgagatatcaagtgtgttcctgctttacagatgaggaagctgtgcccctgggaaataagcctcttttcaagatcctatctgtagccaagggttcagactccacgcaaacctgcattggtccaaatgccagggtcttttccgtacactctgggtcctattgtttatgaatggaaatgcagtcacgtgtggcttaacaatggggatacattctgagaaatgagtggttaggcaatttcttcactgtgggaacatcacagagtgtactcacacaaacacagatgggatagcctaccacgcacctgggttagatggcacagcctattgctcctaagctacaaacctgtacagcatgtgactgcactgaatactgtaggcagttgtaatacaatggtaatgacctgagtatttaaacatagaaaaagtagagtaaggatctgagtatttaaacacagaaaaagtagagtaaaaatatggtattataatgttatgggctcgctgttgtgtatgcgtctattgttgacggaaatgtcattaggcggtgcatgactgtacatgacatattctttacagatggatctttacggtcctgaatctgtggaattgttcttcagctccaggaacttcatccttctagaccagcagttctcaaagtatgggccctgaaccagcagcatcagcatcgcccaacagcttgctagaaacaccccagacctagtaaatcagaaactctggaggggggcagggctggcaatctgtataacaagccctctaggtgattccaatgcactctcaagtctgagaaccactggtctagataatgactcagttatgtcataaatatgaaaatcagtgcctatgatcctggcagctcttgcagaagaagaaagaaaacagtcattacatgcagtttacagtggcaggagtaagaagtctgtacacctaaacattcagataataaaatatgactattattgaataatacttggtattgactgagaaactgtcaaaagcaaatcaaggtcaatgtgtccttttggaggccaggctgggggatactgagacctttaagggcagatgcagcatcttacgcattgcaggattggcatgtaataatggagaaggctatgaagctcaggggacaagagaatcggctgacccagtccacacccaggctccaccacttcctaactgtgtgaatcttcagtgactggtttaacttccctgagcctcagttatctgtaaaatggggccattactttctacctcccaagatggctgtggggatccataaagtgtcatttaacagggggtggctgtcactacttgctgaatacatttgtcagtgaggcaagaggcttatcaagcaggataacattttaatgtttaaagaattaaactcctctaatctgtaaagtgactaagaggagaggagctaattccttggcggtaccagatatggaagctgtttccatatcagatttttttaaaacctgggccttcagcattgttagaggaaaaacagtttgcgtggttttgtcccccgtggattccttaaaagtggggctttggggatgttacactctgtttgcatccgataagctgctggacccatgaaaagcaaataatttagatttttcttcgtgatttttcagcctctggcgccttatcaaggcttgtgctgagggccatggcatttgtgggaaaggtgtgattccacgtgcagtcggccttctggtcggcaatatgctcttaaaaggcaaaaaaaacaaaaaacaaaaaacaaaaaaccagagagaaattgagataagattctgcaaaggcttattcccattctgtgtatggttgtttccaattatctttttaatgaaagcttcataatcaatagtggttttggcagcacccgccatctattgtaatatacgatctggtgctgtcataactttgatcattgattttttttttatagcagcttttgggactcactagcttgtgaaattaatacagtcattattgaagcaatctgataggtaatgagccaattgtgtctttatttcaatgagactaatggtcttggtggccctgtctgataggaagtgttctgcaaagccatggagggttaggaaacagagttagtaccaactgggcatgctaatttttattttcccattgagaaaaggcatagtgcaggatggtcggagatgagtggtctccattacgaaaaatagggtttagggtaatggagaatcgatcgagaccctttgttccacctggaatcaaattgcagttgaacctcgcacttcaagtgcttgtatcataatggataagaaaaggcagcttcatgttgacggacattgagaatgggtgcaggaaataaacctgaagttctgggctcaggtctcagctttgttggcaactgattctgcaaacttgagtcaatttcataacctgcctgagccagtacattcctcatagagctgtttgagtattaaaaagagacctaggagaaagcactttggaaaatgtagatgcatgtaatgttcatgctattcagtgataattgtacccttgtctgaagtcagatagaggaaaataaatcctggtgttgccacttgcttgtaaaggatcgtgggccaatgccttttttttttaagccttagttttttcctccataaaatgtgagaatcatcgtaactaccatataggattagacatgtaaagtgttttccctgcatgtcgagtggttgtttagtccagttccaaaacacagtaagtgccccctaaatgttatccattaattgataatgtcatcaatgaatacagagttatccagtgtctccagataaccgcctctgggattataaaccacatgtgacaaagaaacacatgggactctttttagaaataagcagcataagggcatcagaaaaatgacttcttcccctgtcactgactgaaatcccaccataagagcatttttcctctgcctctgggaagttgagaaaatgaccaaagcaaaccagagctacccttgcgcattggcaggagcaggcctggcccagaagcttcaggttctcgcagaaaagcatttaactcaaacctccaggactctctgccttaatcttttgctgacagtcagtcctggggtcctagcttccctcattcctgttccctgcagtctactagaaggtggctttgtggggtgccgaggaggcattgatcagagtgctgcagaggccatcatccattattgatgagttacggtctggaaatcgtgtaccgagagctgttttctgctagatccctcagcacctctgtgggtggcaccagcccagccccatcctctccagaccaagaggactgccatcccttcccccactgtctctgcccctccttacaaggctggactgaggtgtttcttttttctttcctttcttttttttgagatggagttttgtctgggctggagtgcaatggcactatcttggctcaccacaacttctgcctcccgggttcaagcgattctcctgcctcagcctcccgagtagctgggattacaggcattcgccaccacgcttggctaattttgtatttttagtagagacggagtttctccgtgttggtcaggctggtctcgaactcctgacctcaggtgatccgcccacctcagcctcccaaagtgctgggattacaggcatgagccaccacgcccggctggagtgagttgtttctaagccactgcttcactcagattgctgtgggtgcttacccaaaatattcacattcccaggcctggccctaaacccacaacccagcctttcctggggcctgggaatctgcatgtactgcactttccaggtggtgaccgtgcacagaacagtttaggcaagtccatgctagctgtgcttctcaaaggaacgtgcacaggaatccccgggggattgtgttaaagtgcaggttctgatttagcaggtctggaatggagtgcgagattttgcatttccaacaagcacccaggtggtgccaatgccactggtgcgtgggccacactgagtatccagggcctaggggaagggagagaggagccatcagcagacaaaatgctttgataatttagactcccccacctcccacttaaagggcaactgccaacaaatattgcaggtgggtgcaagagaagtggggtctgatttgcaagcacccccccattgtagacagccttcttcagcagaggactcacctgaaaccttccctctccccaggtttttctcaaggcaggtgtgatctccaggcttgagaagcagcgagagaagctggtatctcagagcatcgttctcttccaggcggcttgcaagggctttctgtctcgccaggaattcaagaagctgaaggtactgcatgccgttcccatgaggagtctgatccaacgggtctggagcgggcatagggtctgcctgtctttcaggatgataccggtgcaccgggtccaaggatccaacctgagcagtgagactttaagtgaggctttgcaagatgttatgactgtttctgggacattgacatcaaattatccatgaggtcggccttgcgctaggtagccatgaggttgtccaagccctcctgggctgattcatgacttcaacctgtcttgtttctggagaaattcactttcacaggtcagcagacagggcatgaccagggcccagccactgaggttttggggaccaaaggccaagtcaagcttgaagcactgacccatttagggtcaccatcttcagagatctctggagactgaatttcctctctgtagctgcacaatagagagaaaaccacgtggctctgggaacaagtattatatatgttcgaattccacctctacctcttagtagctgggtgaaggtgagatgaaatgatgtgcacttaatacagtacatggcacatagtaattgctcaataaactctagctgctattaccttagaattgttattcttaattactgctactactagaatggagtcttgttgtatgtgcctccagtttatgtgaacttgtaaactcaagtatatgtacttggcagaaagagaaaaatgatgagaccgtgaataatgaacatattgtgggcaaccccactggccttctgtgctcatgtagctcataccttggaatgatgtggaatagagtttcagaccctgggctctgcagccagactgcaagggttcaagcctgctctggcactgagaagctgggtgacactgggcatgtgactttacctctctgaacctcactttccccatccgtaaatacataaaataacatgatcttcctaggactatactgaagaccaagttgaggtgtgtgagatgctcagggcagtgcctagcacttacgagcctcaatgtctgctgcacaagaatcagctgctgtgatggtgatgagggaaaagcatctcttggcctgtctgccagtcagtgctgttctggtcccccccccagtgataagaatgaagcgggtcaatgcttctcaaactgtggtcccagaccagcagcatcagcatcacctggggatttgttagaaatgcacatttgcaggctccatcccagagtggctgaatcagcacctttgggggtggtgtctagccatctggggtttaacaagccctccaggggattctgatgcacattcaagtttgagaagcatgaaattactgtttaaatacactgtgaaaatgatctcccttcaatataagctaataacataatcgtggacattgttatttgtgggcagttttagagatttttcagtggcagtttttgccttgcatgatgacctttaaacctaatcctcatgtaagatgtaacctattgtatagtttcttttactctttctcctattattatttggccatgcaagactaaattatggcataatgtttgatgcagagagcctgacatatcaaaaagactacaagaaaggaagcccgtgtgtgtgtgtgtgtgtgtgtgtgtgtgtgtgtgtgtgtgtatgtgttttaaggtatccagtcccttccaccgggaaataaccccacttcctccagcccctttgctaccctctgcctcctctccttcctttatcctcacctgggttggaaaggaccctccagtctgtgttctccttccctgcagattcgccgactggctgcacagtgcatccagaagaatgtggctgtgttcctcgcagtcaaggactggccatggtggcagctgcttggttccctccagcctctacttagtgccaccattggaactgagcagctccgagccaaggaggtcagtctatgtggcaggcagggtgctgggtggctactccccacaccctgctcctcctgtttgcatctagcaccctgtgcccctattcctgaatgttcttgatctaggaatgctcagcccaacagccttgatgccccttccagatgttcctctgcctccaacaacacagacaatcctccatcccatgcccagctcctctctaggctgtgggtgtttagagatgctattaccaccctgggggttcatgaacactcactacttaacccagagaagctcaatgggcagagtctttgagtcctttatttatttatttatttatttatttattttacctctcagacaacactctttttctttcattcttccctgtcaccacctatcttttataactgtttcaattggtttctggttcatgctttttgttgttattattttgcaaaaattagtaactatacacacatatttagttcttatatttcttacataaaaagtagaatactacatatactcttcttcgacttgtattttctacttaaaatgtattctgaaaatcttgccgtttccattcttgtggagctcctccttgttctgtctttatggctgcatagccctcctttgtgtgtctgctccttagttcattccacccgcctgctgtgggtgggcggtgaagcagcttctgaatggtgctgtcataggcacagtgctgagccactggcagaaaggcaatccctggaggatgaagtgctgagcaccgtgtccatacttgtgtatacccagtctcaggcaaagcaagggactcattctgatgatttgtgttcagcccctagactgggcagggctggaacagacttgcatgaacagagacattgaaatttggaagtggtgaaacaaaaagtctcttgttggaacctagcacctgggtatcttcatggatgctggctgaattactcactccattccccaaccgctctttaaaaaaaaaaattcatctttaatttacaaagagtaatcgtacatatttatggggtataatgtgatgttttgatatatgtttacaatatgaaatgattaagcaaagctaattaacaaatccatcacttcatttatcattttttttgtggtgaaagcacttaaaatctactttttgtttttgagatggagtctcgctcttgttgcccaggctggagtgcagtggtgctatctcggctcactgcatcctccatctccggggttcaagtgattctcctgcctcaagcctcccaagtagctgggatctcaggcatgcaccaccaagcctagctaattttgtatttttagtagagatggggtttctccatgttggtcaggctggtctcgaactcctgacctcaggtgatccgcccgcctcagcctcccaaagtgctgggattacaggtgtgagccactgtgcccagccaaaacctactttttacaagcaattttgaaatatacagtgcaccattatttgttatagtcaccattctgtgcaatagattgctaaggtttattcctcctaacggaaactttgtgccgtttgctcactcctaacacaggtggaacttaatctctggcctggaatggtttctgttcatgtgtttgtttttgtaggaggagcttacaacgctaagacggaagctagaaaaatcagagaagttgcggaatgaactccggcagaacacagatctgctagaaagcaaggtatccccatccctcctcttgggtccttgtggggggtctttatgtatgtgagatctgtttaatggggagaacaatgatatgcctgaaagcatgctaattgctttacaagcaccccagaattacctgtgaggcacatgctgttattgaacccattttacagtggaggaaattgaggccctgggatattaagtatcttcctcgaggctgcacaaccggcaagtgtaactgagattcaaacccatgtcacctggttccaaaggggagaatttcttaaataagtcacaaaagcacaaatcatagggaaaaatgataaatttgactatattaaaataatgaacttttgtttatcagggcataaaatgaagatgtatattacttacttggaatagaaatttgcaaactggaaaagagtatccagaacatgtaaagagctttctcaaatcaaatggaagaaggcaaacactccaataagaacggaaaaacaaatatgagccaataatatgaatgggcagttcccaaggaagggacgcttgtttcaagagtttaagtgttcaaaaattcaaatggccaataaactcatgaaaagacactcaacctaattagcaattaggaagtgcaaattaacaccttaataggtactgtttcacacatcagattggaaaaattgaagagtgtgatgtagccaagtgttggcaaggttgtgtggcagtgggaattcttatttactgctgctgggatcataaattgatctcatcactcttgaacaatttggcattatctgtgaaagttgaacctgtccatgccctgtggctggccattccacctctaggtatttatgctagagaatcttatccacgaatatatgaaaatacaagaagttcatagcaacagcctttgtcctgttgaaggaatgtaaacacaggaaagtaaacattcaaatgggagcttattaacagaacagtaggtgaatatgttttgtgatattaaaaacgagctcccaagagtgaaaatgaatgaagagacagggaaaactgtggctcacaggctaaattcagtgcaccacctgctttttgtaaataaagttttattggaacacagccacgctcattcctttatgtgtagtctatgactgctttcatgttacaatggcagggctgagtagttgcaacctgaaactactcagccttgccatgtggcctgcgaaagctaaaacatttactctctggatctttacagaaatagtttcctgatccttaaactagaaaatgtgtatcaacatgcatgtattgctcttgcaaacataatgccaaaggaaaataattcagttacagaagagtacttgattaggggtatatccttgtatacttatggtgtcattatatttatgggaatcataacaccaaattcagagtaggggttacctggggtacggtcatgtgactggagaaggttatgttggttgaatgtgtgaccgtattccctatgccttctctctttgatttcatgggctggggtgacttcatgggcatgggtattgatttcatgggctgggggtgactacatgaatcagacagttcccactccaagaaggtcactgcaaattacagatagacttctagacaaagtcatatgctgtgctagtccattcttgcactgctctaaagaaatacctgaactgggtaatttataaagaaaagaggtttgattcgctcagggttccacaggctgtacaggaagcatggctggggagcccttaggaaacttacatcatggtggattgttaaggggaagcaggcacatcctacatggctggagcaggaggaagagtgagaagggggaggtgctatacacttttaaacaaccagatcttgtgggaacgcactcactatcactagaacagcaagggggaaatctgtccccatgatccagtcatctcccaccaggcccttcctccaacactagggattacaatttgatatgaggtttggtcagggacataggaccaaatcatatcatatgctattatgttgcatgtggtcagcaagccacggctagaccaaagaggagcttttcgacgaaaacctgctgttctatgtagactttcaggactggggaaagggaggcacttgactagggaataaaatgtaaggggtcaccaaaacactcagcaaagtaaataatattttaaaattgtaaagtaatgcaaaaaataatccctgatgaacaaaacatcaaaattttaagtaaatgcaaaatttgtaggccaagattagggtgaggcaagtaaacattctaaacagtgtgaaccaatctttatataaaatgttgatattttctttatcgtggattttttgactaattgagatttttaaaatattgaattaaaatcttatttatcttgatttctgagagtttttttttgacacctccttacatgttgcaccctaggtaagtgttttacatgcttcattctagtctcagctctgtttgtccatgaagctctgggtacctccaaggattctgttaaagaccaaatgaaacccattttttcacccactcaacaaatgtatatgaacatctcccatgtgttagacatttgactggacaccttgatagagctaggaaggagggaaagtccctgtccttacacaaggtctccaggccgatagagggagacagaccacaagcaagcttgtcacacatgaagtgctacggatatgaagcagaaggaggtgacagtgatggaggttaagcatgggctctatttgcctaagtggtcaaggaagaattccatggaaggggatgttggactctagatctgaatgatttgctgtaatctatatgcagatctggtggaaagagtagatatggcaggtgccgaggtcctgggacaatgtgagataatatttgtcagtccaggacaaaatttaaagatttctacacccgagagcacctggtgttattacttgcttataatgttgtttggcttggttaatggacaatggtaactgtaaatggatttatgattaagccaacagaacctactcttcttcccatgttgataacccaagttgagcctgagatggctcatgtggggatgtggaatgaagtttgagaggaggccatctcttttctgcttcttctcatcttccctgtaagattgtgtccattctccccacattaaagtgtcaaccgtggagttggccacggagaaggcagaagccttgctccttgcaggaaggaccacatccacacaagagttaagagaggctgggctgagatacaccttgagcctatgctcctcctatgcaaaagactgtaagggggagaagaaatgacacacacgtgcctgatgtctcattcatgtcttgcgagagcaagctgtctgacctctcttgctggcagcaacaatgagtagaacagcagaagtgaaaaattggagagctgtgggctggttgggaatatcagggacttccctgtagaaattccttcccaccgagctgacatttgaagcagtcattaatcacgaactgtcaggttggatttgccatgcatcggctgttgggggagatgtgcggggatgagatgaacatcttcagcatccagagctgcagtttacaggacacttggagaaggaagggtgggggctcaggcttctgcaccctgaaccaagcaaacaaatgccaacacctacagaatattctactcagcctctttaactctttgcttatatcatggttacaacaagatgtatggggccttgaaaaattaagataaaatttaaaagtgaagaaagccagagcaaagggaaataagagttgatgagtgtatggaagccaggggaagaggtagaaaatggaaatctacctttggccttggatgccctctcacttcatagccttcacatgtgctgttcactctgcctgaaacactcccttcatcctcttcacctggttaatacctcttcatcccttgtcactcattttaggtggcacttcctctaagaagccctcttcaacactctaagggtgggttagggccctactctgtgctaccactagccttgttgtttcccctcacaggattaattgactctttcctagtgacctcctttatctgtgtcccagctagactgaaatccctgttttcatccctgttcgtcaaataatcccagtccctggcacaggatagataaagaatggtcaaatagaaccattaaagttgggcagaaaaatccaacactgaacttcctagcagcgaaagctaagagggaaacaagctatttcatagacatattgcatgtagattgaaaaaaaaaaaagaaacacctgttacatgagataagagtaacttttctggctattgaggtgttagggaaatttattccatggattctcataaaaggggcactaaggcatttagcaaagtatgacttcagcaatattcacacagcaattgagaagggatgggtaggagcacttttggagcatcatcctgaactgtaagccaagagcatgatgtcatttctttcaaaaatgaatcaattgaaatcaaagcagtgctttatccaggaagcacgtttgatgactgagtattatgatgactttatcttcctcaaatctttctcttccttcccacttcatcttccccaacttccagtgctactactggtttatgtcggtcacttttacattaaaaaatttttaaatagttttagagcgtacaatggcagtttttttacatggatgtattgcatagtgatgaagtctgggcttttagtgcaactaccacccaaatagtgtgccttatattcatgaggtcattactcttttttaattagttaattaatttttatttttattttttgagacagaatctccctcttttgcccaggctggaatgcagtagagtaaacacagctcactgcagcctcaacctcctgggctaaagcgaacctcctacttcagcctcccatgtagccaggaccacaggcgtgcatcaccatgcctggctgttttttttcaattttggtagagatgggggtctcactttgttgcccaggttggtctccaattcctgggctcaagcgatcctcctgccttggcctcccagagtgctggcgtgaaccattgcaccagacctgtaattacactttaaagagcattccagtcacctggggaacagttagctctgtatcttccccagtccacctcctgagggtctgacccaagaggaggttcttggtatggggggtagggagccctccagcccctaggcaatcctgattcagagggtgaggttgctttagagcagtggttctcacacttgcaaatgtgtcagaatgccctgtaagacttctccgaatacagattgctagactccagccttagagattctgaatcagtaggcttggcgtggccttggggaggctgtatttctaacatgctagagtgctaaaggtgcctgtcctgggaccacactttgagacacattaggccagagaacagctagaagatatcttcttccatgtgcatctgcttccttggaagggaatttctgttaacagacagggatcagacacccttccaggaccatgcatcatgatgacacccctgctgcggttcgtggcctctgcatgccacccctttgtctctggagggggagaaacagtaatataaacattgctaaaacgtgtcgtgtctcgtcagtgaaaactccatttgactaggcttattaaaaagacatcactattgcaaaatgatttaagtgcttcatttgtgaaggagcagaagaggagatgaggagcctctaagaatctggctataaatactcttcaagcatgcaaaatgtgccttgatgcaaactggggtttttttattttcataagaaggcagtgctggccttcttgttggaagcacctgtaaggttttgggaccacatgggatataaaatgaggtggggtgtttttccacccctctctggaataggttctggattttccccccaagaccttatttatggcaaaagacaggcccatgcactcctcatttctggcctcattagcctgagaggtttcgcttttggtaagaaattgtggagacaatccactgacggggactgcagatgtatgtaggtcagaaagtctatttgcaaagtgctgagggagtttgatcatgggtcatgagtgtggcttccagcttgtctctagcaggaggtaggaaagtgacttgttggggtcacatggtcactggtaactgagcccagaccacatcccaggtctcctgactcctcgctccatagtcctgccacagcatcatgcttctgtgaggaactggactggtagctccctaatccccgggggaaattagacagcctggtttcttatctgtcttaggctattaggatctgttgagccttcactgttgggacatgctagggagtatctcctggtggacagtggaagagacatggtggtcatattcatagatggtcctggtggaagaaactaaggcctctcagctaaagaacagctggtgtattctttctgactgtgtgcctcagtttgcccatacaaaaccgagtccataatctcttctctacctgccttgtaacacagatgaataatctgggcactgtacaaggtaaggaatgaatgcagtgacctgaccttgtatgtccagtttggaggggcagagggtcgagccagcttgagttccagatggctgactctgtaccttcattgctacaagattgtgggcaaattcttcaagtctcttagcctttgtttcatcatcagtaaaatggcaatggtaatcattacttcatcttgataagcctgtggggagaaggtgcatgtaaaacagttataacactgcgtgctatctagcaagccacatcaccactattaccaataaatatattttttaaatgtttaccctccccccagtagagtgaattcctcaaagaaaatgacatatcgtagacagttttatacccttctgtgtctagtacaaagcattcaatgcaaattcagtgaatggagtcatactgaatttaattagaaaaattacatttaatgagtgatgttctgtgccagctgctgcgataagtcctctcagcattgtgagcatttacctgcattatctaattttacctttaactgaaactgtgaagaaggtgttagtatccccatctcacagatgaggcaagggaagcccagagagctgaagtgatttgtcctacatcactcagctggtgaatggcagaactgtgatttgaacccagggctggtcaactccaaacagactgtgattgaggagaagcatctactcaggtgggaaatggggtcagggagggcttcacgggggagaagtcatgaaggataagcaggagctggccaggtgacaaggtgaggggacattccaggtacagggcacagcaagagcagaggcggagagcagaacctggtctggcaggtgcaattctggtggttggagtgtcttgtatggggatgtgtttgtgtttggggggttgaggggttgcctatgggttagagatgaggcatgaagccggactggatcgcagggggtcaggagaatcacattcgaggtttggacttcatcctgaaggggagggcaggaccaaaggacattttcaaaaagaggtatgtgggtgtcatgatcttaggattatttcctctttgtgctgaaacacttggggggccctaatggcccttgaaacccccttataaagcccctgaaaggccataactgtcccttcattctagagggacccccaaggccagtgggtggtgtgtcaccctcctatgcccagctcagaggcataacctttctcctggcattcttacaagattgacccattcccactgacatccagagcctatagagccttcccatgtatgaattgctgtcatgcacttgttagttcagtcaacccgtattcattgagtcctcaagagtcagtttggcagagtggttaagtagccaccacctggctggtgtccttcggtgagcgtttgcaccttggtgcctcagtttccccatctgccacctcgagacaacatcagtacccacttctcagcattttgagcattctgtgggcaaacctgtgcatgtggtaagcactatctgtggtggcgatggttattattatggttattatatgttacttagtagcgagtggtgaacccagctgggatgcacagcagagggctggaactggtgtccaacaggcatctctggggaacccgggagcctgccactaagctgcagatttattttgaatttcccctgctgactgaggcagctctgggggcagtaccatgagactgaagccatggcttaatctccttgacgaacatcccacaagccagctggtactgcagttgggctggccctgtatctactgcctcattttgtcttttcttcactcaggttgaagggggtgggagtgggggcttcccttccactgggcatccacctaggctctctttggccaaagtgtccagcaagggtggttgaggtccagatcttacttggtctttgatctgtacccactggctacttaatctcagctctctgggctatggctgcctggtttgttctaggtggataattgctttactaacctccagatgccagaggggtgagggaggtcaaagaaagggtcagatggtagatgtgggacagaaaatagtggggttgttgtgagccaggtgctgggaatcaggcagcccaagctgggctacctctgctacttaccagctatgatcctaagcaaatcactccctctctcaactccccagtttcctgttctgtaaaaggggaataacaaaaatgcccttctcataaggtatttgaagggcttaaggcaaatgacatatgccaaatgcttagggcatacctatcctcagcatttcaagagtgtgagctgtttctcacccaaggggttataatgaacagatctttctgtgcaaattgcaaagtatgggaggagagcaaaaagttgctgtttcctgctgtctgcaggtcagatggtttttgggcttgacagtctatgaatataagagctgaggacaggatcaagccaagacccgtgtgtgcccctgtggtttgtttgtctctctgactggccagtggggtccttcagaacaggacctggcacacagtaagtgctcacatagtgcttgttggatccgtgaagaacaagcaacagtgacggtcccaaggaccccaggtgtgtcctccagcatttaacatccgtgaaatcccagttactcactgctcgcccaagctgcaaatgaggccagtgcacaggatatttttttttctgttccactccatacaaaatatacaacaaatttattaattcctgtccccttctctctggcaggcccttggagtaattgtccctcaatagaaagaatatttctgttggtttggccaagtggtagatccggagaggttttcaagataatttctggttaattggttcttgagtaatctgcaaggactcttctgggtttgcaaaccagactccccccttcattaaattggttttcaatttgcaatcgcctgacagctctgagcatggtgcctgctcctcacctccatccaaagcccctgtgccccatggtgtgggaagggatagggatttatggggacaggggaaggtcaggggcaccttgtctctgagaaaaacatgtgtcatttcccccaatttgaaaagactaattgtcctttgggctccagactttgggttctgtgaaactcaaaattaatgcatcaaattaattgtgtggtccccttgctcaggccggttagcataaattaaatttcacactaattggctaaggtggagagaacacagtcctggtgcttggaattaatgctaatttcaaggatggtgtttggggtgtgacctggggcattcctggcttgcacctccctgtattgtgtggccagtgcaaatcagcactcttgcagcaagaatgattttgcacagccttaagcaaatctaaccccttcaaatccaagtgtgaggccaaaattaggaggagaccctggcagtttctatggcagtaattcctaaatttttttgttcataaaaatcaccctggagcaggttgaaatgtagattcctgaattatgctttagagatcctggtttgggggtctgagagtcctataatttgcattttcttttatttttttaagagtcagggtctcactctgtcactcaggctggagtgcagtggtgtgatcatagctgctgcagcctaaacccctgggatcaagtgatcctcctgcctcagcttccagagcagctgggactataggcacacaccatctcggctggtttatttttaaaaactttttaaagccagggtcttgctatgttgcccaggctggtcttgaactcctggcctcaagtgatcctcctacctcagcctgtcaaagcactgggattacaaacatgagctatcatgctctgccctagaatttgcattttaacaaccatctgaggtcattgccacataagtacttccctggtgcacggtgtaaggaacagcaagagaaagctcccatgctggagacaaccaggaacaccctaggagagtccctcattaattaactggaggtcctgacttggacctgactggtctgagttcaaatctcagttctgccttttacatgtgatgtgactttgcagtgcttcccccaagccttctttctcctctgcgtctattgaaatgtgcattttggtctcagcagtcggtgatgcggtcaacagggtgggaggcagatgggctggagaagtgaaacagatggggagcatggaatgcacagagcagcctcagattttgttcactctttttgaaagatgttttgttttctgattacaaaatcagttaaaaaatcaacagtacagaaatgcatcacaagaaaattggagttccctgtgagcccatccttccaggaaaaaaaaaaaaatctcaattaacagtttgggagtgctttgttctgtgcaaacaaaaatgggattacaccaaacattctattctggaaatttgcctttttttcccctttggcaatatatcttggggatatattttttttatgtcagaacatagatctgcgtcttccttcttcatgggacagctgaataaattttgagcctgcctaagctgacagtaccgagagaggctagctcgggaagggcagctacgttgctcattgtaagaaccatttaccttctcagtaaagataatgcagagtcgcctctaaatatcagtcatgatgcagagggtccgatgaaagagtgaggcattctaacatcttcacatgcaaaatttacagcaggaggacatgtgaccgcacccaattcaatgcattttacagctcaggtgaccaaggctccagagcaggagggaatgtccaaggtgttagttgttgagtctggactcgaaccttgcaccctacctctttctttttttttttttacaattctgctgccttccataagaggtagcctcagttttatgagctgcccttctcctacatagggttgtttctctgcctcttagccataaacactccactaatatatttctcccgttacgtactctgccatatcctcaaaccctgaacgcttcattttggaacgataatgccacagaagccctgctcatttggcatcggtggctggtcagttaatcagaaaaaaaaaccagtgcaggtgggaattcatttaaaaattcctattttaaaattaattacatgtgtaatttaaatcactgcatttctgaggcaggacccatccatttctttctttcttaaaccacgctcctaatatacaaccgtatgatttccaattttggcttctttaaaacagagcaaatggcaaagtaatttgaatacaaaaacctaattttttacttcaagtttctttttagttgttgcaacaacacctatttggcagcattttaaaaagcagcttacctttattaattccttccaaggcattcaacctagttttcatggaaactctgtccagccatattttataagtttatgtagtagctaactgaatagatagctatggtaaaaatgcaataggcaaaaacagtttgggagcacacacatgtgatactggatgtgcatgcctgtcacctgctagaggcagataggccatggggccattgtagagaggtggtctggtggagagcattctggtgcagtgggcatccatcagtgtgtcttactgagggacagtgttggtacatccagtgagatgatttgctaaaagctggttacgaagagattccactaaaatggccatttttaaaactgagcacttactacgtgccaggcaccgtgctaagctttcaatggattatctccttgaatcctcaaaaataatgatgtatgttgttttcccccctttaaagctgagaaaactgagaaccagcaaggcatcctgcttggtgtaaaatcacacagctagtgagtgttgaaccacatcaagaccaataaaattctgaagtccatcctcttaacgagttgattatactcaagggttgctttcccatgatagtgatttgtccaaaggcgatcctgtgcatggggagagaagggttggtggctccatcgagtgaccgttccttgatcaccccattccccatctcagattgctgacttgacctctgaccttgccgatgagcgcttcaaaggtgatgtggcctgccaggtgctggagagtgagcgggcagagcggctacaggccttccgggaggtccaggagctcaaggtgagtggtcaggggtggccaggggtggctgaacacggtggctaaaaatggttgggtctgctccccgaccctctcattggagatcagtaagcttaagcaagatgcacaggttgactgactgctgggctcaaggtcctgggggacacttaggtctcctaaggcttggccttgggggtgttatgggtggatagtccctggctagagaggcgaataggagaggattgtgcagaaggtggacagtctttggccttggaggtgatttgggtgagaaatatgccgaaggtggctagcccatggtcctggattctgcatggctcagggctgtgcagagggtggccaatccgagccttggaagcacttcatgggtaagatgaccagcccatgtcttctgtccagctctagtttagaccttgagccctttcttctagagcaagcatgaacaagtccagaaaaaactgggagatgtgaataaacagttggaagaagcccagcagaaaattcagttgaatgacttggaaaggaatcccactggaggaggtgagcagcctgggacccttggggctggaaggtgatggacaaagttgtctttcccatttattcagtcactcatagagcactttttaggtgctagatattgcatgaggggctgcgactttggcagagcaaacaggcacagcgtactctcttggagcttacagtctaatggaataagcagatattaatcagataatccaacaatatcccaggtaacaaattatctgtatgatatgtgctatttagttttaatgcaaagaatgatttttaaatagtggctttatgggcaaggtacttttatgtttatgtgaatattttaaaaataaattttgagaggcctggcgtggtggctcacacctataatcctagcactttgggaagctgaagtgggaggagtgcttgagctcaggagttcaagaccagcctgggcaacatagtgagaccccatttctacaaaaaatttaaaaaattagcctggtgtggtggcatgcacctgaagtcccagctacttgggaggctgaggtaggaggatcacttaagcctgggagacctaggctgcatttcagcctgggctacagagcaagaccctgtctcaaaaaaataaaagcaaaaagaaaacgtaaattttgaggaaggctgtctagtggttaaaagttggaacctatgaagttgtatttctggatttggattttggggcaaagaaattgctgtgcctcagtttcttcctctttcaaatggagattgtcttggataattgatagaaaatgtttagccacatgtatagaatagagtgatgaatagctaatagctactttaccattattatgaggaatgatgagatcacagttcatccttatagcaacctgtggaacagaaactactgctctccccattcaaagagggtaaagctgtgtcaggcgcacaacagttaccaaatggcgagaaggcgagaggactcttggttttacccagggatattatacatttgttcagtagtgccaggagtttctggaggtgtccttcttatacagtttcctggagacctcgtgattggatggcatggtgacatctttgccaccttgtcaccgtgcctcttactctccccagcctaatggagttgggtgagaaggatatccagtgggtcagcttctataaaatgtcagcattattccctccgtgtgtccagagaatttgtgcccttgagatgtccaggggaatggagatcaggggtctgtggaaaagagacaatgagtatttattttctgtttcattcttgttcttgttatcctggctacccccgtggcaggcatttagcagggaggttaatacagatgagtttgaggctctcttataagcgagacccaacaaggtagggtacacatagagagaggggaacatgttggtataaaatcagtagtgtgggacagtctctggccttggaggtaatttctataaaatccccagaggggcgccagtgtcagttccatctgcgtgaaattcatgtctaaataatgcttcccagtttgttttcctctgttaagattggggtgttaatgagagggggacatgtgcttagctcatgggcacattagtcacaatgctatataggctctcagctctggatgctcattccaagaagccaacccacaaatattttgtttttcattatgaaagtaatacatactcattatagaaaatgtctaaaatataggaaatttgaaagaagcagtaaaacattttaatcatatcatcgcagtggtaccacaaccacctctatggttcaagatggagtatgaattatttaaaaaaatatgttttcctttatgcatggctaaatatttaaagagaaccttttgtgatatgcactcagcgtggagctggacactgtgggggttacagagggattttaattgggccctgctctcaagatattcacgatataaatggggatatcaggtaaactcaggaaaacatgttgattaagggtggcactcatgggcagggaggttgaaggtagagatgagccttgaaggagaacagtttcccctcttgttcgtgttgcccactcatgccacttgctctatagcacatcatagcacagagtacatgggaagctgcagaaatgctttctgctgctgcttcttacttttgcagtccatgctgcttgtgattgtgaggcttttcctggtggagagatagtgtgcttttcccatcatgatgtttttaccttggtggaagcttgaacaagctttaactctttattattataccatccgttatttggttaatgatgtagaaatctctattgaggtcacctctttcaagaacttaatcctaccatccatccatctatccatccatccacccatccacccatccacccatccacccatccacccatccatccatttatccatctgcccatctactcacccacctatccatataccctaccacttatttatatatcaatccatgcattcatccacccatgcacccacttctctgtctacactaacatccatccatccatccatccatccattattccacctatccaaccaactatttatccattaatcctccaccctatcatctagtcaaacgtcctatccattcaactatccacctttccagtggaagttattgagcatttactatatgctaggcattatagcatattctaggaacacaatgatgaacaaaacaagtttgttgtcttattaattttggttctcttctggatttctataagcttctttatgaaagccctgatcatactaggcttcagctgtctttttacttgtttcccttgcttgattattctggaaggtgggtggatatggcttcttattcatttcattatcttgtacaaagtagtgtgctcaatgagtgtgtgaatggatggatggaaggatggatggatggatgatagatgaataagtgggtggtctctatctttggtcatccacttgtggaatgttttccacaacttcattaacttaatgggcattattctattattcagatagtcaaaagataagacatcttagcctaaaatattccattctaatcagtcaaacagttttaatcaaaccagccaataatttttttgagatgtttaccaaatcaagggatttggtatccatcttatcttgtggagacatcttctgaacagtttagtagagtcttgaattattgctaatttactcatttgttaattgcaccaacagccaatgattatatactctgtacaacccaataaagttggccagtaggatgactctttttatctgattattgtattaggttcattaagcaatccatgagcttgtatcaacatgtaggggaatctgcttgtagggaactcttccagagggtgtgaaggactcacagatgactgaaacagctcccttgcccttaaggattatgaaatttccttggaaaagggaagatatgaatacacttatagagacaactaaacagtataaggcaaccaatcttagaagagtgagcactcaagaactttagacagttggaggtggtcaggacaggctgcctggaggaagcgttatttaaaactcagagttaaagcatagtttcttggtccaaggttgaggctcaagggctctgtgaatattgtgaaattgcatgccaagagccaagaaagtggaggagagccactcacactcttgccttacactcatttggcctcttatcctggtctccctgactccgttaaacagcagacgagtggcagatgcgcttcgactgtgctcagatggagaacgagttcctcagaaagcgtctgcagcaatgcgaggagaggctggactcggagctgacagccaggaaagagctggagcaaaaggtaagatgtggggatagtctgggccacagaagtgttagagagtgggcaggctctcacctccactgtgggtgatcgaggtattagctgagcctgaagagggaggaagaggacacaaaccccttaaggtttttccatctccactattattacaaatgctggtcactgtgagacatgaaaaatattgtctgtacatgtggatcttctatccagagactgctctgtggtgtaaagaacatggatattaactcaggatatctgagttccagttccatttctacgtgaaccttgtggaagtcactttaactcatgtttcttatctattacataattatcagcggtctcaaaaccttcacatttccctgttgcctctgttctaatctgctaccttcatctctcatccagaccaaagcaatagcctcctagctgtgctccttgcctctggcctctcctctcaaccacctgccacactgcagccaaggaatgtttcagggtctctttcagattgttctgtgatcataaagtatgctgactctcatgttggatttttttccttgtgtgttttgtaaatttcgtttttgagctcatcttcaacaggtttctgtgctcctcccccagtagtcacaggtgttctgcattgtggaatgtttttttttttttccgctcccagtgaatttttgtgtgtgtatttagctattttttattgtgagttcaccttcagcaggagatttaatttttttaacattctgttgactttgatgggagccctttgataacagggtcgtgggtgtgttctgctagaagaaaccctttttcactttctttggcagcagtccttgagataatgctaaattcttggtctcagatgttttgcggcatgtaaaaattgtcaattggatctctaaacccacatgaggcttagacctggggtttaaaattcttacgagagtacttcttgccccacctagatccagggtgaaagcaagctttcttaccaccttccaggccagcaggtggagcttttattttctcttctcactgaggtgcatgcagttctttgaggggtttgtcaatgcaacggtcttcattccaactcttcaccttccatgagcccagagccttgtctcctgtctctgtctgggcattgaaacacaaacctctatcctaaaggacacttctggatctatcaactgctcttccccctcatcctggccgccataatattagtatgtaccattactgttagggctttgtgtcctctgcatttctgatatcctgaaatttccttctttcttgaaggtaacattacaaatctaatgcaatcttatctatatataatatatttttatctagcctttctagatgaatgtacagatagtttggtctctctgcttgtcttctgtggcctccaactatccctcgtctacattctaaccagttcacactctaacaaatggtgtgctagtaaatggctccctggaaaaaaacaaaaagccctgatttgtagcacttgccaatttccctggtgtaaatactcccaccatggccaatttcaaactaccattgtgatgtcactaacatggaatttgaaagggatgcacagaattagctctgtgcatctctttcaagtcggtaccagctgactctggcacaccactgattccagccacactcagttttttttcttctccttccaaaaatgcctgattctttctcacctctgggactttgcatgtgctatttcttcttccccgagcaatctttctttttctctcctgcctagatatctccaactattcttaagatcttagcttaaatgtcactctctccagaaagtctttgctgacgcagattgggttgggagtccctgagttgtcttccaaaacataggcctcatcatgttgtattgtaattacctactcacttcatagtctctcccattcgatatcggagccatagggtggaggttatatttgtgtatctattctattctcaacgtgagcaaaaagtatcatgtgattgccttgcagaggtgggcctgggtgagatcacatgggattttataaacaatggaagtgactcttgatatcctctatgctgatggtgatgattttagtggtcgctttcaaggtgaacattgcatcgtggtcctcaagagacatcttgaaccatagataaacacagatggacaactgcaggaaagcagcccagttctttaataacaaattataaagttgagtcagtttccctgatgaagggggatatttatgctacattaaaaagtaataaaacagcaaccttttctgagcagcagaatataagagaacatcccatttgccttcaaatactgaatttagaattacaggcttcattaactcagagttttgcttatttaaagcaattttttaatgaggccatttcttcaaagccagtgtgctgagttgcgtgctctttcccagatctaaactaggacatttgggagagtgtttcctggaggaagatgcaagagtcttgacttttgtttgtttaaggccgtgtgcattctggtattaattcagtccatgcaaagtgccatttgctgctttaacctttaaggcttgtcacttgggattccgggtcagattttctaggtatgtcattttggctgctctgtggctaatcctcacatatcccttctgatcatgtcggctggtggggatatgagttatccggtggctcaggggtcatcaagttgaggcagggtaggtaaagtctgtgggtgcattggctggaggtttattgagcaaaagtaaaatcaaccttaagagattgatggaattatccccactttacctctgagcaaactgaggctcagaaaagtagcttcctggaggtgaccctggaggaaggtagtcaagacagggtctccccattccagcatctgctgttttctcattacacaccttggaaatagcaactccttgaaatacaaagtaaaaagctcgttccatgcccacagagccgggtaattcattctattactcttacagcttggggagttgcaaagtgcttatgacggggccaagaagatggctcaccaactgaagaggaagtgccaccatcttacctgtgaccttgaggatacctgcgtcctgctagagaaccaacaaagtcgaaaccatgagctggagaagaagcagaagaagtgagttgcatctctcaccatcacctgggctgccagggtgggctacattggagctggcgttttctggggtatccaggttctcctaactccctcacttcaactcccttgttttgctctaatcttcctccctgtcccgtcacaccttattcctgtatggttctcccaagaatccagcaagaaattattcttttctcttagccagcctcaactatgtggccaattgatcttgtgaccttggggaactttctttgcctttctgggccttaacatccccatttgtcgagtgaagggtttgttgcagacggtcaagacagcatggcgattaggagcccaggcattgatataaaagtcatctcattcaagtcctaaaggtgcctctttctagatgtgtgaccttgagcaggtcattcagtccttcccagccagattccttatccgtaggttggtgataagatcgcccccttgtgctgaggactaaatgatgcagtcagtacatctaagtggactgatcctggttcctcttcctgttggtgaaaattgggctagagaataaggaggaggccaaaatatggccttctcatttaggacttggactctcagatcacgtgagccattctggcagagactgggccttgtgcaccagcaagatgctaatcttgaatctgcacggtgtggttcccatatttgcattccctttgggttgctgttacagtgaggcgatggtggagcctggatttgtacccagattcgcacactcataggcttcttcatgcaaaacctcagaacctgtgatgcttggacgccttggctgtgtctaaagttctccagctcactcggtgaggggaaaggtatacaggggtcctgttttgagccagccaagtcctaatggagatgtcatactaggcaaataggtgggaagcagcctcttttagaaggcccatgataaaatacagaaaaatgttcctgtgtgagccaagatgtgaatttgtggaaactgcctcctttccaagaagtaggaaggagaattatatttccatggaggtggcatagattttgaacttgatctgcattaaatattatttatcttatttatcctacagctttcctgagctggcttcttcatctgacaaaggtctttgggggattgttagcgtgctctgcatccccaaaataagaaagatttattttttgtttattgatatctcactctgttcccctttccacctccctgtgggtgctctggctgaaccttacccctgcagtggggaaaatggcttggctccatcttggccacctgctgtgtgtccttggcaaataacaccacctctctgggccagagagtgactgatggttcagatggtgcagaagtctcagtttaacaggtcatctgatctggaagaatggctctgacatatacccctgtctgtgaaacaagaggttgggactccatcattccccaagtttctcccagctgtgaccctcttggcccccaactatgggttctactcctgttctgagaggcctaactgagggtttcaactctctgatgagtaaggggccagcctctggagtttgtgcagccagaaaattccatctgtctggtctttccttttccctttggacagaatccctcattccaggcacttatgaatctccccaggataccccccaagcaaagttcctatttcttcatatttgcatgccctcctctcaaaacttagctttcttgtgatgccctctgctctgttaccatctctaggcagaagctaatttatgttttgatgccaattgcagatagcaggcattacctttccaggtagattagcattttatgtctcagtctaactgtggaagttcaggcagaatgactatggtgaagggaaaatttagaagtcagtaatacttccttgcatctctcgatgcttaatcgaaatgtagatgcagctgcctcctgagtttgctgggcccaggatagagtgatgcctccacattggtagagttctctgtttcccgctttggcttctaagttcagagtggcctgggatggtttcattttggttggattgtttgtggcatgattaccctatgggtcacaaagcttggttctgagggctgatgaaattccgggtaagccctgtgctagactcactgattcccacactcaagggtggctggacccaaggccctttcttaacagattgaaggttgtgtgcaaacctatctggcctcaggcaattggctggtcagtgtgggctgtttgctaggagctggtgtttgtagtagctattctttggcatcaagtggcctgttaagtcaaggactcctctgcaccatcagttactgtctggtccctactgtcttacctcacctgtcccaggaatggacaggtagatgggggactagctaagacattagggaagcccaagtccatttctaccactttggaatttggggctgaatcactcctcctctccgagtgatttcagtttcctcctcagtgaatggatcgaataacatgtttcttgctgaactgttgtaaggacgacatggatcccagcccaggacctgacacactgggactgctggatcatcaccctcatcacaatgcttccattcagaggcagcaaatagtgccccttgaatgatgtcaccaacagccaatcagaaagctcctgagctgttccaacaggagggctccattatgattgggtctctcagaagtctgagactttgaatgatagtctagtattaaggaacactggatagtcttataataagcgagactttcttgccaccaaaggccaaaccccatgcccacttctgccatatcaagatctctggaacaatgggacttcctgtttgggccaaggggaagtgactgaaagtcacaccttactgaggcttggcaaagccttctctatcggtttcctcacctgtgatactgccaggaggctgagacaactgaacagagtgacataacatccaggaggggcttctcacccagtggtcatcacagaagggcaggagggcccctaacaaggcattaattccctggatgactttcagtaggactgactagtctttgtgttttctgcttgagaaacaaatgaggacaagaatgtataaatgtccatcattttattgataatcagcatgctttagtatggcatatgagagtataagccagacaatatgttaaaatatgaaatgtagaatatcctcattctacttacatccattcgtttgttcattggtcaggaaatattggaagtcaaatggggcctggtagatttaaggggccttgacatatgctggcagaccagatagatcaggtttttgggttggttttttttttttttttttttttttgagacaaggtcttgctctgtcacccagactggagtgcagtggcacaatcatggctcactgcagccttggcctcctgggctcaagggatcctcccacctcagcctccagagtagctgggattacaagtgcatgccacgatgcccaggtaattttaaattttaaatttttaaagtttaaaaattttaaaaatagagatggggtctcactttgttgaccaggctggtctttaactcctggccccaagtgatcctccttcctcggcctctcaaagtgttgggattacaggcgtgagccaccatgcctggccacctttaaaatatatcctttattctatatctgtatatagttttattctatttttattcctgtccatatatttttattagattttagggttagcatttagattagcattttagtagggagatgatgggggcagcagaagtctcagtctaacagtggaaattcaggcagaatgactatggtgagggagaaatctagaattataagtatatcgaatagttctgtggcaagtctacctcaaccctaaaaattgctctgtggtttttcagattcccaccctacatccacagccttacgtaaaagcattgagaaaaacttccaacttctcatactttctctatctctcttcttccttttgctctctttctaatggttcttgggaaactagcggcctctctgcagcccctccctgcccctgcctcaatcactcccctgcccacctgcctacggggccctgacacgtgctctgctttgcacaggtttgacctgcagctggcccaggccctaggtgagtcagtgtttgagaagggtctccgtgagaaagtgacccaggagaacaccagtgtccggtgggagctaggccagcttcagcagcagctgaaggtaagggatgggggacacagagctatcttggctcttggtggctaaatctcgggaaactgcatcgtgcacctgctgcaaatggtgacagagagaaaacttcacaagggtatcctggtctgtcaagcagctgaatcccagtgtgtcttaataaaatagcaaatggtggctggtaaattgataatcagactttgagcaagattgatgtcttgatcttgcttcagttacctgcacaggttccgaggtgcttacctgggaggtataacaggctcagcagagaatgagttagctataaccttgtccaggagcaatgtcctggtccaagcaggctccaatgcagagagattttactaaaatacaacacgggtgcctcactcagctgctcctcatccttttgtggttctctactactcgcaggagaacctctgagcgctttagcctggcgttcaactccttcacgatctggcccaaagttatttgatcctggagctgactttgtaacctggaagagtcatttctgagcactttgcctccctgctccaacatctcaatcccagcctcagacggcacacagggaagctttagctgtgtgcctccacttcccttacaaatggggtcaacccttcctgtaggtgctctgagatcgaactctagggacaatttattccaatcctacctcccacccccaactccatgcctgtaggagctataccaagagcagcccttgctggtgtcccacagggggcgctgtgagggacggtggggtccaggtggaaatggcaggcattggaaagtggaaaacgccactccagccccagttggttgtagaggtatccctgggggaggagggaggcatactcatgtgactccagatctctgtcctctttgtctctgtagcaaaaggagcaggaagcctcacagctgaagcagcaggtggagatgctacaggaccataaacgggagctgctggggtcaccctctctgggggaaaattgcgttgctggcttgaaggagaggctctggaagttggaatccagcgcccttgagcaacagaaaatccagagccagcaggaaaacaccatcaagcagctggagcaggtaggaaagccctgtctcagggcaacaccctgtcccatgtctccaatgcagagtgatgttattaaaatacaatgtgggtgcctcacttggctgctcctcatccttcaatggctccctattatcccagggaacctttaagctcctaagtctgacattcagatccttcctgatccagctctcccctgcaaggttcagtgtcacctcctcagagaagcctgccttaatcatcttgcaaatagctcccactaggttgcattcatttcccatctccttagctgggttgctttactctctggtacctgccatcgtattagatagtattttttaaaagtttgctttatgcctttctctctcattaacatataagcttcatgaagtcagattgtttttctctttctcttgcttcttagtgcaatcctagagcctagaatgaggccaggtacatagctgatgctcaataaatagctgttgaccaaatatctaacattcattgagtactgtctgtatactaacctcagccctaagctctccccacacatctcacgaatctccacatgaaccttatgtagggagatcttagtattatccccactttacggatgtagaagttgagactcagagacatggagaaagtatcagggatgggatttggaacctgtgtcatctgaccccacactgcctcgaatgtctgctatgtgctaggcattgtgcacagcttcggggcagattgaagtgctactctttggggaaaataaaataacaaagggaataagacaaaaatatcaaatactcttgtaccagtaccctctgcaaagtaccagatgaatactttatttgtctgcttgcttatttatgtacttacttatttacctcattctataaataatttgaggcagcttacaagatacatgtataatagaacacaaaaattgtaaataaaacaatccaaaccacaaaagtacaaaataaaatagacactaaggaggagggtgggggcagtgaattaataggcagataaagcataacatatggtcttacacacataataattttagctctaaaattcctggtggccagaaagaaaaaggaaatgtgagttacatgcctgagataaaaaaaaaaaaaaaatttctaggggaagtaagacttcttctgatgcttggctctaaacgaatttctcttgtgggattttgtaaaaggcaattattttaaagtgttttttttaaaaaaaatgctgaggccaccgttatgcgagaaaatgtgaccaggtgtcatgaatgtgtaaagcagatgaactctgagcagctctgttgaactgaagtggggatgggtgggacaggggatgggggaaccaggggtcagctcttgcttcttgctaaccactgctccaacaagatggagcctggtgagtatcaagacatgtgggtggtgggtgttggggaacaagatccaggaagtcttggatgctcactaaggagcgataaggaagacaagtcttttactcagtcagcctgtatttattaagtacctcctctgcatcatgcactctgtggatgctgagggtgcaattgcaaataagacagacacaatctctgccctcccaaagtttatagtcatgcttagtgttaggggaatgttgaacttgaagatctggtcgtgacagcagggttgggggagagatcggggaaaacttcctggaggaagtgatatttactgaagagggaagctggaggatgaatcagaattggctgaatgagagagttctaggcaggggaccagcctgtgcaaaagcctgaagacagacaggatagtcgtaggatattcaaggagctgtaatacggggtctttgaggcagcttgttgcctgtatgaccttaggcaagcccctgttttctccagacatcagtctccttatctgtacaatcaaatatggagccttatctctcccctagcttcctgccaaccacagctatgaatcagtgaaggtttgtgaagaaggtggaatatctgtgtaggtctttaaagggcatggatgacggtgcagtgccatgtagcaccccagtgttccttgtgttccttaaatgagcaggatcttcacagagccaagaataaaacaagccctcttgaaaactgtgttaactctttaagataccactgggggaccacttagtgctcggaagcaaaaatgtattaccatggcctcagggacccaaaacttaatgcagctgcctgaatttccatgctcagttcacccaggagatgaggctgactcaacactttcatccgtcttcagcttcacccataacctcaggctgcattgtgcccttgtagacatccagtggatatttattgattataatacaacactttttccagggaattttatgttaactcgtataagtttgacataaatggtattgcagatgtcaagaatgtccaagaggctagaaaaaatgaaaaagaaatattatagttacttgctcaggctccttggttttggattatcttcccacaacccctgtcattttaaaggaaaaaaaggcaagaagttgacatttaaagtgagcctactttatgccagaaactgtaacagggcctctgacgtacactatccttttgctcctcaccacggcatagcagggaatattatcaacattttaaaagacccagattgtttttttctgtccatgttggggacagcacttgttaagttccaaaagcttgatgagaggtgctgggacagtagagtaaatgatcagaaagttatcatttctacaatgtaacccattgtattagtctgttttcacactgctgtgaagaactgcctgagactgggtaatttatgcaaaaaagaggtttaattgactcacagttccacatggctggggaggcctcaggaaacttacagtcacggtggaaggggaagcaggcaagtcttacatggtggctggcaagagagagtgtgtgaagcaggagcagtcacgtataaaaccatcatatcttaagaaaactcattcactatcatgagaaaagcacaagggaaaccaccccctgtgatccaatcacctcccaccaggtccttcccttgacctgtgggaattatgggaattaaaattcaaaatgagatttgggtggggacacagagcctaaccatatcacccatctacgctattgagttccaaatgctttttcatgatccagtaacattaaagagtatagacagataaaggaaagcttcaaagctttcttgggccctgtaccctggggattctaatccagtaggtctagggtgaagccctgcaatttgtatgttttaaaaatgcgtttgtaattctaacgtgccacaaaatttgagaagccagggcttgggccaatctgtaaatcatgcagatcaggaaagtgaagtcttgaactagacctagaactcatgacttttttgccttccactctagaaccctttatacgacttcacacagttccaacattatgcacggctctatgcctgttgcatgtgttttggaggttcttgtttgaaagacccagctcattcatgggatcacagctcttaattatgtcaggttgccagggagggaggggatagtcttttctgttttcgaaataatggggaaagagaaagtaatatttatgtatcagatactgtgctaggtgctttatatcatcatttaattctcatagtagcattctaagacggttgttttctacagagaaaggggactgacctagaggtaaagtgaattgtctcagataacattttgggcaaatcatcttcttttccaggctttcatgtcttcatacacttttgtcctaccattcatctacctatccactcacccagaaaaccatcgctgttgcctgctccaggaatgagaaatatgtttcatcttaagagtgttgagaagggggccgggcccggtggctcacacctataatcccagcactttgggaggctgaggcgggtggatcacctgaggtcaggagtttgagatcatcttgatcaacatggagaaactccgtttctactaaaatacaaaaattagccaggtgtggtggcacatgcctgtaatcccagctacttgggaggctgagcaggagaatcgcttaaagccaggaggtggaggttgtggtgagccgagattgcgccgtggcactccagcctaggcaacaagagggaaactccatctcaaaaaaaaaaaaaaaaagagtgttgagaaggattctgaggctgcttctaaactcagtgggaaagtgtgattgatgagtgatgtctgttataagcacaagaatggatagaggcaatatttaatctatttacccaccatttgtgatcttccaggatgcctagggcaataacttgactctcatttatgtattccaaaaatgagaaatgcaattggaatgccaaggatgacatggagggcttggagagttagagtgggtcaccctcacgtgctgtccttgctgcccccgcagctccgccagcggtttgagctggagatcgagcggatgaagcagatgcaccagaaggaccgtgaggaccaggaggaggaactggaggatgtccgtcagtcctgccagaagcgggtacgtgagcagtgaacacagctgtgcccttggatcctggcaggtctggcatggattccctcttccttagagcgaggagtaggacagggtctgggatctggggacaagctctttctgcaatcatctgagaccttagcttcgaagtgacttcaaaggtgtaggagcggaaatgcccatcttaaatatgatcttggaacttccagaagcctctggaactgtccagcataatggctcagagatttctactaagtccccgtaatgccatgtgactgatgccaaggacttgtaaatttcaataatagaaccaattctttcttactattttctttacaagtcaaatcatttcttaacattttatccaaagtctttgtagccattccgaacagtgtgtaagaaagcaataaccccttgacatgttatcacctagaagccatcattattactattttaagtgttcttttatagctctctttcactctctgtacacacatgcagatttgcagagatatcattttcactaaatgaggccatgtggttctgaagcctgttgtctctgcagtttgtcatggcctcttttcatgtctgtaaatacagatctaacttatatgtttaatggcttaacagtttttcacccaaagcttatcctctaacttatacagtaaatcccctatcactggacattaggttgtttctagttttctgcccttataaccagtgccgagataaacattcttagagctgtattgatggatttgaatgtaggatcttcaaagtggaattgctggaaagcttcgggttaagcctcgtttaacaggttctcacatgtactctataagaccttccctcccttctcgtcccctgaatcatacctatgtacagaatacactcaattttgccttgcttgatatatagttttgttattttgtgtgtttttcaagatgggttttagcttttccagtctttattctaaaaacagatataaagagagcgccttgtatttctctccatcctaaacgaaatttctgaaacgaacttgctttctatagaagtgaccatcactcagtactttttccccctccatgggtcaggagatggaatctctcagtccctgcccatattccttcaggtgaagattgcacacatttctggtttattctaagaatgcctcaaagtatggtgtgtgccctgagccagggctccagtgagttggagatgtgacccagactctcctgaggcttttctctggatagatttataaaaggagagagtgaagtcagagaacggtgtttttctccttataacaaatactgatattgacttctcattctggtgactgctctgttcagtctatctctcacgttggcaggaaatcaatagttagtgacctgggtgggaatgctggggctgtctggggtggcagaaagagctggggtcaggagagaggacactaactcctctaaacagcaactaattgcagagtatgcacttcggattttccctgggtcttagtttgcccacccgtgaaataggatctctgatggcatgaggtggaaatggaggatggataatatatacaagagaggctggtgggggtggtctgcaaagcacagccacagtagggtgtttgctctagtggggaatgtctgtgtttgctgggtaattgctgagaaatcagagccagttgcaaattaaatgagtcgctcatagtcagatgtctgagttcaggctgctgtagcagaatattattgtctaggtggcttaaatgataacatttatttatcacagttctggaggctgggaaatctgagatcaaggtgctggcagattcagtgtctggcgagggctgtcttcctggcttgcagaccaccacctcctgtttgtacgctcatgtggtggagaaagagagtggaagacagctttctggtgtcttcaggcactcaccccaccatgaaagctctaccttcatggcctcatttaaacctaattacttccctaaggccccacctccagataccactgcactgagggttagggtttcaccatatgaattgtggagggacacatatagtttataacaccaaaaaatctcaaatgcaacttttttactgcatcattgtgtatttaataatggaggggatgcatttttgatatgttggttataatattgttcagagcctttaaaaatcaaagtgcaaaggtttgcaaatattcagcagtggccatggctgcaggagagaggcatctcttctactggggacctgggggagggggtttcacagtcaagggcaaggggttccccatcattgaccagccctccctactgttgtccagctcccaagcttttaggctcttaaattctcccacagagacactaccacccaatcactagggcagcctcatggaacaaagccacaagctctacattcctccgccttctgagggtccttgccttgtaggatgtgtctggatggagttcatttaccctgtgatgtttcttccctgtgtatccacagcttcatcagctggaaatgcagctggagcaagagtatgaagagaagcagatggtcctccatgagaagcaagatttggaaggcttgatcggaaccctctgtgaccaggtaagggggagacattggcagacattcagaggagtatctcagggacctatttgagagatgggctcatggagagaacagcctgagggataccctctcctccatcagctctgttcccaccatattcactggctcttcaaaggagaccttcaggtgcctgcaaacagcagggtttttgtaagaacccatggggaataaagagagtggggccagccaggagcaatggatgaggctgtctttgccttcagcagctgttgggatcagagtccaccagacagtccttcctttaaggggatgtatgtgaatggccactgcacacatgactgccctcctgagaacatgacttttgctagaagcagtcagccttggagccaggcaaatgtagctttaagctccagagggaccacttctgtctgcacggctttgagtgagctagttaacagctctgagcttctggagagtggagccttatggggttgtggctatcactgtacaccagggttctcgactgtccatcagtgtacaccagggtcctcaactgcatcactatgaacatttggagctggatcattccttgtggtagagggctgtcctgtacattgcgggatatcacgcagcatccctgacctctacccaccacattgcagtagcccacacctcagttgtgacgaccaaaaatttctacagacattgcccaatgtcctttggggaaaaaaaatcaacttccctcactactgagaactgttgctgtactaatgtagccagcagagctcagaggcagcttccgatttcagagttgcaaggaatgactcttccacctcctagatactctattcccttcctgtgctgctgctgcatgaaatcccaacacgggagagaaatgcctgtggcttctatgatttattttaaagtatcaaaggagtgtattttaatgtatttgcttaacatgggttcgatgtctattaattagtaatggtcttgttatcaatatccttccctaaattcattaactttattcacaaaacaatgtgggtgcacttcaggtgatcatcttgggcagccatgccttggacaaaataaatgcttattatgtattaaaaaacaaattgatttaatgagtgaattccacagcagggacacacgcggcaagagtaagagttggaagctgagggagtcaatataatcttccttcttctctgggttttctaattttccagccaaacaattgagaccattgaattcagagccattgaggtgactttccttcagcatcagggcaagagagcacagcccagtaccagattctagaatgatagaggggaatcactgcgagaaggttgcattctattcagcatagtctgagaaaacagaatagataatctagtaaagcaaggtttttatacaaattgcaaaaataaattttacatgtaaagagaaggtaagtttaaatgaataaaaagccatctttgtgttagtcaccaagttggatccttttaataaattagcacttttgatgattttaaatgtttttgttatgacctttgccaaacccatggaaaagcagaacaaataatgtaatcggtgtttatgaaccaagcactcagggttcacataaattaacattttgccatttcttattcagatgtttttaaggaaacaaaacgttttaagaacggttggtggcctctttatgtcgcttcctaatctcaatcctggctctgcttttctctttctttcctccctccccagatgaaaccattccccggggtttgaggtgtataattcccctgaatgtatatttcaacttcagccacatgcagcaatatgattctgcactttactttgtccccctctatgttatgtttttgagattagtctataatgatacatgcagttctaattaattcatttcatttctacacagcattcatttttttaaaatctcctacttctattggtgggtagttagttacttccaccctaaaaccccaaactgcagtgcatagtctcgtatctgcctcactgtgcacacgggcgagtgtctctccagggtatgtagctggaagaagaattgctggctcctgggaatgtacaatttgggaattattaaatatcgctcagattattccccaaagtgattgcagcagtttccatcgtcactagccgtgtctgaaattttacttcttcatgtccccaccaacatgtggcactgtcagacatttttaaacattttttccaggcatcgggtgctaaatggtattgcgtggccctccacagggatgctgtgcatttttcacatgttgattgtggctttttcttttcttttctttttttgagacggagtctcgctctgcctcccaggctggagtgcagtggtgtgatctgggctcactgcaagctccgcttcctgggttcatgccattttcctgcctcagcctcctgagtagctgggactacaggcgcccgccaccacgcctggctaatttttttgtgtgtatttttagtagagacacagtttcaccgtgttagccaggatggtttcgatctcgtgacctcgtgatccacccgccttggcctcccaaagtgctgggattacaggcgtgagccatcgtgcctggccgattgtggctttttcttatgtgaattgcctattcatagaagtttgtctcctttttctctattgatcattcatgatctttatacaagatgcgaatccatttttggttacgtattttgcaaatatctcctacactatggataattgtttcactttgtttataatgtccttagcttaataaaaaatatttttaatacagtcgtgttaatcaagcatgttttatggtttgcgcttttatatcttaagatactgttctttgagttcacaaaaatgtcatcatgtgtcttaaaagttctaaagtattgcttttgacatttttaggtctctaatccatctagattttattggggtgcatagtgtgaggtaggaatctatcttcctcaatatggataaactatgttttagttcataatttttttcctgcaattaccatgtatgcctgggtgtgtttatgaactcctcattgtggctcattgggtttttttttgtctatttctccaccatatggtcttcatggctgggttttgataactcgtaggacagcttaccttgactgtttttaaaattgcctgttttattgaccctttaatcttcttatttaggttctacaacaaaacctgatgtaatttttattggaattgcattgatttacaagttagttgggaacaattgactttttttatattgaactattatattattgcatatgccctctccatttatttgtggctttcagtaatgttttattatatttttctatacagatcttggacttttttgttagatttattttcaagaaacttgtagtttctatggctattatgaatagaatatttttctgtattctatctatatttcaactagttattgtggcatatgggaataccattgattatcatgcattaatcttgtatctagcaaacttcctgaacgtttattatctttcatacttcatctgtaggcttttttgtattttctgccttgacaatcttatcatttgaaaataagaatagttttgactcttttttttttttttttttttttttttttgagatggagtctcgctctgtcgcccaggatgaagtgcagcggcgcgatctcagctcactgcaagctccacctcctgggttcacgctattctcctgcctcagcctcccgagtaactgggactacaggcgcctgccaccatgcctggctaatttttttgtatttttcatagagatggggtttcactgtgttagccaggatggtctctgtctcctgacctcgtgatccacccacctcggcctcccaaagtgctgggattacaggcatgaaacaccgcgcccggccagttttgactcttgaccatggattggggcaacaaagatctcaacaaatttaaaaaaaaaaatgttatactttctacttcttgtttctttttcttaccttatttcatttgcctccagtataagattgaatggtagagaaagatatttgacatccttttcttgttcctgaccttaataggagtgcttgtaaagttttgtgatacacatatttgcagtgtctttgataattacagtgatggattgcttagtgacagggatactttctgagagatgcatcattagacaatttcatcattgtgggaacatcctagagtgcactcacacaaacctaaacgggatagccttctacatgcctaagctatctgatatagtctattgctcctgggctacagacctgtacagcatgttactgtactgaatttgggaggcaattgtgacacagtggtaagtatttgtgtacctaaacatatctcaacatagaaaaggtacagcaaaagtatggtattataagcttatgggaccaccgttgtatatacaatccatcattgatggaaatgtaatgtggcacgtgactgtaactttaataaggttaaatcagtcttgtatttgtaattttctaatatcttaaaaaaagatgttttattattgaatattatatgttttttctgcaattgttgataatctgatgacttgtctcaatctatcaatgtagtatattttagatacttaaggtatcctgatatatttcccagataaacctttcttagtcatatgttttcaatacacagctctttcggattgctaacagtttatttaggatttttgaaaccaggcacataagtaagattgttttataatttttttctcttagactgtctttgtcaagtgttgtactaatctcataaaatgaattcacaactatttctgagacaattttttgtaaaatttggatcatgcagttcttgcagattagatacaatttgcttgtaaccctatttgattactgtgtcaaaatgctgtaatcataattgaacacaaattcaggtattattcttttccttattgagtgaactttggtaactaatgtttctagacatttattatttcatctaatttttcaaataggttgacataaaaaatattcatggtattttctcgttatttaaaaaattctactgtatcagattattttctttttaatcataataatgtttacttttgagttattttgtggttgatgatgattagtcttgttagagttttgtctgtaatcccttcaaataacctgcttttgttttattgtttctttgttgtgtatttaatagtgtctgaccttatgtttgtttctttttccttcttttttccattggtttagatttttgttcttggtcttcagttttagtattaaaatgtttaactcaccttcaatattttttatcccacttaaactgttttctttaagataatacatttaagataatacatttacctggaattgctgttttagtgccatctactaagtgtcttgttgtatcttttgttctttttttcttttaacctgtaagttatctagaacttgagtttcaagtttattaacatttaggatgatttggagtaactttctattgttaatttttaatttaatggcatttaggacagataacatggtagaatgcataacatcttttctttgaaattgttgagatctctttgttgctctagttattggtagagtttaataaaggattgtgtgtggctgggcacagtggctcacgcctgtaatcccagcactttgggaggccaaggtgggcagatcatttgaggtcaggagttcgagaccagcctgaccaacatggtgaaaccctgtctctgctaaaaatataaaaattggccgggtgttgtggcgggcacctgtaatcccagctgctcagggggctgaggcatgagaatcactagaacccaggaggcagaggttgtagtgagccgagattgcgccactgcactccagcctgggtgacagagcgagaccttgtctcaaaaacaaaaaacaaaacaaacaaagaaacaaaaataaactactgagtagaaaataatgtaactgtttatgaggcacagggttcaatacatggcaaatgaatcaaccttgttaaatttttatttcaacattacatacgaatataaaagcataaaccataaaggaaaagttttaaaatacatgattatgtattttttaaaactacctcctgttaactttggttttgagttcttaatctgtttctaagagagtcctgttatatccttaccatgagaatggttataccaaagtttgttaacagttctgtcatagtttctctttatgtattttatggttatatatttaggtgcatctaagttttgtattgctttattttcttgaagatcattgcttcgattcttacttggtgtctttctttctccatgaataagttttgccttattttatttcgcttgatttattttagtcagtttacctgcaagactttttctatttcattttaaagctttgtaggggtgtgtgtgtgtgtgtgtgtgtgtgtgtgtgtgtgtatgcatgttcatgtgttttctttaaacagctggataattttaatgcaatattttagtctctagcttttcatataaaaatttaatttatttacatttgttataatgactgatatatttgaaactattttgtgttttgttagtttcttgtccctttacattgctctccctctattgctttcctacttttggatagattgatgttttctatgttctcttttgacctattgattcagaagctataaactctatttctgttcttttggtggttactcatacatttccagatatatgcttaatcataattttttactaacattaattttcacagtaatgctgtgggatagatattattatttccttcatataaatgaaagaagtgaggctcggaaaagtaaagtaaagcaacttgcccaggattgcatagcaagttagtaccctaggcggattctaaatgaggtctatattatttgaatatctgtcattttaaaaacctattatgattctgcttaaaagcgataaggtccacttagctagaaccatatttttgtgcaccatctttttttcatagtgttctcaggcagccagttctgccattaatttgtgaagccctcagcaacacgcattctgtctccaagcctcaatttccccatctgtaaagtggtttggttatccctaacggcacttctagaccatattttaatagtgtttggagattcctttgacaatggacatttgacaagctccccaaacaatttgcctttatgataaatggtgaaccaactaaggttggaatatagttactcacaacaacactaaacatcatgtagatttattagttaattattcaccatctttatcaaagtttgaatctttgtgctttaaaagggaaactcgcagaatgacatttatttcccattaacctaatgagtgatattttttgccctcctctctgtagcaatttgttataaatgggaggatgactggtctgagattttcttgtgaattctgtttgcagtgcttcctctggaaaggagttagtgccagcattttcagggcctttcaggcagtgaagatcgtagaatctgagccatctctactgcatggtcagtgtcaacatcagggaatgtccctgatgctaactcgccccacaggagaattaaaggcactttaggatatatgcaaaacaaaaacagacacaaatataagaaatgtgcaaagcccactgcctaagcatactcatgagtctgggttctagagtaagtaaatctgagtttatgaagcagctccactaggcactgtggtgcagtagttacagacttacatcctaatgctgagctgtctggattcagatctctgcacagccacttagtagcaatatgacattgggcagatcatttgctctttcatatcagttgttcctccatgtaagagccctggataacctctttcactttgtaacctgcccctcaactcggggttttataccctcatggcaaccaccccgaaatgcatagcccagattatttcttgcctctccgcctttgctcattaagtgctttctacctaaaatgctcttcctccacctcccctagctaggagtagctacctcctacttcccaattccatcccagcctgagctgggtaatgctcttctgtgcccccataatatatattttttcagaattaaagactaaaacacacctatctaatgttatattttactaaaattaccactttccagccagaaaagctggattcatattccaactctgccacttactagctgtgtgatctgaggcaaattacttcatctttgcatacttcagtttcattatctgtaaaatgggaatcataatactatacacctcattgattcatcatgatgactaaatgcatcaatagctataaagtgtttagaatagtatatgacacttaaaactgtctataaatgtaagctattactacatttgtaaaggcaataataataaggtctatttaaggagattgtcacaggagttaaatgcaataacgtgacaaagagcctggcacaatgcccagcccttaactcagttcagcaggtgagattgtgtgtgtgtatgtgtgtgtgtgtgtgtgtgtgtgtgtgtgtataatagaacagcattttgaacctaccaaaacaatacatttcagatataaagaccgtattctgagaaccaactcgtttttcaaagaactcaaaaccagcagtagagaaatagaaatacaaaatctagaggaacacattcgaggtcttcagacaatactcataatcctttatatttgcaaagcactcaacagcttacaaagtgctttggaatccattatcacatctgatccttgtcttatctcaacacgaaggatagggtgttttttttaacctctctttttgtggatgagaaaactcaggttcagagatgtggcgtgactcagccactgctccatcatcagcaaatggtgagccagggtttaaagcctagatctgctcattctcaaccccatgttttttctagaatattccaggacattctgagcatcccaggaaatggttagcatttcatgtggagacacagatttccaggtgtgtaaaaaccacatcccagtgttgaggcatctgcaccctgttttccttgaaactccccatctgatggacaggcccgtattgtatcgtctggtctcctgaagagtccaagaagggagttgttagtttctttcagagatgttaacacgttgtcttttaagtcagcactatttctagagaggtgaccagctgtcgaaatttcatgtagggccctggtgtaattctgcacctcttctgttttggcttaacctgtactttttggccactgaaggctgtcaaggagtctaaggtcacactcctggtgcccagtccaggatgcggcttctttgggactcccttgacagctgtccctggcaaattcaagattctgggggaaggaatgtactcacctctgggtaaggttcctctgcagaaaatgatctcatttgtttgtcctccaactggaaaagaggaccaaaggacagaaaggattgacttcaaaaggagcacatttacaatttactgaggtgtaacacaaatacagagtactccgtatcccacgtgtacagctcagtgaattttcataaactcataaaacaacacccagatcaataacattaataactctccagaagtccagaggctctgtccagtccctgcccacccaggactgtcctaactgctgtcagcagaacctggccagcagcagagggattcacctggcacatgaggctcttacaagatgaggtgaggtcacactgatgacttgcgtgcaagagatgggatgacagagtggctttggatccatacgggctatgatagcagcaatgatagtaactcatatttcttgtacatttattctgtgtcaagcattaggctaggcatgtatttaattttcacagcagcccaatgtggttggtgccaatcccatttctcagttgaggaaactgaggctcggagaggagaatggtcttgtccaaggtcacacggtgtgagtggcagaggcaggatttaaaccagggaacctgattccggaaaacttagaccctggccactgctttgccacctaagctcatgggtctccctttggctttcagattggccatcgggactttgatgtggagaagcgacttcggagagacctcaggaggacacatgcactgttgtcagacgtgcagctccttctgggcaccatggaggatggcaagacatcagtcagcaaggaggagctggagaaagtgcacagccaggtgggtgtcacgggatccccttgagaatcaggctggggaggatgctacgacctgcagagaattgctgtccctcccaggtatgagcggaaccatggtgccaacctccaactttcacagatgtgcagggagatggggggcatttcagggctgtgagggtcatgtggagtgtaggtgaggaggaggggtctaagaaggagtcctgttccctttttcagagatgaggcagaattcttctgtctggaaggcttgggcagatcagcactggccagaatggctgagtgcagtgtgcctgttgtgtgtgtgtgtgtgtgtgtgtgtgtgtgtgtgtgtgtatgtgtatgtgtgtatgcgtgtatgcgtgtgtgtgtggtgactgccaggactaggtatgagccaaatagcaatagtgtgtgtgtgtgtgtgtgtgtgtgtgtgtgtgtgtgtgtggtgactgccaggactaggtatgagccaaatagcaatagtgcaatagtgccagtcatgcaaaaccaatgcttaacaatagcaacagttatacaaacgttggcagtttgactgcctattagtatgctaatgatattgatcaaggcatgatgttgaccactggctgctaccagctggagccctcactaggtactgggtcctctgtatctctgcacatggtgctgcatggtgttctcaggattgctgagtgaggtgagatcatcaacttcatttcacaagtgcaggtgatcgggtggcagaaaggtacgatgacccacccaaagtcacacagcttgaaagcggcagagccaggatttgaacccaggtcttcaggctctaccatccttgggccgactcaaaggaggacaggaggagcggcaggtctgagggtggtagggaggtgaggccggagcagagactggggacctaaggagatgtgatgagtgtgggcggttgcggtggcagactgtggcccagggcagctagtgttgagaagtgtgaatggatcccacagggtggtgcaagccttgcggagagatgtcccaaagctgaatgatgtagcaggaactcaggatttgctaccggtccccatggggagctgaagacacctggggaggctcagagctctgttggaagtgttgtgtccatgcaattgatgttaccttccctcggataagtcattcttgctaagcccagatgccttcgccacctgccttcttggagggttactgtcccttcctccagtcagaggctgagctgggcctgggacccatgtttcctgactccaaacccagtgcccttctctcttccttctggagacacagcccatgatgaccaacaggtccccaggaagacagcaaaaggcagcagactatagcgccaagggttggaaacagcgatcccacagcttcggctgcttccagtctctggtgtcagtttctatctgtaaaacaaaacatttcagttagagcttattcgcttaactagaagacctcaaccaaaacaaaacaaaacaaaaacctaaatttagacttgatttgaatttcaccagtctctcccatttcctctcccgggatccaacccgggaccacactctgcattttgctgtcatacctgcccagtctcctctggtctgggacagtttctcaggctgaccttgctttttatgaccctgacagttttgaggagcactggacaggtatcctatggcatgtcttctaatctgggtttgatggttttctcatgaatagagcgagtttatgtgctattggaaagaatatggcagaagcaaacttgttaaaccagaagacactgggagggcccttccatcttgaaaattctgcgactcttagccatctcctttatcaaatcattctcttctagggtgacccaccatcctgacttgtctgagactttcttagttttagcactgccagtcctgggtcctgggcaagccaggatggctggtcattctatcctcttcatggccatgtcaggaagccagtatcacctgtgcttgaacgcattgccctgcttaatcctcatgatacccctaggggaggggaggtggcattgtgcccattttacagatgagaaaatgttgtccagaggtggcaagtggtgtgtccaaagtaacacagcaggtaagtggcagagtcggggatttgaataccaagtttgtgattctaagtgcagaattgagagatgcttttgactcacattgcgtcttcctgtctgcttggctgaccaggtgggtacggaaccttgaggcacctggcttgcttctaggtaggcagagttgctgtgtgattgcccagccaggggccaggcattttgagttgagcaactcccttggcagaaggccacatacctgcccattttccatcaaaatgtccccagtgccacagcacccaagcttcccttcccccaacaggtggatgtttttgaaaagaaaccacacagagattttgttactttttcttttttttttattaagtattcatgagaattctccctctgcagggttaaaatgcatgttcttgggaaaaagtggtatttaatgaaggcgctttgagctgaatcaaagagcctcattcttctgaaagtccttcttcctagtctctgcatccggctcctatcaaaggaaatccacagctttggcttttcgttgctgttgtcatggaaatcgttataaggatgggatcgcgtggaccagaggtcagggtacagttgctttggctcccagcgcacgtgtcccagatgccagagtcagagctaatcaaataaagcagtgatgacattgggcattgctgcatctcctctccaatgtacagtatttgtcctttgcctgaaggctccagggacataggtagggaaagcagacaggaggatgaaggaagagggagctaactttgctgctggctgctacttaagtgctgagcatggtgctgaacaatttcattcattcaatatttatgcagtacctactgtgtgtcaggcagtgtgctggatataagcaccatggatagtgagacagcggtggtacccaccgtcatagaatttacatctgatggaaaagaagacaaacaatgatacgaataaatagaatcatcccacaccttaatttgaatgagaaaggaaataaatagggtgctaagatagagaactgcaggggcgtcctgtttagcttgggtggtcagctaaaataccctgggagaaggagaaataggcagggaccagaacatacggggcctggaagtttggattttatcccgggggtggtgagaagccattgggaggttgtgagcgaagcgtgacagaatctgattcacgttttagaggattgtacttctgcatggagattggattgtggagggtatgagggaatatccttagaaggctaatgcacccttctaggccagaggaaatggtcacctgggttgggggagtattgatagagatggcaagaagggacaaacttggagctgatttggaattgatgggatgtgcagatgaggtttggttagcaacacttaagtgtgttatttcagaaaatccttgccataaccctaggaggtggatattcctatttttaacccattttactaatgaagaggcagtctctgagaggttgagcaatttacctaagggcacacagcaatacatgtcctatacccttacaacttggtttgaccaatacgggtcctattaacttctattgtcaggcacttactatgtaccagacttttccttagtgtcttggggtttctcaaatttggctgcacatcagagaagttaaacaccattttaaaatcacagacttctggattctgccccctcccccaccccattttaaaaaaatcaagttttggttggaattcaggatctgcatttttaaacaaccacatgaaggggttctggggggaaccataggctttatttatccctcagaacaccctttcgagttcagtggtagcatgtatattttgcagatgaggaaactgtcactgaggttatattagtgtgacagatcttatttccccctattttaaaattagttaatttttgagtagagaaaactggatccagcacttgctaattcatgacttttgacaagtgtcccgacctctctgagccctttttctaaagcgaagcatcatcatcatcatcacatgatggcccaggggctgaggagggaaaggcaatgaagccttcagaaacttgagcaggtggctgggcacagtggctcacacctgtaatcccagcactttgggaggctgaggcgggtggatcacctggggtcaggagtttgagaccagcctggttaacatggtgaaaccctgtctctactaaaaatacaaaaattagcccggtgtggtggtgcatgactgtaatcccagctactcaggaggctgaggcaggagaatcacttgaacccgggaggtagaggttgtggtgaactgagatcgcgccattgcactccagcatgggcaacagagcaagactctgtcaaaaaaaaaaaaaaaaaaaaaggccaggtgcggtgactcacacctgtaatcccagcactttgggaggccgaggagggtggatcacaaggtcaggagatcgagaccaaactggctaacatggtgaaaccctgtctctactaaaaatataaaaaattagccagatgcagtgacaggagcctgtagttccagctactaggaaggctgaggcaggagaatggcatgaacctaggaggtggagcttgcagtgagccgagattgtgccactgcactccagcctggacgatggagcaagactgcgtctcaaaaagaaaagaaaaaaaaagaaattagaacatgttctgcgaccttcacattcgctcactgtgatgacagaaaacctagagaaaggtgtttttttttttaagacagtgtcactgtgtcatccaggctggagtgtagtggccctatctctggctcactgcaaactctgcctcccaggttcaagtgattctcctgtctcagccttccgagtagctgggatcacaggcatccgccaccatgccctgctaatttttgtatttttagtagagatggggtttcaccatcttggccaggttttactgagttggtctctaactcctggcctcaagtgatccacccacctcagcctcccaaagtgctgggattacaggtgtgagtcaccacacctggccgaaagttttgttgtataaaggacatgtaggagggaatgtgttcgaatgcacatgttagaactgtgttcactctgcaaatatggatatgatctccactctgggatgaatttgaggccaagctacagggataaagaggaaatgtcaaggtctctgcccttaaggggctcctagtcctagaagcaggctataacaagcagagtgataaactcttttgttgtgggaaatcagggaccccaaatggagggaccagctgaagccatggcagaagaacgtggattgtaaagattccatggacatttattagttccccaaattaatacttttataatttcttatgcctgtctttattgcagtctctaaacataaattgtaaagatttcatggacacttaacacttccccagtcagtacccttgtgatttcctatgcctgtctttactttaatctcttaatcctgtcagctgaggaggatgtatatcgcctcaggaccctgtaataattgcattaactgcacaaattgtacagcatgtgtgcttgagcaatatgaaatgtgggcaccttgaaaaaagaacaggataacagcaattgttcagggaataagagagataaccttaaactctgactgccggtgagccgggcggaacagagccatatttctcttctttcaaaagcaaatgggagaaatatcgctgaattctttttctcagcatggaacatccctgggaaagagaatacgtgcctggaggtataggcttataaacagcccccctaggtgcgcctgtctcttatggtcgagactgcaggggtgaaagagactccagtctcccatagctctcccaggcttattaggaagaggaaattcccgcctaataaattttggtcagaccggttgatctcaaaaccctgtctcctgataagatgttatcaatgacaatggtgcctgaaacttcattagcaattttaatttcgcctcggtcctgtggtcctgtgatcttgccctgcctccacttgccttgttgtattctattaccttgtaaagtacttgacatctgtgacccacacctattcgcgtactccctccccttttgaaactccctaataaaaacttgctggtttttgtggcttgtggggcatcacggaacctaccgacgtgtgatgtctcccccggacacccagcttttaaaatttctctcttttgtactctgtccctttatttctcaagctggctgactcttaaggaaaatagaaaagaacctacgtgaatatcggggcagattccccgatactctttattggaggactatttggattagctaaagaggaggcccttaattttgctttgagagaggagctggtagctttggttatctctttaaagatggaaatgaattgctggttagataaggtacatgtatgtagacattctaggaggaaacaccagtgcgtaaaagggcagaggcacacagagacagaaagcatattcagttcggcatggtattgctggagtataaggtatccaggggttaaaagggcagagaggatagtgctggtaatggaggctggagccagttcatgaatggtttagtgagcttggctgaggagcttcagttttatcccaaagccacagggagccatagaaagctactgagcagaggaaggtgtggccagaacggcttgtaaaaattggcaggattccaggtgcaatgtctcacacctgtaatcctagcactttgggagacagagggaggtctttttctctgagcccaggagtttgagaccagcctgggcaacatagtaagacccggcctcaaaaaaaaaaaaaaaaaaaaaaggcaagtccccagctaaatcacaggagccctgatgtgcagaatatcaggctctaccagcagcaacagtttcccttagctacagcatcttctctccagatgggcaggcaccccctctgttcattgcccctgcatctagaaccctaagataatcatttggttcttttctcccagtttccctccactgggagctttggatacatctcagtgaacacctgaggcttaaaaccctcctgatacaatacagaagactcctgaaagccatatataggattcaaatcctgccaatgacacttaccttgctgcagatcttgggcaagtcagctgccttgcatagagtctttcttgcctaataagggggtacgataatctcagctgattgggctgatataaagaacactggaccatggatttgaaaggagtcattaaattgaaaaccctaagacagtgatctcctggccaggcatggtggctcatgcctgtaatcccagcactttgggaggccaaggcgggcgggtcacctgaggtcaggagttcaagaccagcctgaccaaaatggagaaaccccttctctactaaaaatacaaaaattagctgggcatgatggcgcatgcctgtaatcccagctactcaggaggctgaggcaggagaatcgcttgaacctgggaggcagaggttgtggtgagccaagatcacaccattacactccagcctgggcaacaagagcgaaactgtctcaaaaaaaaaaaaaaaaagacagtgatctcaaaatataacataacatccccaattggctctctcctttcattcaccggtgtcagctattggaagattttagtttctgagcacatgattttataagacctcttggaacaggtaggcagacaaggtgtggggttgatctaatgacacctgttttttttcagagctgatttctaattaattctcatggaatgtttccactggaaacaaactaatctggagacagaagcagttccaacaaccaagatatataattgagataatcgctgtgcacaaataacatctgtgagcagcagatgctaacacctggctccaaggagaaagtcggagatgatgtctgctccagggcagcagttgctttttctctccccctatttgattcatgcttctgacctttgtctcttccacagaggcaatatgttacttgctttctgttagatagagaaggatttgcactgaactctttagtcgtttacttaattcatgctgggggctgtattcacctcttccttctgagaacaaagctgccaccaagtcattgtaccctctaaatagctctgaaatgcatcccccgtctctctctgcttgtattacagtccacctgaatatctagtacttggatttctctcaagttggctggcctctggtcttgtctgagcaatctttgtaccgtctgatctttggagagagaattttaaaatttaaacgcaaagtcggttctttgtgtgttcaagatccattggtagtttcacattgccttcagcctaaagtccaggtttcttcccttgacctacacggatgcatattttggcacctaccctcctgtcacccctcacccgaagcttaggatggcttggtgtcctctgcacctgccctcacctcttcacctttgcccaagcaatgcccttggctgggttcttgcttctttcactgatccctctttgcctgataagcatctaagcattctgtgaaattgactttgggtgtcctctcttggagccctcttggtcctccatgggctgggtgagggtgccgcctctccttccccacaatctgttgggcctgcccctgagttagtacttgtcactccctgtaattattcctttgtttccatcgttttttttctaaacccttaaaggcagggactggggtgagtaaacatagtaaaagacttagccaaagtcacaaaggtaattaataaaaatcccagcctgggtttgaactgaaggaatccgactcaggtacctgggaatttaacctctccccgccatgccaccaatgcctcctgttggtcctctgctgtctcggggctattacatcctttttaatttttttttttattttgaggcaaggtcttgccctgtcatccaggctggagtgcagtggtgcaatcgcggtttactacagcctcaacctcaagcagaatacaggcatgcaccaccacacctggctaattgttctgtatttttgctagagacaaagtttctctgtgtcgcccaggctggtcttgaactcctgggctcaagtgatccacccgccttggcgtcccaaagtgcagggactacaggccacatcttccctggacaccctgagtgctcctgtaggtccttccacttgggaattctgggtcagctccggtgtttactcaggtggagccacaaagccttgtgcgacttatacactgtgagctcccagcagtggtttgttaatagcccgaggctctctgttagtgcttagaagactaataaccctggattcatgctcagtgcccttaattgggacatttatcaccgtgtgtcatccatgcttccatgagacattggaaatagttagtaagcactgggaagatgaccctgatgggagtcttttgtgtgtgggcacctggggaacatttttccccagccaggaactatggaacaggtggcttcctgcgatgttttatttgaagagccttttttaaaacgattatgttggagtgaatttattcaatgttaacataacctcctgtcggagaagataaagacagaattgtaattggttaaaaacatggttatcacaggcctgttcaccccacaaatgttgacacattcaatgctatgatgaatgaagtgggaagaggctggtttcattataggcaagaaggcggggacatctccccaaaaggacctgttaccatttagtcatggaggggcctgtcaaggtcgtgataactattctacagcaacgatattgacggggaacattgattctttacactgtgctagtcatggtgccaaatatatcaacgtcatgacctgattatatcccccaaacccacttgagtgcagtgaattctgcaatggcaggagccttttctgttttgaaccagtgtgtgggagtgtgactgtatacagcaagtgctcagtgaatgagtggggagagaccggacaggtggtggccagactccagaggagaggagacagctagtattatgccttttctttttttttcttttttctttttttttttttttttttgagacagggtcttgctctgtcaccaaggctagagtgcagtggctcaatcatggctcactgcagcctcaacatttcaggctcaagcaatcctcccacctcagcctcccaagtagctggcatgtgccaccatgccctgctaatttttttttttttttggtagagatgaagtttcaccatcatgtccagctaatttttgttgttgtttgtttgtttttttgtagagatgaggtttcaccatgttgcccaggctggtctgaaactcctgggctcaagcgatcctccagcctcaacctcccaaagtgctgggattacaggcttgagccaacacgcccagcctatgcccattttatacaggaggaggctctgcgtagaggcaaattgctcaaagtcacagagatggatggaactgagatttaagaaaatatattttgaaagaatttaaaacttacagagaagttgcaagaatagttcaaagggcttatttaagtttttcacccagattcatcaacttttaatatttttccacatttgcgatctggttctctctataaattttctgaattatctaaaagcaagttaaagacatggtgcccctgtatcctaatcaaaatcacaaaatttaatattgataaaaatccttccttccttctttcttccctttctttctttccttctttctcttttcttttcttttcttttttcttttctttcttttttttttctttgagacacagttttgctcttgtcgcccaggctggagtgcagtggcatgatctcagctcaccacaatctctgcctcctgggttcaagcgattccgctgtctcagcctcccaagtagctgggattataggcatgcgtcaccatgcccggctaattttttgtatttttagtagagacgggatttctccacgttggtcaggctggtctcaaactcccgacctcaggtgatctgtccacctcggcctcccaaagtgctgggattacaggtgtgagccactgcgccctgcctaaaaatattttctaatccaggagttggcaaactagggcccaaaagccaagtccagccaactgcatgtttctttgtggtttttgtttgtttattttattatagctggtgagcaaagaatttttttttttgtttttaaatggttacatttaaggtggttatgtaagtacccacatatatacttgattttgcctcttgacctgccaagcctaaaataattattatctgacccctgattttatctgctgtctttttaaattttgccaattaccccccagtgtccgttatagcaatttatctcccaatttaggatccaacttggaaagtaaaactgcttccattattttcatggtgtcatagttcctcagtctgtctttttttatgatactgacattttttggagagttcaggccagttgcattgtagaatgttcctcaattttgggtgaactggaatgtgaacccctatttctttccaatttcagagccatttttatttatgcaggtctgagattcccaggacaaaggacttttaaaaccagaaagtcccagaccaaaagggatgagcttgtcatcctagcaccagtgtctcaagcactgagtaatcctggggaagataaaatctccttaccctggccccaccctccacctggcctttgcagtaaagccagttctcaaaagccaactggtggttttagcagaaagggtgatgaaccaaatgccagtgtgagaacctgtccccttccacacaggccttttgtcttctgtcttcccatgtttctcgttagagaaattctcaccatccacatgtgctggccttgtatcttgccttttttccctctatttatgcatgtgagctatattgatattattgcgtgtgttttaggcaattaaagtaatggcaaaaagtaatggcattaaattaatggcaaaaactgcagttacttttgcaccaacctaataattggtttattgttgttgcggttgtatgtgactaccacaatttatcttatccatgttgctgtttatggatatgtgggttttgtctaggttttggttatgaatagagccagtatgaacatttttttgcacattattttatgggaggggagcaaatgtatgcatttctgtagggtgcataactagaagtgtggtatctctgggtcatagtacacatggtttttgtctttagcagatactacaaaataaatttccaaggtacctgtagacatttacattcccatcaacagaacatgaaagtcctactggcttcctgtcatggctggcagttggtattattatcagttgttggcattttagccattccgagggaaggagaatattttttattctattttgcacttctctgatgttcaccttttcaaagtatatcatccatttcgatatttatttttacctgtccaaggcatatgcttatttttctgttgggttgtttgtatttttcttagtgatttgtgggatactttgatagaagctctttgctacatatgtctattgccattattttctctcactttagggttgaccattacattttcttggtggtgtctttttatgaagagaaattcttgattttgatgtaatctaatgggtcagtgttaaacatcttagaatccaaattttaaatcagttggtcaggcagagggtgttctgtttagctggatattctggtgagttgggagtggtgcaggatgatggaaagtctacctccatggccaagactctgtgaacccccagaatttgaggcaggtctcagttaatttagaaagtttatttctccaaggttgaggacgtgcgcctgtgacagcctcaggaagtcctgacgaagtgcccaaggtggtcggggcacagcttggttttatacattttagggagacatgagacatcaatcaatatgtgtaagaagtacagtggttttgtccagaaaggcagggacggctcaaagctgggagggggcttccaggtcacaggtaggtgagagaaaaatggttgcattcttttgagtttctgataagcctttccaaaggaggcagtcagaatatgcatctatctcagtgagcagagggatgactttgaatagaatgagggcagatttgccctgagcagttcccagcttgaattttctgtctagcttagtgattcgggggctcaagatattttcctttcactactcgtggttccgtccctcagtgctcaatcagtttctgctaggatttgaattacgctggtggtttccaggctcgtgtgggtgtgtgcacacacgcggtgtgttttctttttagcaaaataatccacttattaaagagaaatctcattaaaatgccctctgccctgaccattaatagtgtaactgaaaattgggttagttgctggccaccgcatgtagagtccaattaacaagaaccaggcctggtacaggaaaagtgagttcatttctgaagctagcttgggagaagggcacaaaacatcctactttaaatgtgccgctttgcctttggagcaaaaagcagacacttccataaggtcaggaggagagtgagcaagggaggggggtctccctgctaccaggtagttacctagtgggcagttgagttggcacctttctgggcaagagtaagttgtaaaagtggccgagtggtcatgccttaggcatgccctcctgaggcaaccccctggagggggtactttcctggggacatgctttgatttccaaatcaattgtctgctctggaggagaaattcatcttggagcacatagatgaacttgctctataggaaacattgggtgagggggaggtgagaggttattttgcatttcaaaaagggctaagtaggaagtagagggaaaggggaaaggagaaaagaagagaaaaaaaaaaaccctgtgtcttagaaaaatgggggtacttggttataattgggcttcccttgtttctcccagagtaccctccttctggctctgaagaaaggtaccagctcgggtatgtggggtctggtgaataaggctgtggtcaccctccctgtccaggtcatttcctcctacagagggggatcctgcccacaggtcccaccccttgtccttcctgtggacactgtgggtatctgggttagagacctatgcatggaggatgggggagcactcctggttgcgggcttcttcccaaggatgcatgcagtgcagacaggctacagagtcaggcagtcctggctcaccctgcgggttcactgatgctgctgagctcacgtgtctgcctcagtctctcagtacacgacatgtgtcgagttcatactatgtcaggacccagagttgaacaagagccaggtgaccctccaggagcccagtgtccagtggggagacagacgtggaggcacaagacctggtgctgtttaggggagcaaaggggtgctggaatataataaaagagggatgtaaatgagacggggatcggggagggccttttttggatgttttatcctgcttttctatttttctttctctctttggagcatcagtgtgatccagattcatcatcaccagagaggaagtcaggatagaagcttttgaagtctgttcagtggtggaggattcaagcagtccttagatcctaaaatacaaaaaattaggaggactcttgaaccctcaaagaaatagacttaagacaagtgaaaggaggcctgctttactcagcaggtggtgaacatattccacaggacttacaggaaaaagctgtggacttaaaagagacctcggttcagattctgccaccttcactattagctgtgtgacattgatgagttaactaacctgtctgtgcctcagtttcctcatctgaaactgaaaacagctacttcctagaaatgttacatgttataaattaacatgtcttaatcagctcaggctgccataaaaaaataccgtaaattaaactaggtagcttcagtaacagacatttatttattatagttctggaggctggaagtctgagatcagggtaccagcatgcctgggttctgctgtgggctctcttcctggcctacagacagacaaatgccttctctctgtgtcctcacatggtagagaggaaggaactttttggtgtttcttcttctaagggcacgaatctcatcatggaggccccaccctcatgacctgatctaaaccttattacctccccaaagcctcatctcctaataccatcacattagggggtggcttcaacatacacatttctaggggacagaattctgtctctggcaatgtggtaaacacttgatactaagtagttgtgattatcctactactaataataatatttattattactttgaagaagatagaaaaataaatattcaggaagatttttttttttgagacagaatcttgctctgtcacccaggcgggagtgcagtgagtggcgtgatcttggctcactgcagcctctgcttcctgggttcaagcagttctcccatctcagcctcccgaatagctgggattaatgggtgtgcaccaccatgcccggctaacttttgtattttttgtagaggtgggtcttaccatgttgcccaggctgatctcaaactcttggcctcaaccgattcgtttgcctcggcctcccaaagatctgggattacagctgtaagccaccatgcccagcagggaagtgttttgatacattgataagtgatggtctggagcagaatgtcatgaaaattatggaatattcaatatatacccaaatagtttaagttaaaaggcaccaagagtagccaccacactgtcttaagatattctcccccatggccactgtcatcagacttctgggctgcacagaccattggtggacctggcctgacattctttttttttttttttttgagatggagtttcactcttgttgcccaggctggagtgcaatggcgccatctcagctcaccacaacctctgcctcccaggttcaagcgattctcctgcctcagcctcccgagtagctgggattacaggcatgcaccaccgcgcctggctgattttgtatttttagtagagatggggtttctccatgttggtcaggttggtcttgaactcctgacctcaggtgatctgcatgcctcggccttccaaaatgctgggattacaggtgtgagccaccgctcccggccgacattcttaatatgtttgcatttaacaattttgtttgatgttagggctgtctctagtttgatctgtgggtgattcccttcagggaaagccttaatgttgaaggttggttctttcaagtaccctgatgggatgtcaaggcctgggatgtgttgagaatagccttccaaagacaccatttcttaaccagaatgctttccctgtggtgtttgtgatgcactatttttaaatcccctcagttgttcaaccagacccagaaatccaggttctaaccattctgcccaaagactggaatttttcctctccacacctcattccatatgtctagtcaactcatctagtagcttaacaaatcctagcaaacatttcacctaggtatttaaagcaggcagatggcttcgcatagagaagtaatgctattcaacagtttgtagttgatgtatatgtgataggaatctcaattggcctcacactgaatgaaacagaggtgggtgaggggagagaatgcctagatttagctcaggaacagagactagtgtgtagaggagtctttggggtggcccaggaagggcatgggtttggagtctcaaccactagcacacaagtctgaccttgggcaaatcacttcttcctgggctgcagttttctcatttgtgaaataatgaaggctgactgcttccttgcagggctgttgtgggctatagtgataatgaattttaagtggccacgcagtgcgtaatgtagtgagtgttgaagaaatctccttccctctttccccctcgatgagtaatcgggaaagggaaatattgatcctcctatgggtaaggatccatacacagaacaggtaaacagtaaataattgttactctgtcacagggttttgggtggaaccactttgatccaacttttttggtagattagcatcaattaacactatggaagtgtttggttttgcttttttaagagatgggattgcccaagctggagtgcagtggtgtgatcatagctcacagcagcctttcattcctgggctcaaggaatcttcctgtctcaccctcctgggtagctgggactacaggcgctccaccatgcccagctaattttttgctctttatagagatgaggtctagctatggtgcctaggctggtctggaactcgtggcctcaagtgatgctcccacctcggcctcacaacatgctaggattacaggcataagccaccatgcctgacagatagcaatgtcttttgagtgtttattctgtggctaacatcatgtatgcattacctcctttaattcactcatttgtatctgggttttgggtggtaacccagttcaaattggcttgcatagaaaaagggaagttattggccaaaatatctgaaaagttctgaggctaggactgccttcaggtttggctagatctaggtaccccaatcatgtcatcaagattatgtctctgccacctcttaggtcagctttaagatacaacagcagcttatatcttaagcatgttccatcttgtattcttaggcagactcttcgatcttgcccagactttccaagcttttatcctgcttcagaaagagtgaactttattttcatagtctcagcaaaaatcttggtgtcaaccatgtcgttattacagaaccaaccactgtggccaacaggaggcgatgctctgattgggtaggctgggtcatgtgcccctctttgagcttggggagcaggatctgcaccatcaaagcacatggatgtttggagatggatatttatcacagggaagatggggtccttctctcaaaagaatgggaagtggatgctgggcatgtaccataccacattttttgtacagagcgtctgtagtgggcactattgtttccaagggagagcaaggtaatggctcagagtgggaacttcatgaccagactacctgggttcatatcccagctctgccatttagtacttgaatgaccatcagtaagtcactcaacctctctattcctcagtttcctcaactataacaacaggaatggttgttgaccctacctcggagtgctattctgaaagttagatgaattaatacatgaaaagtgttcagagcagtgtctggcacagagtaacagctcatgctcataacctttgtgcatggcatctcctaggcttgtacagtgcacaactgatacagctgtactcagcagtcctactcaatgaacgcaaatcattttgtcccccattttttggatgatgatatggtttggctatgttcccacacaaatctcatcttgaatcaaaagtagctcccataattcccacgtgtcatgagagggaactgctgggaggtgtttgaatcttggggagcaagtctttcccatgctggtcttgtgatagtgaataagtctcacgagatctggttttataaaggggagtttccctgcacatgccctcttgattgcacccatgtaagacatgcctttgcttctcctttgccttctgccgtgattttgaggcctccccagtcatgtggaactgtgagtccagtatacctctttcctttataaattatccagtctcaggtatgtctttattagtagtgtgagaacagactaatacgcatgggaaaaatcaaagttcagtaacctgcccaaggtcacaggctcatagatggaggtactgggactgaaatcccaattctgcctgacctttgggtctgctcctaaccaccacatgatactgtgtgatgttaaacatccccccggtggtagagaacatagagagaatgcaacctctccttccctcccattctttgaccctagatggagctcatctcatcttacccctgtgaactccaggcttccaggacccacaatcacagaagagtcagggccccaccaaatatccccaggccaaagcttagcagcacttaatttatgcataagatctgaagcatgtttccctctgtaactacagtatggggaggacttggaatgaacattttactatttagtagaagaagggtcctatcccaagggaatagtaggcaatgaagccctccgtagatgcctgccttgcagaattcgagcagatctggggaagccgggctgatttaattagagaacaatagaatgacttagtacgcacggaggaaggtgctttttctagctattgaaagtgttttggtgctttgtacccacatactcatgccattgttctattgattttacaaaaagtaaaaattggaagagaaacaaaaatctaatgaacttaaactaaaatcaaatcagatgtgttgttgagggtctattgggatccagcccacactaggtcgggagacagatggaaattgcaggaccttcatctcaccctaaacctctccacccctgagaggccttgtccatggggacgtgatgattactcagagtcgaaaggtgggaagtgtcagctgtcacctcaggtcctcattgtcacactggccacaagggttggagagtgaacatcaataattcttccctgtcgcctgtcaacccaaccacctttactacccactgctctctgatggctcttcctggagctcctcaggggaaggcattttcaaaggcgagtctggccagtgttgcgccactgaaggatctgatctctgtccttaacatgacttgccaccgacttcataaaaacatcagtcaaacagcctccgtatggaaataatgtgcagtgaattcttcttatgctgggtcatccataataaaaaatcagccagaggtggccccatatttctttctgctccctaaagtgcaataaattgaaacttttaaagctcagcatgaagacagcttgtcagcagcggcctggggcctgccccgtggaggtcttgggctgggaaatgcctggtctggtctatccagatcctcttaaaatctagacctgcttgacttgtgtgcctctgggacactgacctccctctacccatcccagtggaacaggaaggctaaaattcctcaagatggtcagtgctgaggccctgcttatcctgactgtgtaaacttggcccattcttttggcttccgcttcattttctttctctctaaaatggagttaaaaattcccacttcccagggatgaaaggagctcacaacgacaattgttaccattttgtaatgttttctcactgccagacactgtgtaagcactttgcatgttttcatccatgtatcctgcagacatcctgtgatggaaccatccctattttatagaggaggaaaactgaggcatagcaagacggtgctgctggcagaagcagactgcctcaggtctggctccagtgcccaagctctgaaccacacacacagtgaaatctggcacttagtgttggtaacgttggtttccttcctctgtccttcggaatgaatgtgttcatccctggcaggttccaggaatgatgcatatttccaccacatttgctcaaactccgagttctgtcattttacagactcccaacttagtccaggctctcctgatgctgcctaagaggtttccgttatagcacgaaaccactgagctgttttctctgcaacagagctctctctttattttgatccattccgtctgtgtggtcagacctcccagtgagtggctttctatgaggggcagtgaagctcagtagttaagagcttgggctctggcgttggagcaagcaggctctccacagaccagctctgtgatggtgaacaagtcacttcccctctgtgtgtctcagagtccgcctttatcaaaaggtcctaatggtggcacctttctcctagaggtgctgtggggctgtcatgaagcaaggcagagaaagcacagtgccttgaacatggtccccaagcaacagtagcaggtgggactgctaatgccaaaaccatcagggccaagataatcctatctccagcccagtatgagctaagaaggccagcagctgtctccattgactgctgtctgtgttcatctctctctggggataagtcgtccctctctctgcttgctccaaggaaagaagggaaaggaaagagcatttctggatcatgcaccattatgccatctataaaatggggataaaaatagagtctcctttctccaggggctccgaggactggcgggatcatgctgctgaaaccctctgctgaagtaggggctgggcagatgggaactgtgtcatcgtgttctgctttgccctgttgctttatttacaatgactctctcttgcctcctggctcccagcccagctccttggcctggcagaggggccctgcgtgaggcctcctcttccaccattagttatctgacatcatctcccttgatggcccatctgctcctgccgcccagaccttttgttgtttgcatgccctgctgtgccgattcttccatttctttccacttccaccccttccaccccggctggagcacctccaccgcctccttcctgcaggaccatggcgatcccctcactggctgccctatttgcaatctggtcccaccctccccacagcagccagagggagattaggccacctacctccttagaaaccatccatggcttcctggcagactgaaataaaatctaagctttgtagcccagctcacaagcctcagagatgtgacccgcgtccacatcttcagcatctcctcctcctctccttctctgtgcagctgccctgccgcactagtgaggtttctgttcctcagcaccaccgttagttcctgtctctgcctcagggcctttgcacttgctattgctgctgcccagtgcgctctgcacatggccatctactttgcatcttgtttctttctttcctttttttttttttttttttttttctgagacggagtttcggtcttgttacccaggctggagtgcaatggtgcgatctcggctcactgcaacctctgcctcccgggttcaagcaattttcctgcctcagcctcccaagtagctgggattacaggtatgtaccaccatacccggctaatttttttgtatttttaatagagatggggtttcaccatgttggtcaggctggtcttgaactcctgacctcaggtgatctgcccgtctcaacctcccacagtgctgggattacaggtgtgagccaccgcaaccagcccttcctttgcatcttttaggtcttagcttaagtgcttctccttcatgagtcctctgacttctcaaaagaggggctggttttgccctgctgccttcagggcagccctatcacccacctcctagccatggcagaggcacttgagttacctgctggaaaataagaccaggcctgacatctcacttcttctgtccattatgctctaacaaggccaattaccttcctttgctctacatcaattttctcagtgtgtctcaatccctcccatttgccgactgaaatgggcccccagccctcttttgctgggcccaactgcaggaatacatttttctcaggggctggaaaagggggttttgtgagttgtgacccatccctctctgagccccgaatgtttaccttaggtgatttctaagagtgttttctgttccgagatacagaaaagggggataagagggccaacgggacttactgtagacctgctaaatgttcagcactctgaatgtgcaggcatcctgctgtgagctgaacattataaatgagctgagttaggctgggcatggtggctcacgcctgtaatcctagcactgtgggaggccgaggcgggcagatcacaaggtcaggagttcaagaccagcctggccaatatgatgaaaccccgtctctactaaaaaacaaaaattagccgtgcatggtggcaggcgcctgtagtcccagctactccagaggctgaggcaggagaatcgctggaacccgggaggtggaggtcgcagtgagctgagatcgtggcactgcactccatcgtgggcgacagagcaagactccatctcaaaaaaaaaaaaaaaaaagctgagttagagttcagaagaggcagctgccaactgcagaatggatttagggtatgtgcatgaatatgggtttctccagtggggcgtgtctgtcacctggggccacgtacataagtaattggatgaatcttgatgactccactttgctaggataggaggcctactgtgtgcagctgggaggaaaagagagaaagaaaagtgtgagaaagagctttatttaagtcggtgtctcttagccttcgaggatctagtgaaagctatgaacccagcaaaatgctaaatgctcacatgcagaatattttgcatacccttttaaagggggtctgtggacccacttttaaccctgaaccctggttaagaaacttccacttggctggttcccatgggccgtcaaaccacctcctacaggaagcctccctcaattcccatcctgtgtttccactgtgccagtgtcaccctctttcctctactgcacaaagaggttgtcattagctgttcttgcctgtctcccactgagagggcaggggccagcttgattgttccctgcatgtccagtgcctggcactgaatgggcttcagcaaggatttgctgaatggaactgaagaataactcctggtgatgcaccaggggtgacattttgagtgggctcagaacctggcagcttcaaatgcaaatttatttgctttctcccaggtgtgagttgatgaatagttgtgaagacatgagggccgcctgtatattaatcccatgcctgggaggggctgggctgagctagaggggaaggacattgaaggaggcagcctcatgaggaggcctctcctctcccctcgcctcccctctcccctcgcctcccctcccctcccctcgcctcccctcgcctcccctcccctcccctcgcctcccctcccctcgcctcccctcccctcccctcccctcgcctcccctcccctcccctcccctcgcctcccctcccctcccctcccctcccctcgcctcccctcccctcccctcccctcgcctcccctcccctcccctcgcctcccctaccctcccctcacctccccttgccttgcctcgcctcgcctcccctcccctctcccttcccctccgctctcttcccccctcccctcccacctcccctcccctcccctcccacctcccctcccctcccacctcccctcccctcccaccttccctcccctccccacctcccttcccctcttcccttctcattttcttttcttctcttctccacctcttgcctggtccagctggagcagagtgaagccaagtgtgaggaggccttgaagacgcagaaggtgctcacagcggacctggagagcatgcacagcgagctggagaacatgacgcggaacaagagcctggtacctgtcccttcctgcagctgcagggacctgggccagcataggcctctgggagctagtgtgggcctagtgtgcgctcagcactataggaagtatgaggacatttattgtaaacctaccaggtagcaccttggaggtacagacatccattgtaggccttttatgtgctcagctctgtaagagggacaaggggacttattgtagacctactaggtgctcagcgttctgaatgtgcaggcatcctactgtcagctgagcattataaagatataagggcatcagcgaggctcaactgtgtgttcccatctgcaacgataagcaaggaagtctgttgtggacataatgggtgctcagtgctgtgaatgtgcatctgatgtgagcttgttatttgctcagtacccaatgtggaaacacaactgtatgttgtgtgcccaccctgcttgccactctaagtggttctcagacatctgctgtggtcctactgtgtgctcaccatcatgagatggaacttgttccttattgtggggctactgcatgtcccctctagtaagtggagacaagggcatctcttggcccgcttaggcttattaccaggagaagatttgagccatttattatggaactaccctgtgctcacccctgaatggggacacatggacatatattgtcgatgtattattttggtgagaattggatgtaggtttccaagtcccctatctgggtgtacagggttggcttagatttatactcaatgtataaaacactaaagtttaggtatagttcgagttttataggcaaatgcttatctcaagatctctgtgggcctttttgtcccttatgttgttggaacttgcctacaagcattcacacacacacatacacatacatgcgcacacgtgtatacacaggaatgaatgtacatattcacgtgcgatcaccaggcacacatacaaaataaatgccctccgtataggtaacctgtgcctccaagtttattcatccacccaatacatatttattgagcacctgttatagggctggcctggtgcttgctgctgaggttatgtttgtggacagaacaaagtccctgttctcagggagagcgccgggatttgcattttcatatatgtactaggcacatttaaaatgtgcacacatagattcccaagtgggattgcacagacataaattcatacacacatacaccctgaattcatagtcacatgtaatgcctaatacacacacacacacacacacacacacacacacacacacacacacacacacacacaccaagctgttatacctaccacatgcattggtaaccacagccactcttaaacattgatggtcactcacctcacacacctataggcaagcccctctttgctcttcctctggaccttgctgcccatccctcaccctctcaccttgccttgaccactgatctgcctcccccaggtggatgagcagctgtacaggctgcagtttgagaaggcggacctcctgaagcgcatcgatgaggaccaggatgacctgaatgagctgatgcagaagcacaaggacctcattgctcaggtagtgaatgagaccttggtggaagaagctcagggacttggggtggggtgaatggggaatgttgagaaggtgatgtggttggactactccctggtcttaacatcttggagggataagtgcacagagatagttaggaattgtgcatttcctgtggtcctaatggaggacaatgtcaccttcagatggtgtgtgcatctctggaggacgtgtccaccatgaaagatttggacttattcatgcatctgtctgcccatccacccacccatcgatcattcatctgctcatcaattcacccattcacttttccacccatctactcattcacccacttaactatccatctatccattgtccatccatccatccgtccatccaatcatccacccatccacccaaccacccatccatctgtctgtccaaccatttatccatctatccagtcatccatccatctttccattcatttatccatccatgcagccatccattcatttatccattcatccatcctaccaccgcttacccatttattcacctatccacctatccaaccatcattttcttttctttttcctgtctttccttccttccttccttccttccttccttccttccttccttccttccttccttctttctttctttctttctttctttctctttctttctttcctctcttttctctttccttctttctttcttccttccttccttccttcctttctctttctctttttcttctttccccctctttctttctttcttcttatctttctatctgtagctatttattcaatatttactgaatccttgccatgtgttaggcactgtgaaaaatgctaagtatattgtggtgatcagaagcacatcccattcccaccttcatgtacctcacagtttagtgggctgggaagaccttatcatatggtcacccagagcagagggcagacttgcaaactgagccaagagtccagaaaggaagtgtacacaattctgcaaatcctgacctaggttgggagtcaggaagggcttcccagagtaggtgtcatttggatggagatctgaacaaagaataggagtcacttagattggagtgggacattggggattgggggtgccttccaagcagaggaaatagcacatacaaagggcctgtgatggtgcattggagagactgaaaggagaccagtgaggacaatctggcacaagacaagctcagcaaaagaagaggatcagatcagggtcttagaggctgttatgagattgggttttattttatggttgaagggaatcaattggcaagcttttcaggggcaagagcagttggagaggagcagccagcatgccaccccagactgtcatctccataaaggcaggactctcctctgccttgtccagtgctgtattcagagccaagaagggtgtctgccctggaggtgctcagtaaatcactgttgaataaatgaaagctgactttgtccaggggaaagacaactccagcctggtagatggagtgaagatgaggaggagtggatggatgggcttgggagatgatcgggagccatgagggcagcatgggtgaaacagaagctttggggtgaagctgaggggtatgatgtggaatccccagcagatctccacataatgactgcataatggggagaacagctccctccttgcaatacaccatccagaggagagccggggtaaaatacctgccacgctctaaatgcatctgacagaggttggatctgaagggatttctgctggacaaggaataataataacaaaataattgatgatatcatccacatggtaacaaacaccacaaaaatagcctatgccaatgtctccacttgcgaatcacacttatttttgcctcaaagagaggttaatctgttcagttacaaaggcactatatgcatatgcccataataaataatttaaataataaagatacaagaaatagaaagtaaagaggtgtttctaccctctagaattcctctcttcagaggtaatgaagctcaacagttggttctattttaaaaaaaacctttactctccactgcttaatttgatctctgaacaaacccaatacggaaaggctgagctgagattgtcagtccgttttacgaatgcagagactcaggtgcagagaggctccacagcttgctaaggccagggtccaggtctagaagctcagttaaatgaccctccgagtagctctcatccctcggaatctggtcctagtgccatggccagcccacttctgtctgggttctcaagggtatataataaaatgctggacagtggaccaaatccaggggcttatataattggagtgactcagcgaacattgaaatgaaagatggtgaggaggatgtgagaggtaatttttgggaaacagctattatcatagaagctctgagagatgtagacatctgtgggtggggaaagtagggattttcaggggtggtttcccagcaaggcttgtggactcagggtgatatatatacatttttttttttgtctcaccagtctgctgctgacattgggcagatccaagaactgcagctgcagctggaggaagccaagaaggagaagcacaagctacaagaacaagtatgtgctcagagccatcctatagttgtattagtcagggttttcttagagggacagaactaataggatgtgtgtgtgtgtgtgtgtgtgtgtgtgtgtgtatgagtttattgtttgtttatttgtttatttatttttgagacaagagtctcactctgtcacccagactggagtgaagtggcgcgatcttggctcactgcaacctctgcctgccaggttcaagcgattctcccgcctcagcctcccaagtagctgggattacagacacccgccaccatgcctggctaatttttgttttttaagtagagacggggttctaccatgttggttaggctggtctctaactcctgacctcaggtgatccgcccttctcagtctcccaaagtgctgggattataggtgtgaaccaccaggcccagctgggaaatacgttaagtattaacttacatgaccacaaggtcccacaataggccttctgcaagctaaggagcaaggagagccagtccgagtcccaaaactgaagaacttggaattcaatgttcaagggcaagaagcatccagcacgggagaaagatgtaggctgggaggctaaggcccatctctctccttttcacgttttcctgcctgctttatattctctggaagctgattagatggtgcccaccagattaagggtggatctgccttccccagcccactgactcagatgttaatctcttttggcaacaacctcacagatacacccaggatcaatactttgtgtccttcaatggaatcaagttgacactcagtattaaccatcacagggaggaagagagggattctccctgggcacttacttatactttggctcctggaaactgtttccttcattcttttattcatcagttcattcaaatactcactcaattccagttgtgtgcgaggtgaattgagaccagtccttagacagacacatgcacacacactcacactcatttactcttggcctgtgcttgtgctgaatccaagcgtgccccatgcactgagattcagccattcagtgcagaattttctccgtctgagaaatggctccaagaacaagagatggtctgtgcaagacaggatcacgatcctctgcgaaatcttcctttgaagtcatggtccctccaaacatctctggctttccatcattacctagagggttgctattatccatgaaattttcaaagctcttctagaaccctggcatgcacctgcttaaagtgactgttggagtgaccaggtctcaagcaatttcctatgggtgctggataacaacacgcacaacaaatggaacagcagcagtggccatttgctggctgcttattatgtgccagtcactaatctcctctaatcctcacaagaaaaatgaagaaaccaaggctcaaggaaaggaactgactttctcagactcacacaccaggcagaaacctggctcccaaacccacacttgcttgtatcttttgatgctgtagcttgttgctcacagactagctttgctccttgatcagagcagggaaggagagaagggaagcactgattaaaagtcttgttttcaattgtgaaggcataagaagcatcacctcccagcacctgagacccaggatcagggtctggtgtgagggtccagtgaaggtcccaagattgacacctggccattcttgcttgtgcagacatttaacatgcagcacacctgagtagagaaggaggtggtgtgaatagctcctcccaccctcccaggctgggtcctgcacatgtctctgtcctggtatcagggacaacagatgtccaatagacttctctcatacttacagctgcaggtggctcagatgcgcatcgagtacctggaacagtccaccgtggatcgagccatcgtcagcaggcaggaggcggtcatctgtgacctagagaacaagacagagttccagaaggtgcagattaagagatttgaggtacgtagtgattcataaatagtgcctgggccaagagcagggagagcttttgtgtaagcttcatccatccttctactactcatctatctactcacatgccttcatctagatatacattactcatccacttctcacccaagctccctccctccttccatcatagcatcatccctcaagccacctacccatttacccatctatcctcacgtatgtctctccatctccttccaccatcatgggtccattcatccatcctcccttccatttgttcttcctttcacctttactttttcctctcttcctctattattttttctttagccctcaacccctctgtctgcccattcttctatgcattgatccagttcttcctacctccgtccacctactcaaccacttacatgcccaacactcattttgaacagaaatttattttgcacccagtgtgggctaggccctgttttaggtgcacagaagacagatgtatgacacagatctgctttcagaagcatatgtctttgtaagcaatgtgggtaagatatgtacataaatatctgtaatatggagagagggctgtgatgtttagaggatagagatcttttcaagactctggaatcaggagggcttctgggaggaggtggcattaatgctgaaccttgaaggacaggtaagacttggatgggctggggtgaggttcagtgattacattcacattgcccttgagctgggaacacaggtgttcacttcttcagctctgtaggccagtgacatgggactcttacagaagacatcaccattgtcaaaatcctttcacataagccactccacttgaggtttgatacagtcctgtgaggcaggtaggataagccttatctgatgagaagatgaccccggagaggtcaagtgacttgctgaagataaagccaggcagtgcgtgggataaggtagatggacacctgaccttcacttcctcctggttacaggttccaatttctctgcagccagctggcttcaccacagtaagacagtgcgtctagacagttgggaggctgcattcctcattctgaaacatttccccttgatctccctaggggcatctggtctccaataaggctgctatggatgaagaacagagagaaattcttctttgctttgaccctcagtggttcccagaaattgctcaagggatccctcaaggtctgactgtctctgcagatcaccatgaaactttgatctactatattttaaataattaaatatgtaaagttgggctatatcacatgccattttaaaacttgtgtctagcgtagtgaaatgacagcagaggagaaaagaaaatgaatgtgggaaaacttcaaatggaaaaattctatctccaaattcaattttgccctctgccactatgatttgaatttagtagaatcctgggtctttgaggtgtagagatggggtacctcaaagacacagtttgagaactccttccactcttcctgctgttcttggaattgtggctgaacttcatttgagaggtgaactgaataggaaagcatttcttttaggttattatttggtgtctgatctgcaggctgttatccccactgcctgtggctgcagaaaaagggctcaaagtccttagcaggggcttgaaatattcatgtgggtcccgtcttatgtcaacactagagtatttgcccatcaggatcgattggttcccggcttgttggccaactaatgaattctgcagaacagtctttgggtttgttttgtgtggcactcgtgatggccaaagcacttttctctctattgtttcattgtgtcctcaaggattccccatcccccctgccaccaggaaaggaaaaatgtcataaaatagtagggctgaggctcatgagaaattatctgaacaccctcattttataaatcaggaaacaaaaacacatgtgggggaaaggtttttgacttcagcagagttctctcttcattgcaccagcccctcgagataaataggagctgctaaaaaaaaaaaagaattaataatcccccatcccttatctggcacatcctatgtgccaggcacccaagccttctgcataccaagaaattagattctgacagcgtccctgggacacaggtactatcatcatccctgtctctcagagggcctccataacgtgcccaaggtcacatagccagggagaggtagaggtgggatttgaacccagagggtcttgggggcaagggttctcataaatacgctacactgcctctcagaatagcagttattttatttatttatttattttttcgagacagggtctctctctgtcacccaggctggagtgcagtggcgtgatcttggctcactacaacctccacctcccaggttcaggcaattctcatgcctcagcctcccaagtagcagggattacaggcatgcgccaccacgcccggctaatttttgtatttcttagagaagggatttcgccatgttggccaggctggtctctaattcctgacctcaggtaatccacatgcctcggcctcccaaagtgctgggattacaggcttgagcactgcgcccgaccatcattttttgcatgttgttaattcttcatttttgtagcagacatcagtattcttatcctgattatgaaaacacaggaaactcggcaaaggatttatcttcctgaggctcccttgtttcatacccctggcctccaactccaaggtgggcatgtgtctctgcccctcccaggtcctggtgatccggcttcgggacagcctgatcaagatgggggaggagctttcacaggcggccacctccgagtcccagcagcgggagagcagccagtactaccagcggcgcctggaagagctgaaggccgacatggaagagctggtgcagcgggaggcagaggccagccggcggtgcatggagctggtgagtcctgtccccatcatgggctcttagcgactgagggtttgcaatgtggtagacccccctttcttaagacttctgaatgggagactcataggtttgggtcctgggcctcaggggtgtgcggaaagccaggagaaacaagaaggggagagtgggctgagacaacaccgtcattggctgcaaaccctggaggtgggcccaaagtggaccaatgacattcactgctgccggatggctgccaagttcatttacatatcagatcccagactttcttttcctgctccattcattccactccaatggcaggaaggcctcatacaaaagaggaaaaaaccggtatttattaacggcctatctttcaccaggtctcaatatccataatattctataatcctcatgtcagccctgtgaagtcagaattattgcccccatttcacagatgaggacaaaccgagccttccagaaggggagatgactagtctaaggccacatctagtaaacatagagctatttctgggctgttaatagcacaacaaaaataaaagatacaaatgatgattcaagccaccatgtgtgaagtatttgctccctaccaggttctgaaggaaacatttctcgtctaaatcctcatttcagaactgtgaggtaggtgctatcttgatgtcccttaaaaaggtggggaaactgacacgtggagatatcaacttgccaaattgaggctccgaatggtccatttgcttgcccagggtcacacaggagtaagaatttgaacccaaggctgcctgacaatgtagtctctgcttttagtcactaactcatattttgtctccaggatggaccgaggaaccttttttttttttttttccctggagacagagtcttgcactgtttgccaggctggggtgcagtggcacgatctcagctcactataatctccatctcccaggttcaagcgattctcgtggctcagcttcctgagtagctgggactacgggcatgagccaccatgtccgtctaattttttgtattttagtagagacagggtttcactttgtggcccaggctggtctcaaactcttgagctcaggcaatctgcccacttcggccacccaaagtgctaggattacaagtgtgagccactgcgcccggccccaaggaacattttaaaatttgtttcttgcctaatgggaaggtttctccatcattcagtgtgttgttctaagaagttttctgcacaggtcacagagcatctaagagtgactgttccactttttctccacggggccagatatcactaaggttccagatttctgattctgtgacctggggtgtatctggcacccctatcgcctaccatcactcagccttctagagacagcccacaatatgccaagccttggcccagaggtctctaaattacatttgttttctccttcctgcattatccgctctggtgctgtgagaggtcttaccaacttgttcttcctgcagcaaatatattaatatgtctcgggctactgtctttcacagccggtgtcatccccatcagctttgcccttgacaagctggctgtctggttcttctgtgagggggcagtaaggcaccgcacagagacagaggttcccagacaaagtccaggcctcctgactggcggttcctccacacccatggccctgggagagagaaaagctctttcctccagttgacaggataacttcctcattaaccagccccatttctcatgcagctgagcacccctcctgcaagctctggctgggaggagagaacatccccagcctttctcctctgatgtcttctttaactagccaggcactcaggcattctgtccagatcaaatagtgattttcttcctctctgtcccttgacctctttttctctgtctcttctctccttccctcttttctctctttcctctccctgtccccattcctggggccatattctgatcttgaaaggccctgaaatactgaaaagattatagcatagttcccacatatgaatcaaaatggacacaacacaaaaccttaaagagcttgcatgcatgctgaaattagacctgcatctgtctccaatttctgatggcaagattctggataagtttatcaaagctgaacttttctctttagtttggtgagtgtggttgaaaggagtgttcgtttcctaggattgccatagcaaattatcacaagctgcatagcttaaaacaacagaaattcattctctcatagttctggaggcctgaagtctgaaatcaaggtgtgaacagggctacactccctctgaaggctctggaagagcatccttccttgcctcttccagcttctgatggctccaggtgctccttggtttgcggctgcctcagtgatggctttcttcacatggctttcttttctgtgtatgtgtgtcccaaatatccctctgcctttttcttataaggacaactgtaattggattcagggctcactctaaatccacgttgatctcaccttaagatcctcaccttaatcatatctacaaacgcttttgctttttttttttttttttttggaaacagagtcttgctctgtctcccaggctggagtgcagtggcacaatctcagctcactgcaacctctgcctcctgggttcaatcacttctcctgcctcagcatcccaagtagctgagactacagatgcgcgccaccatgcccagctaatttttgtatttttagtagaggcggggtttcaccatgttggccaagctagtctcgaacccctgacctcaggtgatccacccaccttggcctcccgaagtgttggaattaacaggcatgagccaccgcgcctggcctacaaaccctttttctaaatgagatcacattcacaagtcccaggtggacttgtcttttgggaggcaaccctccaacccactacagaagaggaaggcacatttctgcttggttggcattctgaagttatccagtacatcctgtcgtttccttaatgcttctgtggaagaacaaagctccacgaataaggtcgggccagcagcctcttccaaatactggatgtcctaaaactcaccaacctatttgctctcaaatatttcctttgcctttgagctctgggaagtttccactgggagaagggaggaagtcatactttcttgtatcactcatttattcattcaacaaatacctattcaacaccagctatgagcatggcacagggataggcactggtgaggaagggcaaggaatcataaggtccttgctgtgtagaagttacacagtgtgcccaaaacagggctcagtgggagagttaagtcctcactgtcattgaaagtctagtcttgctgctgaggcccctcctataggtgtggcatcctggtactctccctggcttctgaagacagatcatcccatctgttcatgtctatgccaccaacttgccttccctcatcccatttctataagataaggggcagcttctttgtgccatatgttctctctaaactacactaaaatcctgcaaggcagccagagctttgcttctttccttcatgcaatatatatccatagttttcactgtgggtcaagccctgtgctttatgctggatacccagtgaggaacagcacacacctttgccccccaggagctcatagatggaaatatataactgcatgagaaaatacaactaaggccattcttagtgtacttcgtacaagtatggagtttcctccgtaatgagagctcagagccttcacaggcaaaacaagggggcatgcactgtgatttgagggattttagaaggccagttggcaccaaatctctctcccatgcccactgtcaccaccacaagtccatttctttgggcaaagtattgccttctccatcttccttttttttttttttttttttttttaaattgagacagggtcttagtcacccaggctggagtgcagtggcacagtcatagctcattgcagcctccaactcctgggcataagcgatcctcctgcctcagcctccagagtagctgagactacaagtgcataccattgtgcctggctaatttttcaattttttaaaatagaagtggggtctcactactttgaccaggctggtcttggactgctggcctcaagccatcctccagccccagcctcccaaagtgctaggattataagcatgtcaccgctcctggcctgtcttcatttttagaattcacatcctccctgggagggatagaatacatttcctaactccacagtccaagcattcatttattcattccatcaacaaacgtttattgagttgttctatgttcaagccgtttgcagaagttgtcttctttagcacttaatgtcaacctcagcaagtggagaacatggaggggcccgggtgtgaggttgtccagggctgcagggtcagaaagggcagagctgggattggtgtcccacgtgtccaatgctaaagctctcaccaggtcaccctgctgccctttcaacccaaccttgctgaaaaatggctctgctctggagaccaaaaaaaggatccggtgctctgggccctggagagcagtgggaaggatgttgatggatctcctgtccacaatcctttccgcccgtccccaacctgtactatttgtcactgttggtgttggtttaaagaactgtgagttgttgcatgtgaatgatttatacccccagctgactctctggcacatccagatcaggatcaattacccctccggtggaactttgcttcccagaaaaaagaaaaatgaggttttcccattaattttagtaaatgtactattcctggagactccaggagccattatggagaaaataatattctggctctaaatcattccagtccctttgtcattagagcgatgaagcaactcatctgtggatgtatatatcctgttgtttttcagtagttacagggcccgggggaaccaccctggtcccaagactgggtaatcaaggggtgcctgaggaagctggaagtcctgatgctgacgggaaggcctgacttcggcctaccaggtgcacctatttcagaggctgcacctgttgggttttatccctcatcaccttggcctgattctccggttttgactttcccctgatccaggtgtccttttcacaagttccccaggtcttgaaaaacttgcatggtgcttctgctcactcttcctgcatccacctggtgacctgagttagaaattgcagcaacctgtctccctctcgctcacatagcttaatggtcagacccgctgattttaccctattatttttcaaattcacccctcctgacccatttttgctcactctatctttatttaagcatcatcccctccagtctgggcttctatagtgactcctcacttgtctccccactttcccttcagtcttggtccgccctgcaggagatccttcaagaaggagcatagcttactgtgttatttctctgctaagaaatcttttatggggccggatatgttggctcatgctttataatcctagcactttgggaggacgagtgggaggatcacttcaggcctggagttcaagaccagcctcggcaacatagcaagaccccatctctatgaaagagaaagagagagagaaagaaagaaagaggaaagaagggaaaggaaggaattaaggaaggaaggaaggaagcaacaaagaagaatttgctacgtctgctggcatgtacctgtagacccagctactcaggaggctgaggtggaagattgcttgagcccaggagttcaagattacggtgaactatggttgcacccctgcactccagcctgggtgacagagctagcctccatctaaaaaaaaaaaaaaaagaaagaaagaaaacaacaaaaagatcttccatgggtcatgggtctccattgccttcagaacaaagttcaaactgcttcctatggcctacaagaaatctaacctctctagatttttccacctctggttgtctgcctctcatcctcttacctgttctacttaagcataaagacagatgttgaggactgctgtagtttgaatgtttgtccctcaagcatcatgttgaaatttgatcctcagttttgccattaattttagtaaatgtgctattcctggagactccaggagccattatggagaaaataatattctggctgtagattattcctgtccctttgtcattacagcgatgaagcaactcctctgtggatgtatatcctgttgtttttcagtagttacagggcccggggaaccaccctggccccagaactgggtaatcaaggggtacctgaggaagctagaagtccagatgctgacgggaaggtctgacttcggcctgccagatgcacctgtttcagaggctgcacctgttgggttttacctgttgggacctcataggaggtgtttgggcagatccctcatgaatggcttggtgcctcctcatggtaacgagtgagttctcactgtgttagttctcactggagttcccctgagaaatggctgttgaaaacagccttccacttcctcctctctgtcttgcttctgctcttgccgtatgatctctgcacatatcagctccccttccctttgtgtcatgagtggaagcagctaaggccctcactagaagcaggtgctggtgtcacacttcttgtgcagcctgcagaaccgtgagccaagtaaacctcttttctttataaattactcagcctcaggtattcctttatagcaacacaattgaaataagacaagaccccagtgccatgttactccttgattcaccgcctttatcctcatgcatcctgctgcctgcctatgcaaatttcaaaactcaaatatcaggttaagcacctcctttgtgttcccgtaccccctgtgcccaccccatcaatgcatgtgtcacccagttattgtaaatgccgatgttcttgtcttcctagagagagaaaccctgagagaagactttacttgactcgggctgcaacctccatatcagagtcaggtatagggtagatgctcagtaattgcttgctgaataattttctcagcattttgaagttttacctcttaacagaatggctcaaaaaagtacatcttagaaatggaaaattttaaatcaaccaactgttgtttgtatcttactatgtacctagccctgtgcctgatgttgtgggagatgcagacatggatggactagggactgtgcccttgcatttctcaagatctagaggaggagatgcacatgtccctcaataactctgacacaagatgggatgtgtggacaaaggaagaaatggtttcacacaaacaggagccctaggggagattgtatggaagatgcatcattcatctgaaacttgtatggagtttcttgaatgataaagcaaatactggctggcagctttgggggagcagtgatccagtcatgtttatcacgacatctctcacttgcattcagcaagtgtctagtgaatgcctgctgtgtgtcaggcaatgtccaggttgccggagagtcagagagaaaccagttacagggatataaacacagactcttcacccctttcctttcttctcttccttctttctcattgcagctcccctactgcatgccaattgcaaaatctcttcctcctccctcttcaacctgttttcttttgctttccttgttcttccttattcttccttagttctcacttgtctagacttaggcatgctgtttctctctctctctcctctttctctttctcctctctctctctcctctttctcctctctctctctctctctcacacacacacacacacacacacacacacacaattgttttgactcaggttgggaggagggtctgtgttaaatttctaggctaccataacaaataatcaaaacctggatatcttaaaacaacaggaacttattgtctcacagttctggaggctagatgtctgaaatgaagatgttgggagagacatgctcctctgaaggctctaggggagaatccttccttcccctggtggctccaggcattccttggcctgtgggctgcatcatgcttatctctgcctctgtctttatgtggccttcccctcttctctttctgtctccatgtgtcctcaaggacaccagtcattgaattcagggcccaccttaatctagtatgacctcagcttaactcattacttctgcaaagaccctatttcccaataaggtcccattctgagtttttaggtggatatggatttttgggggacgctatttaacccactatacggtggttgaaaagagcattgcgcttggagtctgatacctcagacagctaagttaacattgaagcaactcaatttcctcatctgtaaaataggcataatatggcctgttttattgggtagctatggggattaaatgagatcatgtatacaaaagtgtcaaatgacagcccataataagcacctaatagatggtactttattttctttcttccttttcttactcttcctttgagtttctgattttctccttccactcaagctttatcatattctaccagctccacatccatgcagtgcccgtgagtggatggcagtgatgttaataggatttaatatttgtttatcatatactgtatggtgggtactgggttaagtactttacatgaatcctctgttttgagaacttgtttggaggtttggagatatacccttgaccgaagactggtcctcctctatcagagacagtcatcctcttgaagcatgcagctttgggagggatgaacatggagtggtgaggggggaaggggacacccgcctagccagctagatcagccagatcaaccctggcgatcaacagggtgacagatgttacagctagatcgccctcacatccgaatcccctattttgagcctcaccgttggaggtaattgtccttattttatcattaaagaaactaaaatccagacaggtgaagcaatttctccaaagtcacattcccagtaaatggcagagtcagaatttgagtgcgggtctgaccgactcaatgaattttagatacgcagtgtttacgtgttcaagtacaattttaaaaaattaataatatatgttaatattgcttctgattctgtaatgtagaggttctcaaccttggcattattgacatctaggatcagatcattctatgttgtgaagactgtcctgtgtatggtaagacatttagtagcatccctgtcctctacctactagaggcaaatagcatttctgccccgtttaccataatcaaaaatgtctccagacattaccaaatgtcccctaaggggcaaaatcaccatctgttaagagcaacctgtctgagataatcctcaccataaccctttagttaacaactatgataactccccattttacaggtggttaaactgaggctcagggaggtgctgtgcccaaggtcgcagggcagctggagaagggggaacgtcaggaaaggagaaagtcaagaatggaaagaggcggaaattagactccctacccttgtaggaaaaaaaccggtagcggttccagcaaaatccaatcccaaccttcctgagacccagaggcgacttcacagcagaatctaattctgagtggaattgaaggccttgctgcagactgtgtacttttaatcatgtttaaataaaacatgggaccatgggtgtgatctcctcactgagcctggcttgtcagccgcttgggcaaagtcataaatagttaataggcaaccacttatggctctacttctgttaaatctagcatcaattatatatggttcatgcattatttatttggtgttactttggggtatatcttccaccttcgggggaaaagtgtaaagaatgggaggcgtagagcagatttgaggatagcttgtttccctctgtactggtcaatttgtgaaggccttgttcccctccatattggtcagtttccctcgaaggaaaaagcccattgatgattaggagatgattaggagatgaatttggatctgagaggactttaccagaccaccaggaaaaaagatcggggcggtgatgtgctggtaaatgtttaacaactgcctttccagggcaggtggattcctggcttgtagtgtttgccaatttctgtggtgtaaattctccctccagggctgatttcaacctaactacatgatgtcaccaaggcagagttgggaagcaatgcacagtagcgcatcattatatatcatttgcaccatacaggtacaaaaagcacaaataccttcaaaagcatagttagagcaaaacgttagcaaaataattagaaagcaatgtgttttgagtacgtattacctttgtttttcatatatttagttgtaagcttgtatcatttaatctttaataatagctgtgtttgacaactggcttgcaaaattccctaaaatttagctatcagctcttgccagccaatatgagccacttcctgcactcctgtgacctggcgtctccttggggtggtgtccccataccctgttagaaggcggttggcagagtagaaggagtgaaaggctcttaatcaagtctcatcgctcactgactgtctttttaagcaagattacttcaccattagaaatctgtccttctgagcatgctcttttaactcatgtataaaatagatgcaatcacatctcctggaaaagactaaaacaagtaattcatgccatgcttctagatctgcctgtcacataactgtccccaaaagcacacctgctcctctctccctgttcattttctcctgccttctgagaatctgaacatagtaggtaggggccttaggaagcccaaagtcaggttctgttttttgtttgtttgtttttgtttttgtttttgttttttcatttgctttaatttttttccactcccaaaccccatgttttcaaaagtccccttccatctacttactccatggcattcaccaaacccacagtgaaggggttcatttcaaaaagcccttggtgttttccccctgcaaatggctatgaacttgaaagcgtaaagatgaattattctggctgggaactgaagtatttaaaaaggcattccacatggagggcatttggggccatgagccgggtgtaaataacacattttatggctctcctgacagggagatagccctcctaattactgccccgttatctcagtgggatccaaaatgacccaacacgcttataaactctgtgttcacagatttccttttaatccctactcctaatggcctcccgcatgctcagagagctgacaggggaacccgcgggtatttctgtcactcccctccttctaggcactgtggtttcctgtttgtctccctacaaaggtttctgtacaaaagaaacttagtcctaataggcatttaggtgctgctagcctcagacatgtttctgaaagtgaattctcccaagctgtctttatctcacatggtgaatgtgcttgtctcaattcaagaggtgttaccatctaacgaaagagtttctttgcgtctggctctgagatgagttatcctgataataaaatctattaccaaaagcctacctaggaataattgggtctattactccccgacttgtggctttgtttctgcattgaaaacagactctccagcaattaatcagaatttaaagttgctaataccaattacaaataatgcgctgaggctcaagatggcaaacagaggagcagatactaatcttgtcccttgagatttcatcaattgaactttcgtcacttcagacttgctggaaattagagtaacttaactctgcaaagttaattacttaaaaaagaaaggggagagatattgattgaatatggcaggagtatattaaattattcaaataaatccaatttatattgtttagatgagattatgcttcacttaattgtatgccagggaggcttaggaaggttagtcttcatggtagaaagcttgatcattgttacgatttgacatctttaaaagatagtggtcccaaggaaatccagggggccccaaatcagacacttcatgtttttgattcatttccaaagtataattcggtttgaagggtaattctctttttactgttcttttttgacagagcttaaacaataagaaagggagaggggatctcagaatatgaggatcgaccaagcagttgggaagcgaaatggtttttttgggagaattggctggtttggaattcaaagtgtatttagtggggaaagatgaatataacttgtctaggttatggctcttttagttgcaagtgacggaaacaaaattaaattggcttaagcaaaaggaaatttattggctcatgtaatgaaaaagtttcatgacctctggcttcagactcagtgaaattcagggactcaaatgatgccaacaggctgaattcggtgtgctggggtcaacccgtatctgtttgccagagctgactgtgtccatctcttcccaattccatgctccatgacatcacattggtagcttgacattggccattgtgggattatttacactatggaaactggcaaatgttaaaggatttccactcatccccacagtcagttttgaacatttaccagcacaccaccgactgaatccctcccttcccattgccttggagttgattgccattctcagacaggctttcccttcctagtggcaacagagttaggctgacaaacagcaaggctatcaacctcaacagaaagagggccccttccacccagcggctcaaacaaaggccaagaagtagaatctcattgaccctgattggcctggtttgggttatatgcccacacctaaaccaagcactggtatttgaagggtagaggctggattgaacagttctggggtacatgcccagccctgaatccaggagtagagtcagctccaccctagccatatggatggagagtagaagaatagattcccccaaggaaaattgaaatgttagtgccagaaggaggagaaatggtttccaaaaaggcaaagcctttggatgcccactgtggaagccacatctgtgggccttgactcttgcagagatctctctgccttgccacaggccccttctaggttttatcttctctgcttgtgttcctgcctcctgcttgactttttcctcctcctttttgtatattttctgttactcctggggctgggacatcccataagtagggtggatcaaagaaaggaaatggaggccggaagtggacagcctaaattccctttctatcttctcaaagggagtggctcacacagtaggaggagcttgccttgaagccaggaagtctgggtccaagccacacttctgcctctgactgactctgtggacttgggcacatcttttcccttgctggactcactttctctctctgtaaaacggaccagacgacttttaaagctctttctgctgagacccctgggcaagcccagagctggttggtcatagagctgcaagctttgagtgtgtctcaaatggctgatagtcatggtggcagcttcctctgaaacaagcacattcctacaccccaagagcaatgcacagagtcacacaatctcaaacctgaaggtgcccaggcctcttcattccaactggtatcttctccaacctcagactggtaaaaattccatctctgttatgcaactgtggggttggggaaattactacctctgtgggcaacaacattcccatagacctccccttctccatcccattctagattgattctatagctaccccacaactggattccagatgtgtcaccttatctgttggagagagggtttcaaaggacagagagatatcccttgcttatctcacctgggagttagcaaggaggtatccagagattaccacgtttttttcttcttttaagtagccaaatcttattttaaatccatagctgatacagatttgtggtaagtaaaagcagagctccccattagggctcatctacttttccaccctggcccctgaggcagcaccataaaatacagcttgataacctatggtcagatctggctgctgtcctgatttttataaataaagttttattaagacatagtcacaaacatttacctattttctatggctgctttggggctacaacagcagagaggagtatttgtgataagaccatttggcctacaaagtccaagatatatactacctggtcctttacagaaaaaaaaatcacttacctttgccctagaacattgcttagcacagagtaggcataaaaaaatacatgctgagagaagaaagagcttgacaggacaaagaactgggaataaggagacttagatgcaaatctcagttccatcatgtccttactgtgtgactttagtcaaggcactcactttctctgtttccctgttaactcataaaatggagacaattattgcaactgcttcacagcattgtggggattacttaataaaataatgtgtttaaatacttattacagtgcctggcacaaagtaagcccgcctatcatcatcatcataataaccatcatcatcatcattatcatcatcattgccatatcatcttcttcatcaccaccaccatcaccaccaacacatcatcttttccaccattcccaccatcagcatcacctccattgttaccacaaccattaccatcattatcttcatcactgtcatcatcaccaccatttgcatcatcatcaccatcaccatcaatcatcatcttgatcaccaccatcattatcatcaccatcattaccaccaccaccatcatgaaaattattattatcactctcatcactgtgaccaccgccatcatcatcacatcattatcagagtgagactagaatcaaagagcactgcagagccccttcaagagtaggcaagccctgtgattcagagcaggcatataagtctaggccagtggttgaattatttcctatttgaaaattctgtgaatgacgtccccaaatgcagtataccccaccttgtgacctgtgagttcatagatgcctccttctttgtgctcagtgtcctgagtgtcagcttcattggaattctgccttctccagccttgtcttggctgcattccaggtaaatgactcggagcccatcttgctgcatgtcacctctgccgcccgcccgcttggataattagaatcaacacattcatttccctaacagcattctcatctccccctctcaaagttttcaaatggaaaaagaaaggcaaaaacaagctacatctgtccttgttcaggcaatttgcagctgtctgcagctgacatccacccagctgggcggcagaactagctttcctgtttgcttttggtggaagatgatgtggttgatgctgttattaaagtttggcagtggtttggagacaaagcgtcctgctggagagagacttaaacactcagggggaatccttcaggctcctgcctttgtgagctaattgcttggtgggtggggagaagaaaaaagactgatgtcacttttcagcaaacaaaaggaaaggaactcaagaaataagatgattttcggtttttgcttctttctgagagcctgctgagtttgcacacaggtagcaactggatgctctgatccagggactggcaagtattttctgtagagggacaggtagtaaatattttagactttgtagtccatactgtctctgtcacaactactcaactctgctgtcgcagcacaaaagcagccctagacattatgcaaatgaatgaatagatgagcgtggttatgttccaataaaactttatttagaaaaacagatggtggactggatttggcccacgggctgtagttggccaactcttgctctatgctctgttggaagaagaagtggagttggaggcagacagcagagctgggtttaaatcttgtctcgatctctttcaggcacctgtcctctttgagtctttgtttcttcatctgtagaatgggttatcaggtagttgggagattagaatgttttgcacatgttaagtggtcaataaattgtaattctttgtagtactcacccgctgaccccagccaaaaaacatgagagagtgaaaccaaataaagaaggctgtctgctttcctgttggccctagctatggttacagttcagtgatgcagatctttttgtagctcatttgagagtctggcagctctgagtttcccaggatgatccttctgttgtctgttcctaccagtgccttcccacaccaagatgccttcctgtgttcagactatttcgtttccatcacaaaggcgcggcctcagttaggaaatcccaagtatgcaaattaagattctgtttatgcacttttgttgtttagagagagtagtttttgttgtagttgggtcgacattaaagacttgttgtctgtaagccaaagacatggctgcatgtcaaatctaacaatcatgtttgcattttaactggtatgattttcaaacagggtcctagggacaattcagacttatgtgtgctgatactcatagttaagattcacttaacctgaaagggcaaaaaaaaaaaatttttttagtagagacggggttttgccatgttggccaggctggtctcgaactcatgacctcaggtgatccacctgcctctatctcccaaagtgctgggatcactgggattcatgccactgcattccagcctgggtgacagagtgagactgtctcaaaaaaaaaaatacatacatatatatataaataaaatatatgtattttatatttatatatgactcacaggtcattacatatatatttttccatgaatatatgcatatatatatacataggaaaagtgtgaccagaaccccgatttgtgattctgtggttagttgcttgcttggtttgcatctgttaaggatgtcagctggaggtatattttaagttgcattatgtatagcttgtatttacttgttattattacttatataacagcctatcatttgtgccaggcctgagcatgttttatacctcatgtcatttaattctcttcaatttcgtgtgacttatggctttacttttcaaaatatattcgcagatcagcagccttggctatagaaatgtagagtctcaggctcagccccacacctttgagtcagaattggctttttaacaaggtcccaggtgactcctaggcacagcagcatggcaggagccctgatgtcggtatttcatcagcactgaattgcaggtgaggagactaaggctgagagaggttagagacgagatctcggctgggcacggtggctcacgcctgtaatcccagcactctgggaagccgaggcaggtggatcacctgagggcaggagttggagaccagcctggccaacatggcgaaaccccttctctactaaaaatacaaaaattacctgggtgtggtggtgcatgcctgtaatccctgctactccggtggctgaggcatgagaattggttgaacctaggaggtggaggttgcagtgagccaagatcgtgccactgcactccagcctgggtgacaaagtgactctgtctcaaaggaaaaaaaaaaaaaaaaaaagagataggatctcctcccatgcagatctcacccacacaatccactacacaatttagctatggttcctgcctctgtattactgatttgtttttttgcttctagatcttgtttctgaaggacactatctacttcctattgttaagcatcactttcttcttggtgcttccagtgtggggtccagaagctaaccacacacttagtaggtgttccaatatttactaattgccgagtgaacccatgaaacattcacacatgcaaaagtgagagcttactcttaaaaatggggtggtggtggtggctgtgaatatcaatcaaaagggtttcctgagcacatctgcccttcagggctttgcatttttagaacatagaacaatagcacctcttagaaccttcagaccatagaaatatagaacacagaacgtaggacagaacccagtggctcttggcctggagttcctccagttttctcccatggggtgatttcagcagacagaacaagtgaagtgccataatttctctgatatttagattattttctatctctctataacatatatgaataccctaggatggtgttgtcaaacatggtagccaccagcctcacagggatatttacatttaattgaagtggaataaaatttaaaattcagatcctcggtcacaccagccacacatcaggtgatcaatagctatgtgtggctagtggctaccatattggacagcaggcatgatctcaaacaagcataatccttttgtgcataatccaaatgctttgtgttcccatcttatttgtaattgcctcccagacttctccctagggtggagggggctggaccacatgccacttcctttccaatcccttttgaactcacacatgacttttctcatcatcacatcattgtcacaaggagggggacctgtttctggggcaacaaatagtaatacatactcatctgagcctcatttggtcccacagctgttttgggtcaaatctcaattgtgtcttaggtcatcctagtcttaggacggtgaggaggcaaacgttatcatctcacatctgtatttcatccattttttccacaaggtaccatcaacttgcattttttgaaaaattaatttactcactaaactcttttatgtctgctaattaatgttcataccttttcttcctctaatacaacagcatctcttaattatcaatatggctactcaacaattagacccgccaaatctcagcgtttggaatgatagcatcctagaactttgatatataagaccttagagccttcaagccagaaaatctcaggattaatagaatcttgaatcatttgacacgcataatattaaaatcttattaaattgaaccatatgaatttgccacttgtataggtcaaaattggttcaatatagctgattgtaattggctcaacctaatagaaatatggaatattgaaatctatacattcttagaattgttagctcctaatgctacacaattttagaactttaggattttagaacaggggccagtcaactttttctgcaaaggaccaggtagtaaatattttcagttttgcaaaccatagagtctctgtctcaacctccgaagtctgtcattatagcatgaaagaagccgcagataatgcataaatgcctagttgtgctccaataaaacttgatttacgaaaacaggcaggaggccagatttgacctgagggttgtaaattgccacccctgttttggaacataaaactgaaagggtcccaccaagcacttggatttgcacaggaaactcatagacctctcctatggttccaaagggtcccattcaaatatggagccattttaagcacagttttgattggttcagtccactgtctgtcccagggcagtgtctggcctccagagagggaatgcgggggaagaaggagactttggaggctgtgaccaaagcgatccctgacactgggagagtgtcaaagagccatgtcccagagttggagaaaaatgggggagactgttggaatcaatgcctggcttccaaagttctggaagaccttgtgagtcaagcccctcgatcagaagcaaaagatgatcctgagtgcctgggaaggcagaactgatggacctggcaagagtcaatgggccccagctgcgaagtgaatttgatgaggctgttcatccaagaggcgtgcacaacctggccataaccttgagatgtggaggtaaaagagagcacaccgcttagcagttgtttttctttcctgatgagtcaataaatgaataaatggaccatgagtggccaagtggctgatataatttcagactccgtcaaaaggaagatcgcaaaagtgtacggaggtagcttcaacgtctttatgttccgccgctgtgagccccggcatcctaatatcatatagtctgagaggcatctgaaagcgaggcagagggcagcctggggattaacatttactgtatgtctactatgtgacaggcactgtgcaaagtgctttcgatataccatctaattaaatctgcactttcaaccttatgagcaaggaaatatttttatctctattttacacatttaacaaaagaggcttacaagagttgaagtgatttgcccaaggccagatagctaggaaagattgacaccaacatatgtgatcactccaaaacatatgctcttaaccacaatgtctgcatttctccaatatcacctgtacacagatcacccggggatattgttaaggtgcagattctgactcagcagatcgggggcagggcctgagattctgcatttccaaccagcaaccaggtgatactgatgcttctggcccagagaccccacttggagcagctggtactatatcatagtttctctttatgccagggcccccaaagttatgaaagggtgaggtttacacttttaagatgaggtcacacagcaaacagtggtttgtcctagattcaaattcacatctgtctgactccagagtccatttctttcaaaaataaagtctactgcttacccttatgcctgtagcttgaccctcagctgggggtgattttgtccccccagggaacattaggaaatatctggagacatttttggctggcacaacttgggtgggaggtgctgctgatatctggtgggtagaggccagagatgatgctaagcattctgaaatgtacagcatagccctgtgtaagcactcacaaagaattatctgctcccagatatccctaatgctgaggtcaagaaaccctgctttctcaagacactgctcagtgtcttttggtcagaaataaaaatccacccagaacctctctcttgaggccacttagtgcacttaatttagagttagtggacatttcaaccaattccactaaaaaatggccatgaataaataagagctgtagctaccaaaaaagtccattatgcaatcaataggtggaactttccactactttgagatgagggcttgctgtttacaactctgttaatatccttgtgccacagcagatggaaaccaatcaggtccagaaatcattgtcttaattttagtcattaacatgcctggccacatgctgtttattggcatcttttgctgtttatgttgcatgctccgttttctctgatggtagcttttgccttcaccctatttctgagggagatagcattgactctgatccaagcctggggaaggctaggatctggcattgatcaccagcaccaatatctccattccatatcctccttgatcaattcttggaagaacatatctaataatacaagactattgatgaggcttgatttgcccgagagggattgtttcccccttcttactcaagctcatttaagatgtttctttggcttgtggaaaatgctgattgaggtttcatttgttacgaggtgacgggatatgcctgaaaagagaagtgtgtctctgaagaatgaagaaacagtatgatagataattatctcctatgcattcagctctttacagtttacaaagcacctgaatgtaacttgggctgcacgatgctctgtattgaacatagggaaggaattgacatctattgtagagttgaggggccgactgtaggatgtactcattggtgcctggggaatccaaacagatgtgggatccatttctatgtcttgcaatggatgtggttctccttctcatatccgtgctgtttctccccggctatgcttatctgcatagctgttgggttacagtcattttaatcatcagtggcctggatggctttattcaaggggtgatccgattttccaactcctgtatttgtatttgtatttgtatttgtatttgtatttgtatttgtatttgtatttgtatctgggttgctgtgtctgtaacccaagtagagtctctcctgggactgctgtgaacatacatggatgctacaccaggttaagacctaatgtgccccagggggttgtcacattgggagtagtggttgtatctcattcttgggcatggtgaattgtgacctgacagtgaggaagtgggacataggacgagcatgtttttgtggagaggagaaaggaaggactttgaggcccatgctggggcattacaatagtttggctagtagagtacagagcacatgcctgagtggagagaatgaggggcacagggaagatggggtgagggtgagaaagcatcaaaacagaggagaccccccaggttggcatattgcacaagctgtcactcaatagttctaagaataggaaagggagctgatgtttattaagcacttgttatagtctatgcaatgtgtcaaacacttcctctcatcagtgactcttcagctagtcctatagcacaacaatgctgttattatttccactttgcagatgagaaaactgagggtcaagtgggtgacaagacttgcttggggtcacgttgcaaatggtggagctgggttgcaagctcctgtctgtgtgaatcgatggcccatgttggtaagacctgctgcatgctacccaagttatgaatttagggcaggaagagtttaaagttgaagtatttatgtggtgacttctaagttctgagtactacacgaggtatttgggatataaggccgagtacaaccttattcataaggagatcaatatagtagggaattagacattggcaaataattcctatctgatgggatatctgtctttcctagtggcttgtacaaatgctgggagcatagaagggaaagaaactaattctatgagagggagccagagagcacatcatacaggaggtgattatggaatggggtcttgatggatgagtagaagttcacttgtcagagaagggataaggcagagtagagcattccagatggagcaatggtaggttcaaaggcacagaggcatcaaagaacatggcatgtttgggagcttgggaatactctgggaattactgatgtggggtgcaaggtgtgggcagcaaaaagaaagggcgagttgggacagagactttaaaggacttgatatgcgaaacaacaaagttgggactgtgggaactgagaagacactgaagacttttcagcagaggaatgacatgatcaggttaaagagattcctccttggaggctttgtggaatacagttggagagtggtgtagattgatgagaggaacaccagtttaaaactatgtgaatcctggccaggcatggtcgctcatgcctgtaatcccagcactttgggaggctgaggcaggtggattacctgaggtcaggagttcgagaccagccctgccaacatggcaaaaccttgtctctactgaaaatacaaaaattagtaggttgtggtggtgggcgcctattgtcccatctactcgggtggctgaggattgcttgaatctgggaggcagaggttgcagtgagccgagattgcttcactgcactccagcctgggcaacagagcaagactctgtctccataaaaaaagaactatctgaatctttaggagatgatgatgaagactaaatttataaaaagataacagagagcagaggaaagatgcaagagattgtattgatgaggtacttgaggcctagagaagggatccagggtaagctataaattgttcccacgctacacttctttggagacaaaatccagtggccacttgagaagtttcaaagtccattttccctatttctgcaatcacgtgggctagtgggctgagaagaaatatgagctgcatttccatttaaattgaaataagacatgtcaaaggtggcttagtaattaccagctggaacaatggcagtatgatgtgggaagtgtagtgtcagtatatgcggtgcagataatttttgcagttgagacttaattatgttgatataattattcccctgtcaggaaaattgggtggcacagatatgtcatatttgtgtttgagcagaaaaatgaaatgccttttttattcagagagcaactgggtggttgactctgggaagttgggattggggcgtttggagtttaccccaggtcaggatgtctgtttgcatctgggggttttgtgaatcccctgctcagttggtatcaactttgagaaggttgttggggtcccatgatggctattctttgcccctttctgaggatgctgcatcggaagtcataggctggagaggatttttagggatgggaaagctaggagctctgaatagcaagagctttaaggaactttagagagatttctttttaaaatttttatttgcaaaccttgcgactgaaaaacccaaggtagagttgcgtgccttgaagcctgatccctcctccctttcccttccccttctccatcccaatgccccaagagagccttagccaccttctccatccctgtgtgataaggtcttgaggagtctgtgccatccactcctccccatccatcagggactccaagaaccaagtacaaagccccttcctcaccattgaagctccagtccctggcgctatgattactgaagtagctggaatgatgtccaggcagaaatgatccatctaaagtggatgaaatggagagaggggtgcacttgataagagagagaggacaggggtaggaaactcccaggttgtagttttttctctgccaccccgtgactgagcaatctttaccaggtgacttcatgctccaagactccgttttggcccctggtatctggcatgtgtgtccagagatgctcatgggatgtgtgaatgcacacagtagtgcagccgacttaggcattctgcaggcaaactctttatcatctacattttaaacaactcaagttgcctaaatgttaactttccagaaagctataaagaccctcaggcaacagctgagggcattttaaaaccatcaggttgaaaaataagaagagaaaggaaagaccagaagcaggtgcctggagcagcaagcccttctgcctgaagataagggagaatcctggcagggaaagctgggtggtgtacagttccatagagtcccctgcttggctgcagagccaactccattctgcctttaatatacaagtgttttacctgagcgtgagtcaaatagatgttatctatactcatacgcagaaatcaacacaggatggaaatacaccaacatattcatgaaaagcagttgtccccaagtaatagatttaaggatgattttcaaagttttcttttgtcactttttaaatgttctacattctctatagtgaatgctattagaaacagaaaagcaaagcaacggtgtttaaaagagaaagaaaagagcacgtggtgttgtattagttttttaggggaggtataacaaagtgccaccaactgcatggcttaagacaacagaaaggtattgtcctacagttctggaggctggaagtccaaaaaaccaaggtgtcagcaggaccatgctctcttcaaaggccctcggaaagaaactattccatgcctgtctcctagcttctggtggttcactggaaagttttgatgttcttggcttctagatacatcactctaatcctcaatctttatgtgacattctccctgtgtcctcacattctcttccctctgagtgtatctctgtgtccaagtttcccctccttagaaggatactggtcatattggattaggacccatcctgctgacttcattttgacttgattacctctgtagagaccttatctctaaatacagttacattctgaagtcctggggattaagacttcaacctgtcttctctggggatatgattcaactcataaacagatgtgtttctcgagatgagaagttcttcctttgtaggtatgggagtcaattgagatgggacaaatgtgaagatcttttgatgttactgtgacagccagcctcccagatggttctcagtgatctgtgtctctggcattcacaccccagtgttttcacctcccatactgcatcagagttgttctgtgtgacatattgattatgtcattggtaataggttgtcctttctgaggttaggctataaaagacatttggtggcagcaggatcacttgaggccaggaagtcaagaccagcttggacaacacagtaagaccccatctctacaaaaataaaaataaaaaaattagcctggtgtgatggtacatgcctgtagtcccaggtattcaggaggctgaggcaggaggatcacgtgggatcaggagtttgtggctgcagtgagccatcatggtgccacagcactccagcctgggctacaaagtgagaccctgtgtctaaagaatgatcataaagatacataataaaaagacatttggcttctgctgtgttctctcttggatcacttgctatgggaaaaccatccactgtgtcatgaggacactgaagcagctcagcgggtgtattagtccgttcttgcattgctataatgaactacctgagactgggtgatttataaagaaaagaggtgtaattggctcatagttctgaggctgtacaggaagcatggctaaggaggcctcaggaagcacaatcatggcagaagttgaaggggaagcaggcggtccctacatggctggagcaggaggaagagagaaaagggggaggtgctaccagatcttatgagatcttatttgctaacatgagagcagcaaaggggaaatccacccccatgatccaatcacctcccaccaggccggcccctcttccaacactggggattacaatttaccatgagatttgggcagggacacagatccaaaccacatcagtgggagatccacgaggcagagaactgagccttcctgccaacagctagtgaggaagtgaggcctccagccagtagccacatcagtgagcctgcttggaaggggaccctccagctgcagtcaagcctgcagacaaccaaagccctggctggcatttcgatagatcctgtcttcattccctactgctgctgcaacaagcaaccactaacacagtatcttaaaacaacacagatttattcttttagagctctagagatcagatgtccaagatgagtccaaaggcattcaaaattaaggtatcatcaggattggtgccttctggaggccctaggggacaatctgttccagcctcttctagcttctagtgtctgccagcatttcttggctcctggatgcaccactccaatctctgcttccatccacatccacattgctgctttctcccccactgacccccttgcctccatcttcaaagacccttatgattgagtattttagggactacctggagaatccaggacaatctccccctacctcaagatccttaagatactcatatctgcaagatgccttttgccatacaagggaacggatttacatgttgccggattagatcatagacatctttgggaggactttatacacgctgccaaataccttgagccagaaccacccagataagccactcctgaattctcaacccacagaaaccatgagagataataaatgatattagatatttcaaaactctaagtgttcgggtaacctagtatacagcaatacataactagtacagaatagggatctgtaatcctgcacttgattctgcagccttgaaaataataattctggtggccgagcacagtggttcacacctctaatcccaacagtgggaggcagagatgggaggatcacttgagggccagagttcaaggtcagccagggcaacatagtgagaccccatctctaaaaaaatgaaaaaacctaagtggatgtggtgatgtgcacctgtggtcctagctactgagtaggctgaggcaggaggatcatctgaacccaggagttcaaggctgcagtgagctatgatcacactactgcattctagcttgggtgacagggtgaaactctgtctctaaaattaaaaaaaaattcataattctggatgtcttacaactttttcctcaaaatatggacatggaaaagtgtgcaaatcacgtaagtgaacagtttgatgaatttgtacggactgaaaaccctgttgtctgtctgaaataatgaagcctaaaatgatcctggatccttcagagctctgggccagtcattgcctgttcactttcagatccactcctaccccttctctgttctgctgtagaattacagaaaaggacatttcctggtttccttgacttctggtaggttctgccaatgaaaggcagtgatggacacctgaaggtcaaaagaaagggagaagacaggatatctttctttggcactgccttgaggcatccatggaagcagcagtacctccttttaatccagatcttatcagggactctcctcctccatgaagcccatttcctctgggcagcgctattgaggtctcacttcccattggatggcccaactccttggcttttttgtccagccctaggttggcagtgccttcctgctgttgctaatctctcctggctttcccaaagcattctgtaaaatccttccagcttcaacaaaacaagtaatagattcttagacatcattttctgaaaaatgaagttgtcctcactaaacaccagcagccctcgtatttcccgtgtctttacttagaaagaaggaaataggaacctgtggaccaagtacgtgctaccaatttaggtaggtgaggtgtacacaattttacattatttcatttgttccttgtaacaccttttgtcaaggaataatacagtactgtcattttaccagatgaggaactgaaggtaagaaaggattagtaactctttgggatttgcgtagctgcttcagggttcatcttgttccaaagccagttctgttcctgctgtttgtgatgttagcagtttgcatctctccctctccccactcaccagggcctctctggaagtgtgattagcttcagcttcactcggatccacacaatactcaccaatctttaaggagaaataaacctgcgaaccaactaactaatataaatatcttctttgaggatttgaataccatttctaggaggattgggatcatttaaaaatgtggcagaggctgggtacggtggctcatgcctgtaatcccagagctttgagaagccaaggagggaggaccacttgacaccaggagtttgagaccaacctggggaacatagcaggaccctgtttctacaaataataataataataataaatatctgggcatagtggtgcatgcctgtagtcccagctactgaggagactgagatgggaggatcacttgagcccaggagttcaaggttacagtgagctgtgattgtaccactgcactctccagtctgggcaagagagtgagacccccatctctaagaaaaaaaaaaaagtgtagcagagttgagagttctgatcgatgctggcagatgaagcacaggacagcactggaatgaaacacttggcttggtgagttgagataatggattctagcccctgattgcttgggtctctgctatgattgattagacatgcctgccatgtgtgaagaaaaggacaggaggtattgttgggtatttgctgaccctttagaaattgtgaaggccccaacttttaatctgtcactttctagctgtatgaatttgggacctttgatgagtctctctgtgtctgctatcacatcataaaaatagaataatactggggctgggtggatcacttgaggtcaggagttagagacaagcctggccaacatggtgaaatctcatctctactaaaaatacaaaaattagccaggcataatggcaggtgcctgtaatcccagctgtttggggggctgaggcaggagaattgcttgaacctgggaggcagcggttgcagtgagctgagatcgtgccaccgcacttcagcctaggtgacagagcaagattcactctcaaagaacaaaacaaaacaaagaaaaagaaaaaaatagaataatgcaatgaatcttcaggataattatgaggaaaggaccctgtagaatgatgaccaacttcttcccagtcgttattcctgctggagactgggcatacatttgggttttcttagggccactccaactctttcctttcccaaagtggagcttaacaccacctgctgatgctcactccattaccagtgtggcctttgagctcttgctggaacacaattcacagggcgttttttatttttattttttttttgagatggagtctcgctctgtcacctaggctggagtgcagtggcgcaatctcggctcaatgcaccctccgcctcccaggttcaagcaattctcctgcctcagtctcctgagtagctgggactacaggtgcatgccaccacactcggctaaattttttgtatttttaatacagctggggtttcaccatgttggtcaggcttgtctcaaactcctgacctcaaatgatccaccctcctcggcctcctaaagtgctgggattagaggcatgagccgccccgcccagcctacagggcttttattcccccacttcacaccctccagcgtcagcctcatttctcccaggcaagtgaccctcggacaatttgaaggaagcaatggcagttcctcatagcctttctttctgggaaagattccctcacctggcatcattggatgaaacaggaacaattagaagcaaagctggacagagccatggactgccgtcaggagacctgagcttagctctagatcttttcttggttgtgtgtccctaggcaaatgagttaacctctctgagcctcagcctgctcatctgtaaaatggacaggacaaagtgatgaagattacctctcagcatggagcaggtggatgaggagattgttcattatagcatcagagaggaataaagtatatattttttaacttgcctatgataaagataattcttattctttacagaaaatcttgaggagtgctcaaaggaatgtaaaaattgcctgatatcttaccacagagagataatagccattgctaccactttgttgcaataatctcagctcactttttatgtttctatagtacttgactctgagggtttcaataaagattaaatgagataaaatattttgaacatttagcagactgcctgtgtatgcaagaaatgtatctaaatatattcacttatttaacacgtatttattatgttcaaggtttgttaaacatttaaggatatgaaaatacttgattattttcatcaggtttcaggatataccctgatctataggataaagtacgtgttacaggcaaaattcaactccattcgattttcaagttgaagccagaagggattgctgtttgctaattctaatcagcaaccagattctaataaatacgtccttaatatttgttaggtatgctatgtgccagatgctggaaatatttgggtgtgtatctacacatgcatgtattgtacacacacgtttgcatatatacatgtttatatatatttataatagcatatgtgtgtgtaatttttttcagcaccaggctctgtaacattttctgcttgtctttgctaaatcagaagaaagcaacaagatgaattttcgtcaagtttcaaaagtgtttcgagatagtctgatctatagtgtaaattgtgtggcacaggtgaaattaactttggggggccttgggagacacctcagaaggtttgagaggcaacctccagagctgcagaaattaacaaatgagagtcttgtccatttgcagagaggagagggtcctctgaagattgagatgctctgggcagagaaaacaaacaacaaacaacagttttaaatattagcctctaattgaacatcacaagaggagatgattttaattgcagccattaattatcatatgaactgcttctcacatgggcaactctgtgatatgctccagagggagtagcccgggggtttaacaagaaatcatagttctctcaagtgatgctggggaggtcggcaagtatgcatattatctacattctacatattattgtactgatctctgtatacacgatatatatatcctccatatattacatatgtatcatgtatattatgtatgcattagaatgtataatttatcccttatccttccctcattcgccactaatagtcatacaatagcaccattcatttcatccccaaacatgtattgagtacctcctgtgttccagacactggtaatacagatgatttccctgcaagaacataagctctgtggaagtgaggactttatttgtattgccggcacctagatcagtgctgcgcctcataggtgctcaacaaatgtttattaaatgtatgcgtgtatgcatgaatgaataatatatgaatatataatatataccaggatatatggatgttgtttgtctacagtgtgtacaccattatattgtagttttagattatcccgggaatgtggtgtatatcttagtggatttctgctatctatgcatctaactatctaaatcattttgtatcctaattatcccccacctcccaatttctctccatgcttcaaatctctaaagagagctaataacagagaagactaagctcacaatcgacctcagcacacaaccccattttcatggagcagccctgagccaagcccgagcaagcgtgattgtcagatgctgtcgttgcctcccgcccacttcctgtttcatgagaggggcactggctcacttccccttctgcttgtgcatcccttccgtgtctccggaggggtctctggctggggccttgtattatctgccccagggagactgtttggggcactgcgtttgtttagcctaatgaaatggtctctgcaatcagcagactccatttggttttggagttgaagcaggaaagatttgctgattgctgattacaccaacactaaatttctccaagctttctcctcagggtgcgcccactgagtctgatgcttccctagcagatggaggatgggatgcagagggcggcaagggggcaatggtggagggtggaaggtagtggcagatccacgaaccctgtccttggtccacatactctggcctaactaatgatggctttctggttctcacctcttcttgctgtgtctaagccaactcaccttctatgcagcccttgtttttttcatgtcttttctatgtaggatagtgaaaaatcttcagagccagagtcctgcattccaatgtttttatttggtttgtgaccttggcaaatctccacagtgacctggggatgacactgttcttcctgagactccttctcctatgagaattaaaggatagctatgccactgttggtcaagtttccactctgccaagctcatttactcctcgcaaaagccctgtgagggagggtctgctactggccccatttccccagtgagacaactgagggtcagagaggttctgtaacttgctggaggtcacacagccagtgagcagcagagttgggatttgaaccccggcagctcggctccagagcctactttcacttttatgatattgtggatttgactcattttagactcctatttcttctgcccacttgcttagtcccagccgaggcccacccatccctgagacactgtgcctctttctgtctctctcctctaccctccaggaagctccctgaggatgtggactgtacaccttgctgctcctgcatgacactgacatgggcaaggttcacctaagcaaaacgaggaggggatgtctgtacccttttctcatgtctcagcacatgtgacttaaagggttcccacttaagaacccaagacctggatgcacatctcagctttgtggtctcccggcggcgtgacctcagacaggtcatttggttagacattcgttgaaccaatgcttttaggattcactgtacttaacacataacccacaatggcccagatgtgtggacttgggatagaatctaagacagaaatacagatttttctgcctctgtgtcttacaaagatacaggtgccacatctgggagaaagtggctaatgcccagtgacactgttgtcctggtccagtagaacagagtggagctggccgggcgtggtggctcacgcctgtactcccagcactttaggaggccgaggcgggtggatcacgaggtcaggaaatcaagaccatcctggctaacacggtgaaaccctgtctctactaaaaatacaaaaaaaaaaaaaaaaaaaaaaaaaagccagcgtggtggcaggtgcctgtagtgccagttacttgggaggctgaggcaggagaatggcttgaacctgggaggcggagcttgcagtaagccgagatagtgagactccgtctcaaaaaaaaaaaaaaaaaaaaagagtggagcctgggcagatgctcccagaagctgccgggattttgcacctagctgttttctaggtgcatttatgagctgacatgctgatgtcctggggtgagcaccccctccttcacagtccctcagtgtcttttgtttcctctgacagcctgggggccccaacctcgggttgtctctcaccttgtcaaggctgagatggggatttcacagttggtggcttcaatcaactgggatggactggcagctccttctcatgccaccaccacggcgtccttcccgccaccccttctccctctcatcagcttgacctggcccttaggcttactcagtctttgcctgctgcctctctctctctctttaaaatcagaaaacactggaaaggcacagacttacaataatgtgaatgggcaagccaatgtgcagagagctgagtgtgtccctgtaatggtcctcgctgacttccattggggaatgcagtcatagccccagaaagagcactggactgggagccaccaagcccagggttcagatcccagctctgcgcctttcctgagtgacctcgctgactgaccttgctggctttagtttcctcatctgcaaaataaagaaaaatgaggccgggtgcagtggctcacgcctgtaattccagcactttgggaggccaaggtgggtgaatcacttgaggtcaggaattcgagaccagcctggcgaacgtggtgaaatcccatctctgctaaaaaatacataaattagccaagtgtggtcgtgggtgcctgtaatcccatctacttgggaggctgaggcaggagaattgcttggacccgggaggtggaggttgcagtgagctgagatcatgccactgcactccaggctgtgcaacagagcaagactttgtctcaaaaaaaaaaaaaaaaaaaaaaaaaaaaaaaaaagaaaaagaaaaaaaaaaagactccaggctaagagaggggctgtgagccattcattttcacttagctactcagttccatggggagctgggaattgcgctttgaccccacatcctcaaatttctcccctcccactgtcctcaggtggtatgtatgttcctttacacagcagtccaaaaataaactttacataattagagccggttacaagaaaaatcccatctataaccccgctttgccccatccataaatattctcaattctccatgagtgttatttgcatagacttgagcatgatactgctcggatctattccgtttgcttcatgttatttcaaagaagcactccacgctgccacaattcttatttctaatgttgatgtctgcctaagagcatcaaagtgacacactgtgatttccctaaccattcccaattgctgggtgatgaggcagatcccagcctctccttgtcatcagtagcactgctgcaaacatcctcgggcatagagctgtgttctgtgtcttgatttatcccccgtaagatgaattaattaccaggaggttagatgctgggtctcacccagggtttcagactcagcaccgtggacattcaggccggataattctttgtgggattgtcctgtgccttgtaggatgttgaacagcatctctggcctctacccaccagatgccagcagcatttccccaagttgcgactgccaaaaatgtctccagacatgaccaaatgtcccctggggggcaaaatcactcttaggtaacaatcattatgtgttaaagggtagcaatgtgtaggttgcaaattaaagtcagagattttcccaagagtccagataaaatccaattagaaaagtaccagaaagtattgatcacgaagatgagcactgagaggggcgtcagaggcaccgagcttgagttccagctccgccatgaagtctttgcttcttaaggcctcagttcctcatctgtgaaatgggagaagagtaaagactcacctgctgggcctgtgaggcatgagtgagatcctggctgcaaaatactcaacacagctctggccacagaaagagctccgtaaatgcccatcgcgcttgcctgttctggagggagcccagctgggtttttcatctttgcttttgctgctgtgaggacagcaaggtgggggtgtttaggggacagacttgaaactatctttgttatgttctccccatgacctcctgcaccagatttatccttgaggctcagcttcctaaaccagactccatgacccttcttggtttttacgtttactcctccatccaagatgggctgagtatccactgtgcgtggtggtgcagattcagagcatggccctggggtcagatgcattgggagcagcaccccctgcacaggtgagcaagctctgtgtgccatgccctggagtatctattccctcctctatgaaacttggaacacctggttgaggatcccataaatctgtccgcagagagagcctctcacggagaacttaccacttcataggtgctcagtgaacactaggctcagcctggggcgtgtctcttccccagtgcatgcatgggtggtgcatttcttgcccaaggccaacgtgtgtttgcatcttctgtccccaggagaagtacgtggaggaacttgcagcagtgaggcaaaccctccagacagacctggagacatccattcggcggattgccgacctgcaggctgccttggaagaagtggcatccagtgacagtgatactgagaggtaacttgctaggggctcggcggggctgggcgcagcaggtgggcggcatcctggggagctctatgccctttagccgggctggggccacattcactgggaaacccaaagatgttcgggggctggaggcacccctcgtttacttgggtaaggagagactggatgttgccctgctggtttaacctctccttgctgttgctaaaacctctcagtccagcttaccaagcctttggtgaggcaatgtgactggaacaaggactagcgtatggtcttctacaagttccatgtccaatcttggcctaattctctcatctgtaaaatgggcataataatattaggatgaatcacatgcaattgccaagattggactatttttgacctacagactggaagtttcatatattcaatctactgcctatttcttagggctgttgttgagagttaattgagttcacagatgaacatgacagatatgtaagtgctatgtaagtggaagctatgtttgtacagaataatggacattattttacaagggcaatggctgattcaaggttgcaaagttgggctggtaattagcgagaccacccaagttcaatggcagggcttcttgcctttctcagaagataggctacttttcaccatctctgcttgaatctcaagctactgcaggccacaggtggaccgctcagctggaaagagtttgaggtatcccagctgggcacatgggtccaggctgtccaactcctgtagcattctgttcccaggagctacctttgtacccttggcttattgcttctctaggaaccacagctgcctgtcttgccacacatccctgcccccgttctagcctctgtggcaaagcctgggtagcagagaagacactttccttacacagcttttcaataaagaatctacagggtggttccctcctgctgcctgcaagctgcccctgtacacacctgagcaggccacattaaaagcctgtttttcttagtcttcctctctgcgaaggctgtttttttctgcagccaggacagtcaaacatcagtccttggaatgcatccctctttgtttccatatgaggaccctgactttagagaagttcaaggtcacacagcaaattagcttcatacactgagctagaactcaggtctgctgaagttcctacccagacctttgccattcacacctctcttaagggctggaggcaggggtagctgctgacctttgggacttgtgggtgcgagacaggcaaaggaagcagagagggttacaaatcagctctggtttagccagaaggaagaaccagacatctatattgtctatattagagctgactatgaatagtcaaggaaaaaaactggaagaaatacaccaacattctaacactgaggaaaggcgttacgggtgacaattttttttttcttcaagtttatttatattttctgaaatctgtgcaatgaacatgcacacacatctctagctctactagtactctctttaggagattttgctcatgtaagttatgtactccatacacctaattttagaatgcgcataacctcctcccttaatgcagtcctgggctggtcatagctgctgagggatttgtaacctcagactctccagtaacgatgtctgcgctcagcaggagcaagatggagagccactggactctaaaactccatgttcttggccaggcatggtggcccacacatgtaatcccagcactttgggaagctaaggcgggaggatcacttgagaccaggaattcaagaccagcctgggaaacataaggagtctccatctctacaaaaactcctttttaaaaattagccagacatggtggcctgtagtcccagctactcaggaggctgaggtaggaggatcatttcaacccagaagtttgaggctgtggtgagctgtgatctgtgattgtgccactgcactccagcctgggtgacagagcaagaccctgtctcagaaaataaattaaaaaataaaagttcatgttttgcctgtaaataaaagactttgtcttaaaaaaaattattcaatttgtgcaaaagtggcttccatgcacattccaagtattcccgctattccctgctaattggcacagctgccaaactgctggtgaaagggcaaatcctgatcttgcagctgctttccagctcatggttgcatttaggattccacctccactgccccctcctcctgttttattaattagtgtcatggcagaacttagtgtaattacaaactccttttgtcaatattacttgtttgatgcttgggctggcttctccattcatagaaacaatagagcttttgcatgaattacaccaggaatgaatggctgtagttacaaccatctttggccagtacacaaaatgtttaaattattttcacttgcatagcaagagattgcttttctagtaaacaatcaaagttaagtaaacataaccaaattggaaggaggcggagggtccatgcttgaagggtgggtgacaggctggaagaaggtgcaacaagaagcaagggacagtgtccatcaacagatgaatgaataaagaaaatgtgatgcgtatacacgatagagtactattcagccataaaaaagaatgagattcggtcatttgcggcaatgtgaatggaactggaagtcattatgttaagtgaaataagccagacacagaaagagaaacatcgcatattctcacttacttgtgggatataaaaatcaaaacaatttaacccatgggaatagacagtaggaggtgggatggctaatgggtacaaaaatgtagttagaatgaatgaataaggcctggtatttaatagcacagcaggatgactgtggtcaatgataatttcattgtacattaaaaaataactaaaggagtatagttggattgtttgtaacacaaaggataattgcttgaggggatggataccccattttccatgatatggttgttatgcattgcacacctgtatcaaaacatctcatgtaccccataaatatatatgcctactatgtacccacaaaaattaaaaataaaaacattataaaatgaaaaggaaaacaagaagcaagggacagacatctcactgggagaatgagatcccggtggtgaggtcacagaaagttgcagacatcactccagtcttggcgtaggggagaaatcccctctggctttaaagggaccctgctgtcaccctcatcctaataagagacacctttatctgtctcctctgttctgatctaccctttctgagctccatgccctggaatccaatctgaattctttctttctcacttttcatgatcttctgtctctagggacttaagtcttcctccctgctgggcgtctgatgtttttcccttgactggatctctagtttccatataacacctgtctcatagctggaagggacatcacctgcatttcagagttgctgtgaggtgtgacacgactacagaaaaccaggtgtaaagaaatgcatcttgtgcctgtacctggaaaagccccatgcaatgtgcaggattattacaatgggaagtcaaggaagaatttgagagggaataggctttgcacatcaacaagtctgattgccaattagagatctaatggttaatttctgcgtgaccttggacaagttattcaacctctctgagcctccgtctctttgagtctaagatgggttaataataagaagcaagtgaaaaagtatggcttcctagcacattaccttgcacatagtaggggctcaacgagaatcatcatcaattgcattcattcattcattcatttgataaagttttactgagcacctgttgcgtgcgagatgctgtgttaagtgcttgttttattccacttgcttcttgttatcgttattctccctcttacagatgaagagaggttgagtaacttgcctgaagtcaggcagaaatgaatgtttggaactgtgtctaaagcccagtttggttgaattgctgaggaatagagagggagaagagcctaggggtggtcctgcttttatcaaacctgcattctgatggtggagtgtgtgtgtgtgtatgtgtgtgagtgtgtccaaaaatagagtgcacagattgataaataaaacacgagaatacaattggagttacgaggccagagaacgtagtgctatgatgaagagcagggtaggcagttgtagcctcccagagaggaaggcattggaattaagacccgaatgaaatgaaggagccagctgtgggaaggcctgaagaaaatgagtaatggcagatcaaggcacgttctaggaagtgaaagaaaaccagtgtcccccgggaaggtagatgagggagcagcagccctcttgttccccttttctctttctccatcgcatcttcctctttccctttctcctacctttcttctcctctgaagatgacccatagaaacccactgacaccctcagtttcttaaaatgccccagtgccccaggcaggattggccacgtcatttgtagggttcagtgtgaagtgaaagtgtgaggcttgctgggcgcggtggctcatgtctgtaatcccaacactttgggaggccaaggcgggtggatcacttgaggtcaggagttcgagccccgcctggccaacatggtgaaaccctgtctctacccaaaatacaaaaattagccgggcttggtggtgcacttgggaggctgaggtaggaggatggcttgaacgagggaggcagaggttgcagtgagctgagatggcgccagtgtactatagcctgggcaacagagtgaaactctgtcgccaaaaaaaaaaaaaaaaaaaaaaaaacgaaggaaaaaagaaagtatgggtctccttgttaaaaaattatttaagatttcaagacagtaacacaagagcattaaaccaaaatgcaggcccttctgggcatgggtcgcaagcccctgaagccagccctgaccccagggtggttcttagggagcatttcctaattctcagcaggccttgatcctaatatgttgacttagaacttggatttgagtggaaacacagtgtagacttcagtaatatcatagaaatggggaaactgggggaaaaaattgcccatgaagtctcaacacatttcaaagaattaatattgtataaagcatgttgtctgatcacagtgcaattaaattggttataaacaatgaaaagaagtatttgtgttgctaggctgtaaatccaccgtccatagcagaacccccagctcctgcccaggccccagtctatagtctccacttgctaacagctccacgctacacttcactcctaatttcctcatcaccctggggtaagaggtttggattagagcctgagggactggttcgaggtacttctccaaacagagttctcaattataataaattcaaagccaacccaggagagaaacacacacacacacacacacacacaaacacacacacacacacacacgagagagagagagagagagagagatgcttcagctgcaggtgaggttctttgagagacttgttcaaattacaaaaagtcacatttccccatgttgggaattagatctgagcataacaggccttccaggctggaaacgtggctacgtgctcagaaagccaggtagcctatgtggcagcatttaaacgtgtgctctcctgcactagagccctgcattgtaacttgcactgtggcatcaacctccttagattaatggagaaatgctttaagccagtcacccaggcctaaagtatgctcattattcttggagggaggaatatgctggctgacacagccctgtctattcatggcccaggggctgcggctgctctgtctgtcaccttggctagggggtaaaggggtttgggcgagatgtagagaggtcagtgaatgacctcttgctcttgggtcggctgaaagtgcataagtaccagctggcccaatctgagacgaatgctctgaaaaaagagtcctcagttgctttgttgagtgtaagttggacattttccaacgtacatccttttataacctggctaaaattaggctgcagtaggacaagtggaaagatctgggtctaacggaagattctggttgctactgagggcacgcttctgagttaatttattcatgagtggacccaggctctgtccaaactgtaaagtttcttgctacctagtaggacagtcattggaacttccaacagctcttttcctgcaacttttttactttctagtttgtcccctatgagtaatgaatgtgctccaggccagggagaacagcttaaagcattcctattaatctgagaaggttgatgctgcagttcaagttgcaatgcaaggccttagtaccatataacacctgtttaaatgatgctgcatagaccacctggctttccttctagcccatatatccagctagtaggattcacagagagtcagggctccaaactactttgtctattccagcattacgggaaataatgataattgtaacaataggtaccttttcttgagaaattactttgtgcaggtactgtgctacctgtttggcatatgttatcctcaaaacaactctctgaggctcctaccattattcttcccagtttgcagatgaagaaactgagaagtcaagaaagttgccccaatccatgcagtaggtgatgaagccatggtctgatgtccaggctgaccccataacctaaactgctaatggccaagcgttgttgtcatgtcaaatgtaacctacttcctcctttcccttgtcaaggtctctgttctctgcccagtaactgccctgtcgttaaggagaacttgtatctgtcactgtgagatggggccaatgaatttacatgttacttcccaggcaacatttgcatttagactggaattgtctggcaaagactgaccctaaagaagtacagctgaagacattgaattaattatctcgctcatcatcaacaccctgtttataaattcctggcacaagttcaagttcttcttctctctccccctccccctcctccccctcttccccctccccctcttccccctcctcctcttccccctcctcctcctcttcctcctttctcctccttctccttctcttcctcctcctcctcctcctcctttctcctccttctcctcctcctccttctccatcttcttctcctctcactctgtcacccaggctggagtgcaatggcatgatcttggctcactgcaacctctgcctcccaggttcaagcaattcttctgcctcagcctcccgagtagctgggactacaggcacacgccaccacacccgactaatttttgtatttttagtagagacagggtttcaccatattggctaggctggtctggaactcctgacctcgtgatctgcccgcctcgcctcccaaagtgctgggattacaggcatgagccaccacgcctggccaagttctttttttaaaaagccacttgcaccaaggggagagaaaaccactgaccgcatgtcaggagatgagggtcccagacagctgtaccaccaaatgaatcaggaccatggacaggtcatctgccctttgggcccctgcccactcagcagaaaacaatgaatggacaccttatgtgttgggacagggggtacagtagggaacaagcagacatggacttgccttgtggagcttgtagcccagagacactttcttcacatggtaaaagggccaatgtgtttcaaacgtcctccttattgtagaattcgttttttataccaaagctaactcatgtacaaaattctagcttaggatggagtgcagccatcctctgattggagtgacagaggaaggttttgggctaagccttcctcctaggtctctcttcttgaccccttggtacccacactttacatggggtctcctagaactcgagggctccatgcaccatggtatacaaactcaagtactttccaggaccaataacctgtgacttacgtgcagtctatatggtagtgagttctgcccatgtggtttaatacttctcaggagcagacagtacaaagctccccactgcttctgcctgaaagccttttttttttttttttaaatctcctgtcccgaaggcttcattgcggatcatctcatgataaaggtgttaggtgccttcagcatttgttcgtacaataaacgtgagctatagttcccagaagctcttaattcagccttcttattttaaacatactctcattttttggagaccatctcaaatggtaggaagcatggggtccaggtcagatatcacacttggtgtggacagtatttcatcatgaatgaacaaacagaccagctggtgggtcttgacttcagccttagatattctgtgcaagtttagtgaaacaggttcatgggcaaaagcaaccagtgtgcagatactataaaaatgtaggattaataagcagctatacttccatcttttttatttgtccttgtggctagttcttttccagatcagaagcttaggaggagctagtaaggattgccgataatcttaggctcttataagattgtccctttagattcttcactgttttttttttctcccacattgtgacactgtgattaagggtgtaacagtagttagcagtgcagtgttgggtcatgcctgctgtctgcttcttcctcatataaactattggcctagtaaatgcagatcttcctgttaaggtagaaaaagcattgagattagctattgtaatagagtctggcagaaactgaaagacaaactctaaatgaagagagcttaacaaaaggactatttacaaaggtgtgaggaagctccaaggtatagatggcgcagcacctagggaatagcagcaactgagagcagtaactcctgcaaggtctgaagggagaaaaagagggtgcaattgctggaatccagaaagaaagagagtgagagagaagcctgataggaggagctctggcctttggttgagagctggagccaacacaaggaaaggcagtagagagaaatccagaaatccaggacaataagtaacttcagcttccctgtcttccctccttcctgtcaactgtcagttgcattccctattggctgagtccaagagaaagccatgggatagggaacccattgatgttgtccatacagatcagccccctgtgtggacagagtgggtcagagagcaggagcatgtggaagagtaaggagatgagaagatgcccagcatgattagacatcaaggagggaatgggtctctagtgctggggaagagccctttggaagagggtgaatctgaatgccgagtccacccgtggggctagtactcatggagtcagccagggtaaatagtaaacaagaactaacaccagtgtgtgctttgattagctattgggctataaagactttcctgagtgctggattcaagtaaagattggtgtttagtcaaagtaggtgaggaagtactcaaaatgtaagtgaatgggtgactgtgttccaataaaactttttccctgtacagaaacatattcccttgttttgggggttagaatgtgaacatctttggggaccattattctgcctcctacaaggccattcacaaaagctgcttttgttccactgcagagtctttttctttaaaagggctagatagtaaatatttagccttttcatgccatgttgtctttgttgcactactattatggtgcaaaaacaatcacagacaaaaatctctatttataaaaataaatggtaggctagaattggcccatggctgttgtttactgacttttcttctgttggattcaccaagcattgtctgagaacttctggtctgactgagctttggggctgaaggatgaataagacttgttcttggtccagaagggatgttggtcactgcctggacaaatgcatgtaaatagaagcccccagggtgacaggcttttgagggtgggagccaaggagcagcaggtgcagctcttagaggaaacagcttgatcttctaaaagaggaattgtccagattacagcagagaatactgagaagccccagcctgatgatccagattaaaatgatgtcctaggtgtctgaggtttgcggtttggctgtctgcacccacccactgaacaattgcatgctgattaggagcatgagcttaacaggcctgggatcaaaagctgtgtgacttagacaagtatgtcaggttcctaatctctaaaatggagacacatggggtaggtagatgagattgtgtgggtagcatatttgttgaatggagggatgctctctaaagaacagctaccatcgtaattagtattggagtttcccacaatgccctgggaagctgccctgctccatgtctgatttgctagcactcacaaagaacatacagctaataccttgcttgttagcaataacaatgctattaataatagcagtactagttgtactaaaacaagagtagcggtaatggttgctaccacttaattagcactatctatttgccaggaaccatgctgagatcttcacaagggttatctcacttactctgctccacaacagagccccattatttgccacattttaggaaggaagaaaggaagctcagggaaggcaagtgacttccctgagatcacacaggggcaaaggttggaagtgggattcacactcatgtctgtctaacgtcaataaccatgcttccaagcccctggcagcacgaggataacacactctttcttgtgcctcttactagtgtccagacggcagtggattgtggcagcagcggccgaaaagagatgtaagttaaccccaggtagaactgagcagctcacaagggtgagcccctggctctctctgtccagtttgcagagggaacatccatgtccacttggagaattatcagtgatgcccatgagactaatgccttcatggtcataacctatagcactaggaacatcgtattgaactgccctagttcttttagacagaaagaagcctatgccttctcatgctactgtcctcagacaccttcaatggctccctattgccccagaacagactttttacactgatgtttgtattctgcacattcagacccttgccttcccctccaactgtgatttctggtttccatattgtttatgccccgacctttatgacctccgtacctatgtgtacgtgattccttccacccaaaattccgttcttcagtccctgcgtggccaaaccctaaccttcaaagaagatgtagctcaactttcactacttgatgtctttccttaggcctccaagaagcaaatcaaggctccctctttgaaagaaaaaattattaatgctttatagaggcacagagggtaggttttattagaacctaccattactaatgctttatagagggacagagagcaggttctagtaaaacctaccctctgtccctctataaaatattaataatttttaaaaattttattgttatttatagagatggggtcttgagggacagggtcaatgttaagttcatgtggacaagaactggtgcttggcataaatagagcgtcctattaaaaaactatatattataatatatatacacatacacacatataaataatattaataaatatacacacatacatatacacacacatatacataatgttgaatgagtatatcaacttacgtggtctcattgaggacctgtgacgaccccctctctttctgtgccgctttcagaatcaggggacataaaagtagagtccctgttttaaagatgatccagataaggtaaggaaggagttaagaccttcacacttgatatattccttgaacacatcaaattcaatgccaaactttactcctaaattggagagacctcaacatttgtagtggagtgtgtatctccccaaggaagagtgccatgattaatagcatgggcattggaataaaaaggaacagggtttgcatcccaatttcatcattgactagctgggtgaccttggccaagacccaaattggcctctccaaatctcagtaattccatctgtgtaactgtgacagcactggctcctacctctctgggatggcgagtgaggttatgcaggtatatcacttagcacaatgcctggcttatgctatgggtgaatatctaattattgctgttactgtgattgtcattgtgctgatggtgtcctgcaatcttattctagggataacgtctccatcctcagctcccagccagagggcagcctgcagtcctggttgagctgtactctgtccctggccacagatactatgaggactccttctcgacagtcagccaccagcagccgcatcctcagccccaggtaagagtatctccttgctgcctctggatggctaatagcttgaagaatctcagactttgaaagttgttgttcaagtctttcattgtctctggcataggcaaaaacaagcatggtcctgaaagtctggggtataactctgccacttcctagctgtgtgactttaggcagatcctttaccctctctgagcttctacttcctcatctgcaatacatggaatataattttatttactgatccaaatggttgaagcaatgaggacctaatgcagtcctctccagagcatggttttccagatttttaaatagcacagggtgaacattttaaaaaatagtaatagttgttatagttgccttctacttaaggcacatcatactcttttttccatttatgggtaattacaggttcaaaaaatttttaataaacatattcacttaagcttttttaatggaaagtcattataaagaaattgggccagatgatttatcacctggagattttagctttattcaaattttagctttatttttaattttataatttccttaccacagaaagggatgaattcaggtgtggcctgatatgggagcctcacaaatctacagaattgccaacaacaaccgcctccaataaatgggcctttggattcacccttagttgcacagtttctatcatccatcttccttcttgcttttcagctccatttctctgagctcacttggtttcccttttcaagggtggccctcttgtaattaggagttaatggccataagtcagaaattatggattaagatatgcataattaagatgagatgctcacagtttttgtgaacagaaggcccaatatgataagactggaaaaatcacagactcacggagcaaacccagacaaccgcttcctgactcaaaacgtgtttgctttgatgcaggggttgtctttacaaaaagaagggagtgggagtttatgctaaacttttgggcatatttggcaaatggcaaatgtctggtgcatgtctgcagataatcttaggctgaaagacttgatgtagaaaatatcaaagacaggctccaagaatgggttgcttctggggagctaattaaagcaagattatctgattactgctcttaattaaaaacaaaggcctgtatgaagaagggaattgtgtcctctgtgaactccaaactatgaggactttatctcttctgaaaactaaatacctttgcgttagcctgtctgccagtggcagcaggagaattggaggcagccagagaagaatgtgaatgctcattaacataataaccaagtttcataattctaattatattagggtggataataaggatcctaacagatgaattgcagcctaacctaagttgtttggcacctgtttgaatgggagatggtagggtattacggtttcggtgcaggatctgaagtcagagctggattccaattctttttttttttcatttgctgtacatgtttaagatataattggcaatatcaatattgccaaaacaaaaagtaggcactttttacattgtaatggcctgttgaaaagttttagaattgttattctatacagagattcatctttaatcagtgttctggctgcttccaaattcactgaattctctagcactggattagaaagcataatctataggaaaacgtatacaatgtatagtttttaaagtcaacgtttttagaacaacaagacaaaccagtacatataactttcaataagcatttatcaaatgcttactatgtatggacccggacatagattaaaaaataatattccaattctttatttgcatatctgcagctgtgagattttggacaagctgcttaacttctctgttcatgtttcctcccgagtaaatcatgattgttgtcaggggtaatgtggtgatgcacaagccactctttactcagagcctggcacctagaaagagccacaaaaaattagccatttttatcagcagcagtaactatttgatgcccggaggaatcccgggagatagacttcactgtctatcttcatgttacagaagagaaatctgagactcagagaagggggagcaactgatccatgcatagatggtcttacagctcctgcagtggcccctcaggcaaggtgggtcttcagcatctcccagagagccctatccagagtctctttcccttttcttttccctttccccttccaagttcttgggcatgttcagctgctgtttggagtgaaagtgcttgcaccaagaacagggagggggcaggaggcaagggagatacttacacatctgtaagaagggatttcttgtctgtcttcctcatggccacatccccagggctggctcacagttggtgctcaataaatgtttgttgaatgaataactgaccagagcatcaaggctggaccagaaatattaattgtatttggtcacagctcagcattgattgtggcacagagagggttggtagtttactaatagcacaaagtaggtaagtggaagagccagaatttgaacctaggttggaatcccaccaaagcctctattttatttgccatgctaccacagctctctgacattcatccaggaggtagaccactcacctggtaaagtttactggaaaaatctgatctctgtttattagtactaaaactgcctaaggattattatgcaaccttcaatgttcagccaagacaaagtgctactgagcaccagatcctacgacattaagccctaaaaattatgaaccccttcctttgaatatgtttatagcttgaggactcaaggcattctgagttgcaaaggaccaccgggattatccagcccaacttgctcagtttatagatgggaaaacctgaggtctgcagagggaaatatcttatccaaatttatggtatgaactgacacagagtacaggtgtcttgacttctagctctttttaattgcacaagcaatctatgaatacttctctcaaagaacttaaaatatatcagaaggctgaaatgcccttggccaccactgcagtcttaagcttccttctcagaaggatccatcatcttcagtttggtgtatatccttctctatctttttctatatgtatatatcataaacatatacatgtacttgtagcaaatatatagcatatttgtgagatttttaaaaacataaattatataattacatgtaatgcttttcataaatttttacaatatacttctttccctcagcaatacaccttggagatctttccttaccagtatgcataagttcatctcattctttgtaattcctgcacaagctgccatgctttatttaactatagtgtctttatttcacttttaggtgctttccagatatttgatattaacttgtcaagctttgaaaaacacacattcttataaacatgggtaaatgattctctggatcaaagggcatttgcattttaaactctaatagatatgagtgtcctttctgctaggagactgtatcatagtagagaacaggactcctatttatacccgctcccatattacctggtgcatgggaagacccaataaatgagcctcttggatatatcccatttgactgagaaagaaggtcactctaaaaacagaagagagggagaaagcagtcttctgccaacaaaataaaagcattccccacattatttataaggggacgtcaactcaagagaaatacacctaaagcgttatgatttacagcctaggaatcatgctgctgccgctgataagtgcaagcgcttctggagacgaagacactaaattacctttgtggccacagagagggagtttatgggctggatggtggcagtcacactttgttcaggagtttctcttaacatctggccgcaagtggtgcctgggctgtccagggtctggcatgcttacgtcagtccctgctgcatgcctggcctctccttctcgctctccttccactgctctgtggatgagagtgcgagggcagtgaggctctcccaacttcttcttaccctgacaacacattgggcttcctgagcagggtctaagcctcatttctttctagatcctcaccccaagcccagtaaaaccctagccatggtcactcaccctgttctgcaaggtccacatgctgacaggcatgacgacctagctgtagagactgccaaggtattgtcatcgggcagtcgctgttctcatttcctgggcaattattccaaaccatcctgacttccctctgatctctccccatcactctcaggaggcaactccacttctgtttcattcaaagtaaaataataatgcctttaacttctgctgtgatgtatatgcattcatctctatttgcccccatattccctctggtctcagaagatgaggtccagtcctgccctgtctgaagctaattgggatccaggacttctttctccctaaaacactctgattcatctagtgtcacctctgtctcttgtgtcctcaactttccttgtttcagttcttcccccagaggttataaacagctgaggtcctccccatcctaaccatgtcctcatccatcaccttgctgtcctattgagttactgtttttccttccttttgattcgagcttctcagacgtgttgttaataggtaccatcttcacttactccacattcatgcctcaatttactacagcccagagactgctctgccactccattgaaacctttctcactgtgtcagcagcttccagagacacaaatcaggggacattctctagtctttatattttcctggacttttccccactgttgaacatttcatggaactctatctgcttggccttgacaagatttctgctccttggttctcctcaaacttctcttccctggtctttgcctcacgaccttatctccaaatgccagggttcacaggttactgccctcacttggctgattctctctccacctgatagctggcaattctccttttgtgattttggctctgcagctttcagcaggtgacccccaaatacagatgaacgtctttatattctcccaagttttaaatttatgtatgttatcttattgtctatactgatcaccaaccaggtatctccctgatgttttaactcagcatgtccaagaggaaactcatcctgccccaccagccctgtgttatcaggatcattgagtggttctgttattcataaagcaccacgttggagcccttgttatcttaggttatcattcccctctctcatccccatattcaacgaatccgtaagtcttgtattctaccccccacccaaacaaatactctttctgcttctctccatcccccactgccaacacctttaagtcaagctaccataattgtgctcctagactctggcaaagacctttcaactccaccctcctttagtccatcctctatactttagccagtttgattcctctaaaaggaaaatctggtttcagtggctcctcattgcctacagcaggggtcccagagtgcaggttgagggcagaagcatgtggtgggctcagagagttcaacagggcctgaccagcgggcctggaaaacatacttcaagaaagtaaagggtagatctgttttctaatacaacctctcctttactagttcctgactatgagcaagttacagtctccgagtctcagcccctccaccgttaaatagactttaataatattccctttgcagagctgaagaattaacaactgtagcaaattagcactctagagtgctcattggaaggcctgccaccaagttggtgtttaataagcagaaactcccttccatcctctgtccttcatcccagagcaggccaggtaatgctgctgtgccaaaggcatggatgctgacaggcaggaccagggaaaactaggactgggtgctccacataccagagattgcagaagtgggctaaactcacagcagaaaaccatgagcacaacagaaaacctcttggcagtgaaagtggagttttggtgagctcagttttaaatatgttaaacttcgtgtgtttggggacatccaaagagaattgtccagaagctttttaaactctgacctggagccctaaggagataccaagaaacctctgcgtaatgttaggattcttatgagtgtagatgacataaaacccatcaacctggccagagtaagaaggagcatttattgtttcctgtagctgggaaaccaaaaaggaaaatctagcttcaggcattactagatccaggaattcaaaaatgatcatggggatttggttccccaccaacctctctgctctgctgtcttctatgttggtttccttctggggcaacaagatggcggctaacagctccaaactcatgcctgcaccattctgagtccagtagtaaagagaatttctctcttcttcacagttttcacaaaaaatgcaagcctgagtgagcctgaaccagtcagaatggacaaggggactgaaggagcctcttacctttggcctaagtcagtcttctcacctggctcttggaaattcccaccaaaccatgagaacatgaagggaggaggggttccccaaaggacaatgaagggccttacctgaagcaggagaatgaggacttggtagatgaaaactataagcatagaaaatgttttccaccaagggggaagctgaatgaactacaggaatgggcaagactatgaagagaaagaatggtggggaggaaggaaacttattaaagtgtttggggtccccattcagtaaccttgggaaatctaactaaaatggtgtctcctgatcagagactttatttatccctaaatttcaatggccaatctatcatcacataattagtgatgctgtgctttgaatttattaccaagcctggctttctgctgttgctattggacttgtaccatattgcaatgtgagcatggagattattgtataaattattctcactcacataatcatcgtgattttaattactgtgtaatctttgctaattactgttgtatgtatcatttgctttggtgccgatttaacacaactgcttttcgtttggctaaaagatggcattacaacttttcctttttgcaggagaaaatttgctttctgtaaacatttgcagccccaaactcttggcttgcagttcttggtttaaaaggaaagatccagaccctaccaccagccctgtttgtttttatttgggataaggctggcttgaataagtaaaaaggtctaaattacacagtattgtctttaaaaaaacagttgcgttactttcaaagaagggcaattactctactacagacaggaagccaaagatgggtcatgtgagggctgcttaaatgatgagataagactcgtttgtaattagttcattaattatggatatgtgaataaatggtacttagctttaaaaaacagctcgttcccaaagtggggtaagcatctgatgctaatcttatttcaatagtacatttatttactggtctcggcattcttagaaatggagctcaggataattttaatccatcctggaaatacttaatgaaagggcctctcatgaatatggttttatgtcttcctaggacataaggagtctttttagttttatcagtattaggaagattagtggaaaagattttgaaactgaatgcacagaaatattaaatgcaaacacattaaccatggaccaaaggcctgagcaagtgaaaacaggtgaagtctgaatgtagacacaggatttatccttaggacccaaatccctctcagacaggtatttataggaaggaaggctgtttcctgtctagaactcgaggtcttggatggtaggtctatggaccttttagaaaatttgaggttcacctaagctgcaagtttgtagaaaactatttggatacatcgttgatggttcagaacattcttttaaaatctgtggttctctgattaagctaaggttttgttacgcaaatttaccattgaaatatatatacaggaaagtggatcttgaggaaattttcaaaaaattgatcatacctaattaatttgtaattactaacaaaatcaagactggaccattacagtgcccctacaacttccttgtgcccattcaagccaccacctcctccttcctcaaagaaacccaccatcctgacttctaacactgtatattagatatgcccctttttgaactgtgtaaatggaagcatccagtatgtcctcttttgtgtctggcctctttctttcgatattttttcaagatgcatctacactgttgcatgtagcagtaattcatttattttcattgctctatagtctatgtcagtggttctcaactggaggcacttctgcaccactacccatctcaacaggggacagctggcaatgtctggagacatttttggctgtcatgctactggcatccaatgggtagagttcagcgatgctgccaaatgtcttacaatgcacaggacaggccacatagaattatcgggtccaaaatggcaattataccaccactgagaaaccacagtcaataatatgccattgtgtgaacatagagtaataattaatttattctattattaatagacaattaggttgtttatggtttcccatgattatgaatagtattactgtgaacaatcttgtacacatcttttgttgcatgaatatacagatttctgtcgggcgtatactcagcagtagaattgctaggtgtgttttcagctttggtaaatactgtcaaaacagtcattccaatttatgtaaccataagcagtgaatgaatgttctggttgctctaaatccttgccaacgcctggttttgttatttaaaaaattagctattctaataggtgttagtagtttcaaattttcatcttcactcacatttccctggtaaataaacctttttatatgcttatatcttcattcgaatatcctctttaatgaagtgtctgagaaagtcttttgtccattatttttattcttctttggttatccatctcttttgtattgatctgtagttctttatgtattctaaatgcatgccctttataaggtatgtgggttttcttccactcagtcacttacctttttcactctcttaatggtttatttttataagaaaagttcttaattttaatgtaacccagtttataatgttttcctttatggttggtgctctttatatactgttgaaaaattatttgcctactttgaaatcatgcagtattttcttattttttgtagacattgtattgatttaccttttatatctagatacacaatgcatcatgaattgatacttatttgtgatgtgaggtagggctcattgtggtgtgaggtagggctcactcttttccatatagatattgagttggtctagcacatatattttagagaaatgatactgtccacattacacaacagtataaatttgtcataaatcaagtgatcttatgtatatacgtctgtctattctatttcacttttctatgtgtccatccttgaaccaatatagcattggaagtataagttctccatattaattattctttcaggtcagcaaatgactctcagggaaagtgccacatcatactgtattcaccttcagtgtatttccctctttgcaggatttggccttttgagtcctggctgctttgatggcttcccactgtccttaaatttgaattctacttttctggctttccaagtagctctggtgcaagctattacatctggaagctgagtgctgagctaggcttttattctcttacataaataaacatttttttttccaatgtacacttccaccaacagtgtataagcattcgtttttctctgcaacctcaccagcacctgtctttttttgacttttaaataatagccattctaactggtgtgagttggtatctcattgtggttttgctttgcatttctaatgatcagtgatgttgagcttctttacatatgcttgttggtcacatgtatgccttctttttaaaagtgtctgtgcatgtcctttgctcactttttaatgggttttttttttcttgtacatttgtttaagttccttatggatgctggatattagacctttgtcacatgcatagtttgcaaatattttctcccattctgtaggttgtctcttcaccctgttgataagtctcttttgctgtacagcagctctttagtttaatttgatcccatttgtcaatttttgctttggttgcaattgcttttggcatcttcatcatgaaatctttgcccattcctgtgtccagaatggtattgcctaggttgtcttccagagtttttatagttttggcttttacatttaagtatttaatccatcttgactattgtagaaaacagcatggtgattccttagagaccaaaagcagaaaaaccatttgacccagcaatcccattactgggtatatacccaaaggaatataaattgttttaccgtaaagacacatgcatatatatggttcatcacaacaccattcacaatagcaaagacatggaatcaacttaaatgcccatcaatggtagactggataaagaaaatgtggtacatatatgctatggaatactatgcagccataaaaaagaatgagatcatgtcctttgcagggacatgaatggagctggaggccattatccgtagcaaactaatacaggaacagaaaaccaaataccacatcatctcacttataagtgggagctaaattatgaaagcacatggacacatagaggggaacaacacacactggggcctatcagaaggtggagggtgggaggagggagaggatcagaaaaaataactagtgagtactagacataattcctgggtgatgaaataaactgtacaacaaacccctgtgacatgagtttacctatataacaaacctgcacatgtacccctgaacttaaaagttttttttcttactttctacacctagggaaacacgaactttcacttatattttcttccagtcctaacttagtgcatctaccaccccctctagaatgtaagttacttgaagacaatcactattcatctctatattgacagcatctgtcttcatgacactcaataaatgattcaggatggacgcaaggaaatattaatggatgcataatttccattcagttaaagctgcatcttcatggggaactgggtgcttttatgaatgagtctgagattttctgtcactattgccatttcaccatactctggtgagacaatgtctctgcatggaaagtgaagggatgcattaaattcacttaaatatgttgaatccaaattgaatctacaagccaagtagattttaattactctacaaatctagaattgtgttcttcaaaacattgtgaaaattgtagcagaaggtaaaagactcgagttgtagagccagtacttgcaccatctcatcagagtgtgacttgggaagttctattcccttctctgttttcctaggtgtagaatgaggggttcaaaccagatgaggcccacacctccctctcaatttgatatcctagaaattgatcacatcctgtagaaatgaaacaaggctcttggcttggtgttagaaatatggagaactcactttagattgtgtactggaagtgggttttgaatcttgtttttcagccaggagaagtggatgtgactgaccagtgagtggggatactgggttctgaattattcagcccaggtgaggcagccctttgcacattctttctgcagttccacaatcccccatctttctgttcctccattccttcattctttccattctacaagctttctttgaggcagtcctgatgctggggattcatagaagaaagacatggtctactccagaaactccagtatctcccagtcttgctgggagatacaaataagtaaatagacaaccacagtacagagggggacacaggaggctgtgggagccaggagaggccccagcccaggccagagggcggaaaggcttcctgggggaagctacagttgggctgaacattaaagggtgagtgaaaatgtttgtttgtgtgttttttctttaaatatagaataatggtttatgagaatcacctgcagagtgtcagttccttcctctctgactccctcctaactcttttttattaggctaatttccttccttccttccttccttccttccttccttccttccttccttcctctctgtgcctctccctccctccctcactcactcactcccttccttccttctttcctcccttccactccctccctccctccttctttccttcccttgctccttccttccttcctttttctttcttccttctttttttaaatttgttaacaaaagaggacactatcaactcgtagcttctactttgatagttgttagaattttccacattgactttatttctgtctttagctcctcctctacatctatgtttaaacacattttccttcttccttccttccttccttcctcccttccttcctccctcccctcctccttcctcctctcccttctcttttcctttccttccccttatgaaaacaagttgacaacatcacaacagctctccttaaatagtttcgcatctttcttctaagaaggacattttctaacgtatcagtatcgcacttaggaaaattaacaaatccataacattatctaagatctcaacttttatgttacccaattatcctaaaactgtcctgtatcactgtatttttatattatccccttatgtatttatttttcaaatttaatttttaaaagcagtgggtacatgtgcaggtgtgctacaaagatatattgcatgatgctaagattcaaagaatgattctattaaagaatgatactcattatatttgattatgcttctttagtctcttttaagaaaaataatagactttttagttttaagctgttttaggttttcacaaaaagagcagaaagcatagagagctcccatatatcctttttccctgttctgtttttcttattattaacatcttgcattactcctccatctcttttaaatgagaacgatccccttatcaccacccagctccaattttactgttttgtttttttttttttttttttttttgcgggggcagggggtgtagagttccaggggtgacttgaatgggcaactctatgcaaaaatcactgaccttagtccctggtagccagtaagaatgtgtaggtgaagtcaaggcaaattctgctgagtcacataaggcatgcaggcaggtgtccactcagggcagctcgatggattggtttgtaaaattgtcaaagactcggccccgaccttaagcatcagagagaacagcaagcaagccttgagagcgaccttgtctcataaaaactgccatattgtaaggaatgtaggatattcactgtgtctgtttcctgactctattccccatgtcaggagtggccaggcatggggacagcatggggacagattgctgctaatgtcacctcctcctcacttccctgctcccttggctatccttcccccaaaccccagcaccctccttgctttgaacttccctctcagctaggggtgggggagcttcctaagcctcagttttcttgcctgtgcaatttaggtatcagcccttgctggtcaagggttttgcagattgaataagctaagaatcaataggaggaatcttctgcttttgcttggagtgtctttcttgagccatcgccgccattgaaatcctacccttcttccaaagcctgactcaacccacctcgtcaagaaaggctgtgcatggccaggcgtggttgctcacgcccataatcctagcactttgggaggctgaggtgggtggattacttggggtcaggagttggagaccagcctggccaacatggtgaaaccccatctctactaaaaatacaaaaattagctggatgtggtggtggcgagcacctgtaatcccagctgcttgggaggctgaggcaggagaattgcttgaacctgggaggtagaggttgcagtgagccgagattgtgccattgcactccagcctgggtgacaagaatgaaactccatctcaaaaaaaagaaaggaacgctgtgcacccaggcaccagtattgactgctgtctcccttgccaatctcttgctgcatttatagtctgtgcttcacagtttctctggaatttcttgcattgctgacccttctccatggtttttttccagactcaacacctacactgctctccccaggaggggagggcagcccatcttctgctgctatgtgctgaaaacattataggtagacagaccagcatgggagtctcagctctgctccttctcagcaagcccatttgcctgtcttagcctcagcttcctcatttataaaatgggacgataaagggcagtagagcagagcagttgggagccatgggcctggggtaggactccttggtttaaatccatgttctcccacttattacatgacaaattactgattctttctgagcctcagttctgacttgggaagattgcaatatctgctttagaggactgttgtgagcgtaaacttgagtaaagtctgcaaagcctaaaggcataatacatgataactctaatgatgtgctatttacctgcacaccacagtggcttagtaagtgcctcccattccctgcataatgcatagtcctgggtgccatgtcaacttttgttacagactctctgttgttattttggactcagttaccaaatattcaggtcatcttcaaagagcatctggtttcccatctcaggcctcaccagtattaaagaacatcaatatgtttttaatttcctctttaatttcagggagtggatgaagaacggggggtgacagcacgctttgggggatgattcacggtgtcattaaatctgcattgagtttcctgtagctacaattggcccaggctatgaccacactcagtcctgggaattatgttttgtttgttttgctgtgtgattaagtctaataacagtaaatccagcatctccttgacttggactttcttggttcattacatcgcagtggatcttgaaaaatatgtatgtgtagatgtaagttcaactggttgagtttcccgtcagccttctgcccagtaggtgtgtgatgtagtggaagaagaagaatgggattcagatctggcccaccagggttcaaatgcaggccctgccacttagcagtatggccttgagcaaatgttttctcaccactgagcctcagtttcctcatttgcaagatgggatgatgcctctgattttgatgcggtgatgcttcttagcttgatgagatgctgcatacgatacatgcagatataggtgcctccttctttgttcttcaccgattttcatggagcatctgcttctgtggctgacactagagataaaatgatggggccccattcataagataatctgaaaggggaaggggtatggtccaagcaggagacactgtctcagacactagctcgttctgaggctgaaccaaccacttcagtctccacttcccttctctgtgctgttcacagtaggctcatacataggaattgtttactcttgaacatctgtcctcaatctggggacttctctagcactgatgaaagaggtcattaaaagcaatcagacaagggttaagattttaaaatttatgttatactgttatgtcaaaggattaactttgagataaataagtcatgtatggaagtttaactgtagtgtcttttgcctcattggtagtactgggggtaatggaggtagaagtggcttccactcttaaatactgaatatgcatatggcatgcatcatctctcatttctaacaagaccctgggacctagggcagtgtcattctcactcttacacctgtgcaagttcaggcttcaaaagataactgggggcccgggcaccgtgactcacgcctgtaatcccaacagtttgggaggccaaggtgggtggatcacttgaggtcaggagttggagaccatcctgaccaacatggtgaaaccctatctctactaaaaatacaaaaattagcctggcatggtggtgtgcacctgtaatcccagctactcgggaggcggaggcaagagaatcactcgaaccctggaggcagagtttgcagtgagccatgatcgtgccactgctctccagcctgggtgatagagcaagactccgtctcaaaaaataaagaaaagaaaaaatacctggcttggaatagacagagctgggatttgaactcaggtctctctgcatctgaagctctttttttgcttttagccttgcaggttagaaagagtggcaatttcagtattcctgagttttcatgtcctagtttacctaataaacttctataacttgaagcaacccatacttacagcattttcatataaatacccttattcatcagttcatttaatcagtccagtatttattggaacctagtatgtgacaagcactggagcatgattcataacttgaacatacattttattgagcacctactatgtgcctgaggactggcaattcactcatgtatccaacacatgtttatggagcacctacaatgtgttagggccctggtgcttccctcactcactcaacacaaattcattgagcacctactgtgtcctaagacattattctatagacactggtagcagtgaatacaatagataaaaatcctgccctcatggagttcttatctccacagcattgcaaggccaatctagtttccctcatttttcagctaaggaagctgagggttagagaagttaggcaatggtccccaggtcacatggctagtgagtggtgaaaccagacttggttgccagctgtgtgtgcttgcagaggttactcagcctctctgtgcctggaggtcataatccctatctctcagggtggctatgagggtaggagccatccgtttgctctctcctatattcctggtatccagcacagcacctggcgcacagtaggtatctagtcaggggtagctgttgtgaccaatgactatttcatccactaagttatagaaccagccccggcatctttgtggctggatgcttatcctctggctctttcccatagcaggtataccagaaggatattcctttttggacagactacagggtgggcagaagaagtctccaaggcttttctggagcctctccttgaagagtaacagtgcccctgcctatcctgcctcatagtgactctgagagccttctatacgtcatccctctccctggcccaggctctgggaagcaggcacggtaacatgttgattatctgacatccctccatcatgatgatggagagttccatctgagccacaccgacctggtcctgtgaggacagctagaaaaaaaaaaaaaagactcttactggtccccggatgaagtcagacaggatgtgtttgaagtgtccagtgctgggacaggaatggggatgatcatccagcctcactcagcagaacttgggatccttatcccaaagcctacaaaacggcatctgaattcagattaaattcttcagtctctatacagaaagaagtggatgcaaggaactttataccttgagaggtggtgcagacaggaagtagaaaaagcacttgcagagatgtaggtggatttctgcatgggaaagccaggaagaagcacttggccgtgcttcttgccctctcttccttgtctctcctcactcgacccctactgctcctctccagccccctaggagtctacactacgtggcttgtattcctgttttaagctcaccagctgaggtttcaaaggcaccagaccatttcagaaaggtaggactcagctcactccaatctcaagacattagaccccatgacagccaggctaggcctgagtggctgtgctgggacatcttggcttccatgccttgtagaaggcattgctcctcaagggccccagggaaggcgagtggatcttgccctgtgccagcatagctgggaaccttcctggcttgggcccagcaaacctatggcctctgtacctgattgccagcactcacagactgtgacctccagatccccatttctgggcagctggctacttcgccatggaccccagcctatctcgcctttttgttaaagccaagatggcagatccttagttgccggcctgaaaggcctctgtttcccctctctccttcttgcgtttgcctaagtctccttccttcttctccatcaccaccgcccttctgggtctccttcctctttctctccatctcatttcaacttctttcctgtttaaactgcctcctcttctttcatgctctagccttccttctcttcttcccacatttctttgtcctccctccacttttcttatcctgactacctcttctttctcatctaccttgattgaattcgacagcatttgctgagcatctactacatactgggctcagtgccagttccggaggtgcagaaatgagagtcagcaagacactgtcagttcagacttgtggtctgtgattctccttcctcctacttttatgccttttttcccccctatgtttttggctcatcttcctcctccctcctcctcctcctcctctacctcctccctcctcctccctcctcctcttcctcctcctgggacttcttcaccctccgttttcatgccctgccctggtgtccgcagccagcagtggcagtgggagctagggtgagcaggatggcagagtcccgggagattcagtgacaggagccctcaatgttgccctcctcaggtggcaggcggtggatgagacagagcatccaagacactcattcatcacacccgcctcctttcagggccaggacaggatggaaatgacttttgtcagttctgcggcagcccactgcccctggcagctccaagctgtttattaataaaaagtaaggaagaaaaaaaatacaggcgtgtgaatgccatcttgctgtgtattcgaggagggattccaaagcaatgaagttgacaaatataccttcagggaatcacaaaagagccctccatctcctcttccagcccatgtccagctatgttgggaacagacaagaaataggaaaggagggagctgctctgggcaaacgtgtggcttttgttttagcacataggaaccaacctttcttcttacggtgagacagaaggtcacttgcccattcattcttctatgcatccctctttgaacttcaattgaggcttttattgagtccagtgtggggttgggttctggagattcagaaattaaatagtagtaatattgattgcctttaattattaatgattaataaccatttattattggttataaattattcatcataaccactaaccattatttgggtaattaggtgccagagacagtatcaagggtgtttctttcactgtcccagctgccccaggaggaaggcaccatgactaggggtcggggagtagaaggagtactccgggtagaaccactcctgcaagacccagaagcagggagggcttggcctatcccaggagaccagcgtcctggagcagcatgagcaagagggcaggaatagcaagcctgatcacacaggagaaggattgagggtgatggtcagagagagaaaggaggtagctcctccacattgccaccttgacacccaggtcttaccgtcaccagaccgctgctgtaaccctcctccacccatctgacatagggagtaaggagaggcagatgatcacagccagctctatgtcttgtcctcatgaagccctttagccgggcccatcattgccatggcgatctcacacaggcccccagcctggggagctcctgccagacctggaggagataggtttgtgggatcactgaagctctgtcctcaggggcgctcaggaaggcagggtctaggtgcctgtctcagtctcttctggctgctataacaagaacaccatagactgggtggcttataaacaacagaaatgtatttctcatagttctagaggctgggaaatctaagatcaaggtgctggcagttacatttgttgtctgattcatagattgccatctcactgtgtcatcacacagtggaaggggtgagggagccctctggggcctcttttataagggcactaatctcatttacaagggctccaccctggtgacctaatcacctcccaaaagccccacctcctaatatcatcatattgaggattaggtgtcaacatattaattttcgggggagacaaacattgaatctatttcagcccccacctatttccctgggaaagacactgctctcctaccccagccattccctcccgtgccttccatggccatcacctcaagggagctttgggttggcttccttcccagattcaaaagcccattgggtcactgtggtcagttctatttctcctaaactgtcctgtgtgatcaggagtggaagtggtgttacccaactgggtaagcaagaagtcttcctcaaagtcttgtagcagaatctcagtcaccctttatacatagagttctgaatcctacaatcgtcctgattgttacagttccagcaacaaagcactcagaggcagggaccccatgattggaaacccgcgtgtgcatcgccctcagcatctcttcaggcctgagcccacagtggctttatctgcagtgccaacactctgacatttggcaacttttttacttttttaaaaaataaattataactttggtgaggggagggaatggggtcgtttctcttagagagaggacaaatagattttatttattaaaggaaaggttgatggactccagtctctctcctttgaatgatgccatttattttacagtctataatttggtcccactgtgagcctcctacttttcagaggcaaagtgtttttggcgctgctgccacaaactccctctgcataaaaaccacgtctggtgtagtcccagaatagaaaccgtctgtcctcttgtgtatagtcttggttttaagttgatttcatgtgaatctttcccttttgggggaaaaagattttacctacaccgtcaccccatgaaacaatcagggatgtcatggggtatcccgtggagacacatatttgggtcttgactctcagaagccccacttggtgggactgtcctctaggcttggccccaaataaacaaacagcccactgcatgtccccttccggtcttgaagaagcaaactacttatttcacagtaagctctgggatgataggtcctatcatgtcagatatgatgcctcataaatctaattcatccgtcctagctgcagttttaatctactcaaatgtacttagctgggtttaattatagatagaaattgcattcggaaagcaacaagaaatcatttacatggcttgaatttgcacattaaatcatatggttcatttgagagtgcggtagggatggtatttccaaagaaaaataatattagtgcctgtgcttaggggctctcacaccgattgcacaaattgtatgaattgcacaatttctacagactgcatttttcttcttggcacaggataaacgaagaggctggggacactgagaggacccagtcggcattggcactgagcagagcccggtccaccaatgtccacagcaagacctcaggagacaagcctgtttctccccactttgtccgccggcaaaagtactgtcattttggggacggcgaagtgcttgccgtccagagaaagtccacagagagattagaacctgcttcctctcccctggcttctcggagtacaaatacatccccgctgtcgagggaaaagctgcccagtccttcagcggccctctcggagttcgtggaagggctccggaggaagagagcccagagaggccaggggtccacgctgggcctagaggactggcccactctccccatttaccagacgactggggcctccacactaaggaggggcagggctggcagtgacgagggaaacctctcgctgagggttggggcaaagtcacccctggaaatcgaaggggccgctggtggtctcttgaggtccaccagcctcaaatgcatctcttcagacggtgttgggggcacaaccctactccccgaaaagtcgaaaacccaattcagttcctgcgagtccctcttagaatccagaccgagcatggggagaaaactgagctctccgaccacacccagggacatgctgttgtcgcccacactgcgtcctcggaggcggtgtctggagtcctctgtggacgatgcgggctgtccagaccttggaaaggagccgcttgttttccagaaccgccagtttgcccacctgatggaggaacctctaggcagtgacccattcagctggaaactcccaagcctcgactacgaacgcaagaccaaagtggacttcgatgacttcctcccagctatccggaagccccagacacctacctccttggctggatcagccaaaggtgggcaagacggttcacagcgttcaagcatccactttgaaacggaagaggctaaccgttcctttctctcggggatcaagaccattttgaagaagagcccggagcccaaggaggatcccgctcacctgtctgactcgtcctcatcctccggctccatcgtgtccttcaaaagtgctgacagcatcaaaagtcgaccaggaatcccacgacttgcgggtgacggtggcgagcgaacgtcccccgagcggagagagccagggacggggaggaaagacgacgatgttgcgagcataatgaagaaatacctccagaagtaggaaccagttcaggtaaaagcaacaggctggggctattcttgggggaatgagagttcaccttgcagccttggggagagcaggtgccactactgtccttaatgccacaaccgatttctctagagaccaagatttttagaggttttagctgaagtcatgtgttgatggatgcaaagcttttcagaacccctctgctgggtacctctacttccttgtactttgaaatgcagacacatcagaaagtaagaggttcctgtgggataccgctaaagaaggtgccagatgtagccgggcgcggtggctcacgcctgtaatcccagcactttgggaggccaaggcgggtggatcacctaaggtcaggagtttgagaccagactggccaacagggtgaaacctcgtctctactaaaaatacaaaaaattagccaggtgtcttgacgggcgcctgtaatcccagctactcaggaggctgaggcaggacaatcgcttgaaccagggaggcagaggttgcagtgagctgagggtgccaccactgcactccagcctgggaaacaagagcaaaactctgtctcagggaaaaaaaaaaaaaaaaggtgccagatgtttaaagttacctcaccctactgtcattttcttttcttaatgtcattccacctgggtttgaaggagctgtgatggcgttctgtccacataatgacagaagatccgtggtgggatcacagacatgcaaagggccaagttggaagagaccttcagaatagtggagtccacttgcattgcatatggagagaaactgaggccctaggttcaggggggagggaacaagtacaaaaatcacagagcaacaatgcaggataagtaactacttgctgcccttcctccctctcctagcactcatcctgccactcatctggagtcaaggtaagaagaggaattcaggccgggtgcggtggctcacgcctgtaatcccagcactttgggaggccgaggcgggcggatcacgaggtcaggagatcgagaccatcctggctaacacagtgaaaccccatctccactaaaaaaaaatagcagagcgtggtagcgggtgcctgtagtcccagctactggggaggctgaggcaggaaaatggcatgaacccgggaggcggagcttgcagtgagccgagatctcgccactgcactccagcctgggcgacagagcgagactccgtctcaaaaaaaaaaaaaaaaaaaaaattcattgctaaccaaggcttacatttattgagaggacacatcagacagtcatttagtactcctgatatccccaagcagtggtgaatgttatttattcccatttaccaggttgacagactgagtatcagaaagattaaagtcacttgtacagaatcaccagggcataattgggtttccagctctagaatccctacatttatctttaaaagttttccctagggacacattccaggcatcttcatgagtgaaattagagctgtctgatagcgtatgagccttcgtaaatctcccagtcactgaatctcagaacttgctgcagctcaaggctctgatggtccagcgactgcacatggctctcagggtgcacctgctgccacccccaggcctccttgacccaaatgaggcacacgtcctctatttctttgagagacagcctcagcccatcaaaaagccattgccccttccgtggagacaggtttggactctatcagagcaaactaatttgacttaacatggccttctctctgctctcaattaccgagtaaagatctgatattcatttacattattatgctctcggggacacagaaagcagtttcaaaggccaagtaaagggcacacatccatgaggggaacagtccttagcagaagtcatcacagaacatcttgtctctgccattccgttttaaactcaagtcctccttccctaccctgagcaaggttcttctccaaggatgctagtttttcagctatacaatgcaacacctccaacgatgcaaatgcatggtgggctttggaaccaaacaagaccccccaaagctcagttctgccctgtaactagccattggaccctaggcaagtgatacagtctcaccaagcccctgtgtcctcagttggaaaacaggggtaagaataccaactacctaaagtaacgctgtggatttcatgagaatatgagagattcctggaatagagcatggcaccccatggatgcagtaaatgccaggttactttggaatttttggacctttgggaaatctatcccaactttttctccttctgccacctacactctgccatccctttctgtggagttgctacagtaacgccacctgggtatacagaattccaggccctccaccccattcattgtctctatcaaaatgtacccatcttcctggccaggcacagtggctcatgcccataatcccagttctttgggaggctgaggcaggaggatcacttgaggccaggagtttgagaccagcctgggcaacatagtgagtccccacctctacaagaaatacaaaataaaaaattagctgggtgtagtgacatgcacctgtaatcctagctacttgggaggctgaagcaggaagatcacttgaacccaggagctggaggctgcagtgagctatgattgcaccactgcacactagcctgagtgacaaagtgagaccctgcctccagaaaaagaaaaaccttacccatcctttgtcccattcatcaactctgacctatgtttgcttccagcctccttgaagctgcccttgaagacttcccgactctacaataacttggagacagagagactggccaggcctccccggtggccagagccagccagcatggccaccctcaagaggcgagatgagcccacagaggcatatcctgcggggatgctgggctcccagtgtggttggcctgaacaaaataaagtgttgactcctgggcatctgtgccttctctatggccttgctacctgggattccagagagttgatggggtgcagataggggtaggactgttagaatagaaccaacccaaactgtgtgtagtttggggtgtatacttctatttctcttcctacatgtctacatgccatgaccttcctcctcctcttcacttggccagtttcagctcacttcctccaggaagtctttcctgatatatcaaactgaaacaaatgctcctcctccatgctcccttaatccccatgcttgtcgattatattcctttgccaattcatttctctatcctgtgtatgtataagtgtgtacaagcattcaagaaactgatgaatgatgaatgaatgaatgagccaaagaacaaataaatgagcccacacaccctgaacgcatgcgacacactgatatatatgcatcctacaaatgtgcacccacatcaacattcaagaaccttgaatttattccctttttaccaaggcgaagctagcatatgtgtgcccacatttaggtagcaaatgctgcctttatttaaattcccactagcatagactccatatcctaccccaaatttgtctccatccccaggacccctctggtgtagccaatcatagctcccacccgtgggagggaattcccatttggatcacagttgtgttagtgtttgctagggctgctgtgacaaagtaccatagctggagggttgaagtccagattcaaggtcagctgggtaaattccttctgagagctgtgagggcctctctccgtagctggtagatggctgtcttctccctgtgtctcctcagttcatcttctgttcatgtctgtatccagatttccccattttatattggatagggtctgccctaatgaccttattttaacttggttaccctgtaaataccctacctttaaattaagtcactttatgaagtactgcgggttagaacttcaacattttttgagtggggctggggaagtgggcacacgattcaacccataataactggtaaggtcactccaaaaagaggagctctcatctctgatcatcctcactagagactctgggtagaagtgaggcaagggaggaggatggggcaggagggaaattcactggagacctcaccgtctctggagaccttcctgcctctctgatggagcacgttggtggaacagtggaccctgttgtctctgatgcagacacagtctcccacttattgaatccaccatccacctcttgccattcacaggagggctctgggtcactggagagtgctgggacacacggggaaaggggccaggacctctgcggagtcagaagccctggcaaagaggaggcaccacccaaaagctcgccaacacttaggtgtggggtgggaatgggagaagacccaggctcttgcacgaggttctcccaaagctttctgcagtgaaatccatcaagtcatggagtcttagccaagtcacttcccttgctgggtctcagttttctcatctcagtaatgggaacaacagttactaaactctaataaaacctgggaaagggaaagtatagcatactgtattagtttgctagagatgctgtaacaaaattccaccgcctgggtggcctaaacaacagaaatttatttcctcatgtttctggaggcaggaagtctgaaatcaaggtgtcagcaggggtggtttttcctaaggcctctgtccttggcttgtagatagtcgctttcttgctgtgtcttcacatggtctttcttctgtgtggctgcacctctggcgtctctctgtgtccacatttttctcttataagaacagcagtcatattgaaacaaggcctatcctgatggcctgattttaatcaccctgttttttttttttttttttttgagatgggagtttcactcttgtggcccaggctggagtgcagtggtgtgatctcagttcactgcaacctctgcctcccgggttcaagcaattctcttgcctcagcctcctgagtagctgggattacagacatgcaccaccaggcccagctaattttgcatttttttagtagagacagtgtttctccatgttggtcaggctggtcttgaactcccgacctcaggtgatccacctgccttggcctcccaaagtgctgggattttaatcacccttttaaaggtcccgtctccaaacactgtcacattgtaaggtatggggggttagaacttttaacacatgagttttaggggttcacaattcagcctgtaacacacaatgcaaaaggaagtggtgatttaattattattatcacttaatctattaatttattattcatacagaataattttcatacagaatgaatattattatacagaataatttactattcatacaggatacatatgtcccaagctcccagcttggtccacaaacagaggtaattcgggaagtcaggaagagattatcaatgccggagggaacagactcacattgccttcctggcattgatgtttcctgggcattttagagcctggaacctttgagtttccatgcacttcttctcttcatgtgccagtaatattatttattcagtccgtattttctgagtaccttctaagtgcctggcaccgttccccacacccaagctctagtgagcaggcagagtcaccctgcctttcttcagggaatatcttagctggggagacagacaataagcaagaaaatgaatatactgtcaggagcaagctgtactatgaagaaaaataaagatgaaattatcttgtgagttccgtgttaaaaatttataatacgtttattttatgaagcacgtttttataaaagaagaaatcagtcattattcttcaatgatgtgtaagggatgcatccaaaaaggttaatttcaagtaataacagcaaagtcttcctcattatgcagcagtaaacagaaatcctgaagatgctcattaaaagtcaattcaacatgctacaagttgacaaccatccccatgcctctcaaatcccccaacccaacacagcctggagcagaaggtacttactcaacttcatcctctttcttttcttttctttctttctctttttctctctttctctctctccctctttttctctctgtatctttttctttctttttctgtctctccttccttcctttctttttctcttcctcccttccttctttctttctttcctttctttttctcttcctcccttccttctttctttctttcctttctttttctcttcctcccttccttccttctttcctttctttctttccttccttccttccttctttcttctctttttctttttttggatggggttttgctcttgtcacccaggttggagtgaaatgtgtgatcttggctctctgcaacctctgcctcctgggttcaagcaggtctcctgccttagccttcgtagtagctgggattacaggcgcccgccaccatgcttggctaatttttgtatttttagtagagacgaggtttcaccatgtaggccaggctttgagcctctttcctacaagatgactccagaaattatgcagtgggccctgatgtcacataggcagtgtgctcacccttagcacccggcgtagtaagcgtcatccaagtctgtgacactaccacttctgctacctgggatatcaacatggcctggcccctggcctgggctttgccacttagccccaggtcaaagagtctctctctgtgtgacctcacagatgtcactgctttctgacctctccttcactcatttggaaaataggtctaaactagtaccagcttcccagcatccttgtaaggaatcaagagctcatgaatcagcccattgattggcagatagcctgcagtaaatggtggcatcattgttctttggtctcagaactgctccctgatgcctctgtggctccaaccatatggctgtgccctgctatggcgtccctgctgatgtaaccaaaattatttcaaaggtgaggatgttggtggtcatgaatccatgtggattaaatgctctcctgcaaatgtttcctcttgcttttataccctgaggccatttttaacagggcgcccatgtcttgaaagaaccctagaccataaggactagatgaaagcctcaaggtaattttacaggtggggaaaatgagtctcagagaagaaagtgagttttccaaaggcactcaatagcaaagctgagtttagaactcaacatttattcattcaacaaatagcacctcatgtcctgagcacggttgcaggcactgtagaaaaagctaagaatgggataggcaaaggccctgtcttcgtgaagcttatggtttactgtgggggacgggtaatatacttggaaatacatacattggccatgtccctaccacctgatgtcccaccagtagtccagaagctacaggtcatccttctgtgtctgcatgatattttgccaaacaccaggggtttggcctaagtccagttgctcatatcgcagaccatgagtattgccagggaagaaaatctttattatggaaatgaacaattatcaaaatactaactgcagtagcaaataacaagcccaagagtgtccaaaccaaaacagtcagggtgccttctactctcaagccagtcaactgggcttgtccaaactgcaacaaatggaaatttctttggaattcccccagattgagaggagagactcctgctgtcagggacccatagagagcactcacctgtctggatgcagatgtcagatttcaaagcctgttcttcctaggcaatcaggaatgcaattggggctggcagtggtgatgcagaagagaaggagactgaaacccatctctggccaaatatgcctgggaagctgctaggagggcttctgaaatgctcctgatccatggccactgagccgtaagcaatgaattcctgatcggagaaccagaattttgttggcaaactccaggggtttgacctaggtctggctgctcaccacacagaaagccaatcattgagacaacaaatgttgctccagaagaaaagctgtattggaggtgacgtcagcctaactgtcaaacctctccctcctcaaccaactaaagttaggggtttgtaaagcagggaaggagaacaggagcagcaagaaagaggagttggtcaacaggcagcaggtgtgtctcattgtctgggtgcagcaatctggaaagcctcagctttctgataccatccaggaggctcaaaggtcaatttcctgagaaaggaactcagataagccaaatgtacgtttctcaagtttcagaggccctctccaggccaacacagacccaaccctgtttcaaggcccctggctctctgcagagttcaaggatggggagttaaggctctgcattctttcccactcccaaagattgtacataggaagcagaggagaggggagactgttgttgcagctagaagaggcaggtgtcaaaggatgttggatgcagccgtagaaggctctggttgtgattaatggcctggccaagctcctgctgctgtcttcagaaggtgatggacagttcacactggactcccactccctggacctggttgcttatttagctgtcaatataggcagctcccttcagagcatagtgacagatgttagcagctctggtgacaaggtgacacagtgaccctgtcaccctttgttaagaatcatcatagctcccattcctgtgtgtctgtgaggagataggcactgtgcttggtgatattcaaacatcacttctaagagacagtggttgggatccactgtcctatccatgtgttctatatgtgcaaggagaaatataaaatgactcaaaatgctcctttgtaaatagctgcatgaaggcccagtagtcttattctgggctcggtgggaaaatcattctcatagttcaggcctacagcttgtaggattcactggaatggcttatttaatcctctttccatctcccatctcctagagtctaaagtttatggtcttcctgcttaggcttgctgcaaagggtaggggaagacatggctgcatttaccaaaagcccttggtcttcccttgatcctcagcttatgcataaagaggttctgcagcaaaaggtggaaggacattggaggatgcagtcccttaaagcacagtggcctcacccttggtaaagtgagtcagtgtctgtggctgatggtgatcaattaaagagcaattttcattgttcagcgagtgaggagagagaacgtaacaaggggtcaagttaatgacttttccccataccagccattgagactcaggacagaagcacagacaagtggagctgggatttgaactctgggctctatctccaaatacaggcattcttggtactaacaccatgggctaaacttgcagtgtagatcgtgctttcctataaggtcagctggctgaacgggcctatggatcacatcacttcacctgtgccatctcctggctaaacaaacctgggcctgcctgctccatctgggaggcaacggggaccagtgtctaggactaggcttgggtttactcctggctttgccatcttttaagctgtgtaacctcaagtggtttgttaaatccctctaattcttggtttcttctcgagtaataaggggtgggagaggagaccctatctttagagcctgtctggccagcaggagcatcaggacaaggattattatgcccattttacagatggggcagctgaggctcagcaaggccaagtgactggcctgagttagcagtgcagaagctgggattagagttcagagctcctgactcttcattcagtgctcttcctaagacagtcactctgaccccgagtcccaggcctggttgtccggccagtacagggaacatttgaaagagttccaaagatttccctgcactagcacaggcaggcggtgctccaatctgggcctaacacagcactgagccctaggaggcattcatccctattgttcacttcaatctcaagcgacctacctcaaaaatggggtggggtaagaggattgttccataggtgcccagcctgttctcccttctcccatgtttgagggaacccaatttttggcatcaaaggcctctagaagagtttaaatgtgtcctttcctaataaagagaagtactggaaattattcttgctgctggtgtttcactgggtgtctcatttagggctatgtgggcatcatggctcatggtccatggactaataccccatacctgtgcatggaagtcccaggagtgggtttggagggcatggatggggacaggcaagagtgttccttgtggctgaggagcaaacactgctggcagggcccagctggtacaagtacattacactggccccatcattattttatatgcagaaacaggaccagagaaggagcatctattgcctaaagtcacacagtaatttggaagcagacttcaacctagtgttttccctctaattcctgctgccttccacagctggagagaaatgatttgaggataattcagtctttgggtcaattgtaaataactagggtgcactaaagaatcctgacagcacctccaagttctggtctcaaagatttaggtctacattctttctttctctgcaatcctgagtggcccaaattctgttcaatgtggtgctaagctcaccataggcgagctgtatgggtgggcaaggtatgtagcctctctgtgcctctgtttcctgctgtaaagtcaggacaacgatgatattggatccatctcatgagccttctcaggttctcttggtatcataactcctggaatctcaattgcttcctgattcacagccattgctatggcaacatactccatgcccatggagtcccaccacctgaagccaaagtccagggtctctggctcctcctaccacatgcatattatgaagaggatctcctggcagggtgcactttaagcgctgggaaacaggagatttgagggagctgtagttacactctctctccactcctcctcctgttggattacaccacgaaattttcctatgtggtctaactggggacagaccacattagccaaccaactactgtaaccagcttggtaatgcgtgactgaccttgtatcttatctttcctgcctcatttccttctccccttagtctctctgccctgagactgtaccttccaagggcatatgagcatttaaaacttgccccaggtgcattttctagggagcctgcatcaagactaaagccaaggcaaagggtattgagaatttgcatgaaaaagcactttgaattggtcctagcactttgtaagcacccataaatgtgagctgctgtcattattattgtggctgttaatatctcttggagtctgatattcgaggtaaagaagcatcaagcaagggagaaagatgaagcctggaagactgagtaaatctgcttttccatcttctcctgcctgctctgttcttggtgctctggcagctgattagatggtgcccagccagccagattgaggatgggtctttctctcccagtccactgactcaaatgttaatctcctttggcaacactctcacagacactatagatgttactatacctggctcttccgtgatgtggtctctacctgtcttgcctgcctctgccctggatgctgctccaatcctagcatgatctttctcccttctgggctttcttgcatgcttttatctccacctggaacactcatttattcattcatatgctcactcatgcccaagtattttttgagcatccactcaaaagaccatccactggtcttaaaggcttacactagtctcacctgccttttcaccttgtcaattgccctcctccctccagatgtcagccttccttgacttccaggtggggctgggaatgctgccacagcctcctacacacctgtgcctccctctgtttttaggtttttttgtttttgtttttgttttagttatatatgtatatataatttcaatagtttgggggtacaggtggtttcaggttacatggataagttcgttagtggtgatttctgagattttagtgtacctgtcacctgagcagtgtacactgtacccaatatgcagtcttttatccctcactcccctcccaaccttccccctcaaccctgagtccccaaagtccatatatcactcttcttttcaaggcaggctctcactgtattgcccaggctggagtacagtgccatgatctcaactcattgcagcctcgacctcccgggctcaggtgattctcctacctcagcctcctgagtggctgggactacaggtgcatgataccaactctggctaattttttatactttttttgtagagatgggtttctgccacgttgccgagactggcattatatcactcttactgtttatgcatcctcatagcttagctcccacttataaatgagaacatataatatttggttttccatttctgagttacttcacttagaataatggcctctagctccatctgagttgctgcaagacattattccattcttttttatggctgagtagtattccatggtataaagataacattttctttatccattcgctggtccatgtccgcccttaggtttgcagctctctatttacttggggctctctctacacagctgtggggtccagggcccaattcatggttgatgctaaggaaatttatccataaaacacctactaggtgtcaggctttatctggcaccagagataaagcagtaaataaaacagacagataattcacgttctcctgcaatttacatgatagttgggggtgggagcaaatggtaaacaagaggagtaagtgaactatacaagatattaggacgctgaaagcctggaggaggaaaataaagctgtagaagggactagaaggcattggaagtggtgcagcgagcattttagatagagtgggcaggagaaggcctccttgggaaatatatttaagtaaagatctgaagaaagtgaagcaaccagccttgtcttgaacttggggaagagcattctaggcagagggaacagtcaatgcaaaggccctgaggtaggagcatgagtggcgggtttgagcacctttaaggaggctagtatggttggagtagggtgatcgagtgggtgaggaatggtggacaagatcagagaggtgatgagggtcagatgatgtagggccttgtaggactttgtaaaaatgttggctttaactgagagtaaggatgggagccatttagggtgaccaatcatctcactttgcccaggactgagggagctcttgggacacagaactttcggtgctaaaacagggaaagtcctgagcaaactaggatgaggtttgacctaggtcctagagcagggttgtccaacccacggtccgtgggactcctgtgacccaggacagctctgaatgtggcccaacagaaactcataaactttcttaaagcattatgagattcttttagagccttttttttcctcataagctatcattagtgttagggtattttatgtgcggtccaagacaattcttccaatgtggcccagggaagccaaaagattggtcacgcctgtaatcccagtactttgggaggctaaagttggagggtcactagagcctaggaattcaagaccagtatgggaaacatggtgaaaccctgtctctaccaaaaaaaaaaaaaaaaaaaacaaaactagaaaaattaggcatggtggcacatgcctgtaatcccaactacttgggaggctgaggcaggagaattgcttgaacccaggaggtagaggttgcagggaaccaagactgtgccactgcactccagcctaggcaacagagtgaggctctatctcaaaaataataataataacaataaaaagactggacaccctgcctagagccagtgtaggctttggagcagagttttgacatgattttacctgggatttttgctgatctctctggttgctggatacaaaataggctctaaggagacaagagcggaattagggagaccagtttggaggttatgaatccaagtgagggatgaagatggctcagaccagagtggtagcagtgcaggcatgagaaggaatgaacttctgaataaatttagaaggcagcaccaacaggaaagttggaatggagaaatgagggcctgttctctgtgtcacaacctggcagatgacctcctggcaggtgacatgcccagctcccctgggtaaggcaagagctagatcctttcttccctgggcttcctctcagtctcactggtgggagaagccaagaaatagcgactatctgcaccttctgagtgtccccaggatgctgtcatcacggctccaccctaaggagccagagaaggcgaggcctgtgccctctttctacagatgaagaaattgaagctcagagagtgataggcccccaggcacccatcaagcatgtgtcagagctggaactgcgccctgggttcactcccccaccaggtgtcaggcaggcctggtgttcaatgccagccttttcagagtgtaactcacctgggacacttctaagactgagtgttctcatttgtgaaatggagacaatgatccctgccagctgcatcctaaaaggtaaaggagactatgcctgtgaaagtgctcagcacagcacggaacatgacgcctagtaggccctcagtaatatcagcttcccttcttcctctagacccatcccccggcctgcccttgcaaataaattaaaagatgttcttaaagactgtttgggggagcccagtggagccattctgtccagctgagtggggaatatttacatcttcttttctaaaggcaaacaatttcatagagaggcagaattagttcccaagtagcctcagggctgttttgtaaatacatagctatgagtgttacaggagcccccgtttgtccagcaaaccagaacagagatgctaaaggctgtaaatatcaggacagtctctctcccagctccagttttagaaagccagaaattcatttcactccttctctctccctcttcaaacactcattcattcattcatttatgaattcactcaacaagcatttattgagtacctattatgtgctaggcactgggctaggcaccacagaactaagcaggagcaagagaaaacagggtcctgccttcatggcaccggaccttggtgcctggtacacaacaaagcaatgactaatcacaatgaccatagctcatgtttctaatttttttgttgagatctactttgcgtgcaatgaaattgctgagacctaaagtgtgttgctcagtctgtttggatgaatgcatatcaggacaggacatttttaatcaccctagaaagttccctcatgtctcttcccagtcaagtgttccctcctcccccaagcaaccactgccctgatttgtatcgtcataggttatttttacctattctagaatttcatacaaatgggatcatgcaaaatatactttttttggtgcagacttctttcactcagcaaaacatttttgagattcatcatattattagatgagtcagtagtttgttttttttattgctgagtaatatttcattgtccaaatataccacagtcatcttatttattttcctgtagatgaatatttagactgtttccagtttgggattgttatgaagaaagctgctgtgaacatttgtgttcaaggctttttatggacattcgtttttgttactgttgggtaaatacctagttgtatttgtctagattgctgggtcttagggtagatatatgtgcaatttcttgagaatttgctgttttcttcttccttttttttctttctttttttttttttttttgagatggagtcttgttctgttgcccaggctggagtgcaatggtgcgatctcggctcactgcaacctctgcctcccgggttcttgcaattctcctgcctcagcctcccgagtagctgggattacaggcgtgcgccaccacgtccggctaattttttttttgtatttttagtaaagatggggtttcagcatgttggccagactggtctcgaactcctgacctcgtgatccacctgcctcgttggcctcccaaagtgctggaattagaggcataagccactgcacccggccttctttttttcttagagttgagggtcttactatgttgctcaggctggcattgaactcctgagctcctcagcctcctgagggttacatgcacacgccactgcacctggctttactgtgcccttttctattcctgccagctgtgtaaaggaatcccagctcctccacatgcttagcctcatttgatgatgttggtctttttagttttagccattatggtgggtgtatagcagtatctttttgtgtttttaattggcatttttctaataactaatgaggttgaacccattttcaagaacttattggccatttgcataatattcttgcgtgatgtgtctgttcaggttttgttaattgagttgcttgttttttattatccagttgtaagaattctttatatgatttagatgcaagttctttgtcagagatatgttttgcaatattttcttccagtctgtggtttgcctatttgtattcttaaagatgtagtttgatgagcagatgtttttatttttggtaaagccggtttattattttttccttcatgattcatgctttctaaaccctttctaagaaatctttgccttctcaaaaggtcactgagatattctctcatctttttcttccagcatcttttctgttttagtttataatttatacttagatctatgatcacttataatatactagggacatattaagtgcttaacgtggagtgtcttatttaattctccctgacacgtctgtgaagaagatacaaacattatctccattttcacataggatgactttcatttaggtctcttattgagtttcactcatgtatctacttctttgttccataaatacttgcctaccattcattttggagccaggaagaactgcatctgaatttgcatttgaccatcacattgaagactctcacttctgacgtggagaaaacagcaactgtagccaggaaggacttcagagaggaagagggttgggatagctgtggaaggctgggtacaatgcaaatattcaagtataaggagaagaggcctctagggagaggaaatgcatgggtgaaggtgcagaggctggaatacctattgttgagatggtttgtccaatggcaatgagtgtggcaaattgtaatcatggccccagtaattcatctctccctatgcccttgggttgtcatgtgaccttggagttcctatcatcaaggcagagtatttccttcctatgtgactgtttttttttgttttttggtttttggttttttttttgcaaacagaatgaggcagaatacacagtataccagttttaagcctaggtctcaagagggcttgcacatttctgcttgctctcttgtgtctctgtcatctccatggaaacacacctgggctgacctgctggttcatgggagtcacctggagcatggctgagtcacttcagatatcctagccaaggccattcaagacctgccaatagccagcaagccagcctccagtgtgtcagctgggtcatccgagaaacagacacgtagatggagttaggagtacaagatggtgaaagacaaaaggtgacagaagcagaattagtcagggaaaggctttagacctcaatgtccatctgatacctattatatgaaatgagggaagagaaacaggattggacagagagtctaagatcatgatcatattggacaaagtctcaaccaacccaaaagggagctctggagcaaaaactttcctatataggaatcaagcattgggcagaacagccaggctctggcactctgctctgttaagtcattatccgagggctgcaccccaactgtggggccttggcttgaaagccaagggagattctgaagggagtagcaacttgaagctgtcaagtaactgcggcttttgcagctgaacataaagttctttttgatgtgagatgcaagcaatgtaccttcaagactgccacccgcaaataggtgaaaggtcccagcgaagaccagcagagcagagcagaaccacctagccaacaactccaagcacatgagcaataaacagttacccgtgtataccactgggcttctgtgagtgtttgttagcagtgttatcgtgacaacaggtaactgatacaatgagttagttgtgctctcaactgacaggcatttcacctctcattggggaaaaatggaggctctgctactgctgaataaataaatagtggttattaattgcatatgtgcctgactctgctaggcaacccatttccatttaatagtatctgtgcttatgacttcagtaagtatcagtttgtattgagtagcacaattgtggcgtcccagcagctgttgagggttaggggatgggggagattttatgcagccagtaaaatacagcaactgtcaaaaaaaccttaggatacttgttacttattcatgctcatccacttacacacttgtgatttgggagcagagggtaagcattgttgtctgtgctcattgaatctggggaaataccataaataatggcctctagggagagaaggcaatttcaccttctaacttgcactaactcagaatttttctaaagtggggcaccatgacagatgtgaaagcctcagaaatgtcctcaagggcacctcccaagtatttcccttacatttcttcaacttctccattttgcttcctttatctaatctatcagtgggacttttgactctaccaggaaaatatccaaataggtccattgccctctgctcccaccactgccactcttgttagagcaccagcatttcttgcttggatgctgtgatcatcccctacttagctctacattttcactcttgcccctagctgtctgttcttagcccaatagccaaagcgattttgttaaaaatgaagtccaatcaagacattgcttccctcagaattcttccgtggctccctatgtcattccaaataaaaacaaaattattaccatgagttgttcttatccattatcaggaaacaaaccaccccaacacctaggagcttaaaataatattatttcccactggggtagctggaaagtccaatatcaccttacgcgcatggctggtagttagagctggttgctgtcagagatccagtggggccatcaggtgggtgcctcagttctcctccatgggtttgcctccacatggctgcttaggcttcctccaaccgtggtggttgagcccaagtgcaagagttacaagaggtgaaaggggaggttacagaactccaaaggccaagtcttggaaactatgcggtatcacttctgccgccttctattagttggcccatttttttttttttttttttaagacagagtctcgctctgtcacccaggctggagtgtagtggcgtgatctcggctcactgcaagctctgcctcccgggttcacgccattctcctgccttagcttgctgagtagctgggactacaggcacccgccaccatgcccggctaatttgttgtatttttagtagagacggggtttcaccgtgttagccaggatggtctcaatctcctgacctcgtgatccacccaccttggcctcccaaagtgctgggattacaggcgtgagccaccgcgcccagccagttggcccatttttattgtatgtatgtttaggggggatgctacaaaaaggcatgactattgagagatgtagttcactgggagttctggaggaggtgtcgccaatataaccggttaccaccatgatctatccttgtgttgtccaataagatagccactagccatattcagctactgaaagtttcaagtgaccagtccaaacagatatgttgtaagcataaaatgcatatcagattacaaagacatgatataaaaaatgtaaaataaatcatattaataattgtatatatataaaataacttgaaaatatttcattatattgggttaaatattttaaattaatttctcttggttatttatattcttttgaatatctagaaatgttaaacctattctggcttgcattctattttagttgcatagatctgctccagtccctgtttaccccctctgacatctaacaccatgttcctttcattcttcagttcctgccacactggctgcctgtcagtttcttttctacctctgatccttctcttttgctgttccttgtgtgtggaatgctcttcccattggaattctcatggccggctccttctcatccttcacatctcagcttcaacgtgctttgctgtcagagtctagagtagacttcctccggttactttagtccccactcactgtttattttctttgtggtctgcatcacacgttgtactgtagttattggtctgcgcgtttttttgttttgttttgtttttgtctgtttccgctactactcagtaaaagccacgaggacaagaactctttcctggcatgaaacagaaactcaaaatataattttaaaagactgccctgaaaagtcttggcagatatactgaagagtccccagactctagaccaatgtgataaatgtgtggaggagtcccagattccaagtcccaagatcaagctttagatttacaaatagtgccatcattgttattaccattattgtttttagtggctgggggttaaagacctctggggaattctgaggaacgggggtggggtgcagagcatgactcctgtgacctgcctgtggggtctttctccatcagcagaaatgaaagtggcgcagaacatgccagaccttctcacagctagaacccaccattctatggcttccttttacccttgggccaaaacctctcaactctttatgctgacctacaggactataagcacataattgatgctcaaggagtatttgcttgttatctcctctcattattaaaaaaaaacaaaacaaaacgtgttggctattgtgaatagtgctgcaatgaacgtatgcatgcatgcgtctttatgacagatgagttatattcctttgggtaaacacccagtgatgagattgctgggttgaatggtacctctgctttcagctctttcaggaattgccacactgcatttcacaatggttgaaccaatttacactcccaccaacagtggtagaagtgttttcttttctccacaacctcgccaacactattgggtactaggcttagtacctgggtcacgaaataatctgtgcaacaaactcccatgacatgagtttacctacataacaaacctgcgcatgtacacctgaacctaaaataaaggttaaaaacctctaaaatctgaaaaaaaaagaatgtaggacgggaatagcagactaccaggacagggattgactgctcaggggctgcccccagctgtcaaacagtaccctaaagatctccgaagtggcaaccagcccccagcacctgttcatctgagatgcaatggcaatggaaaacagaaaccatctatctagagacccaaggagcattttaagaacaacagaaagcaggggtgaagtgaatgaaagaagaaaggtaatttaatttcagtgcaattgcttcaagtacaacaaacacaagcgtctgattttggaaagattgagtggaagaggatatactttttgtaacagcctagtccagagtcacaggtcttatttgccatttatttaagcattggggagtacagtaagtttattcaaaatgaggtaatggatgtgaatgcattttgtaaactttatagtgcctgggagataagaggtgatggttattttgcaagcataatgtgctcttgaaaaaacagtcctaaaggtttcataagtacagaagtgagaccatcttgttcaccactgaatcctcagtgcccagcactgggagatactaataactattgttggataaatgagtgactgaatgaagaaatgaataatcactgggccgggactccagaggcctgagtttgtgtcctgaccacacctctgagtgggcttaggcaaatcatgttacctctctgagccactgtttcctcatctataatcatagtacctgccctgagaattcagtggaaaaatgtatgctaagtgctggacacagtggctggtatacaacaagtacaaaataatagcatactttcttttgcactgcaaagtcaaaatgtagactcaatacattggagcttctaaaaatttaaagtacagctgtccttacaaagtgattcggagtcaatgcttcagttgatttcaattcttacaagcaatgccctcagaaaaacagcactatttatctctggtaggaaatcaaattataaaacaagtaaaccagggtgaacattacccatcaggctgtggcaatgggtgcgtggaaactgatgagccgtcattaatttctcccgcagaatcactacctaaatatgagttggcagtgtggggaaaaggaagccatttatctgtggccagatacagactcacagatgcactgacagtgtcataattacacaccggaagtatgtcgtgcagggttcagtgttcagtcaaagccctgtcatcatggggacaaggtagtttccttgggaatttcgatatacagactgtagaccagaagtgttctcagagttcagccatgcctctgtaccgggctaggggagtgtttcaagattgccttctgcagtcacttctgctggtgttgggtggagggctgttagggaagagaataacaaaactatttgaacagatgaggatctggggatgtatcattattaaatggcactgataggctgaggatctcctggtcttattgtatctgaattttctcgacagggcacgtaggaatatggaagtcagaaggacaacacagctctgctacgtcccggttcttggtaactttcttaaccccactatgctttatctttagttttcttatctgtacagtgaggatactaagagtccttacctccccaggtatttagatgaattacgtgttagaacagtggcaggcgcatagaaaatgcccaataaatattagatattgttattgttgcttatgagtagtgatgagggaccctgagaaggtccaccagcgaataggtcctatttgtaggataaaaggttggatgaggttggggagaaaaattgctggaaagagttacaagtgatgttaagaagcaagtattgaaggtaaacctgacaagctattaagtttaaggatagatatggttctgagagagagggagataaagatgcaaggttgggagacaggtcacctgcaggaacaaagcgcgtgttacatatttaatacttacatgacaagtaagacttcaagacagtgatcaaagcagaaaactacaatttattgagtacctattatctacaagatgcatgctaggtattttaggtacatagtgtcacagccagagaagatatggataattggtccctttttttttttttttttttttttttgagacggagtctcgctctgttgcccaggctggagtgcagtggcgccatctctgctcaccgcaagctccacctcccgggttcacgccattctcctgcctcagcctcctgagtagctgggattacaggcgcccaccaccgcgcccggctaattttttgtatttttagtagagacagggtttcatcgtgttaaccaggatggtctcgatctcttgtaattggtcccattttacagtgagaaaccagaggtctgagcagtgaaatgctttgccaagtcacatagctaataaggaaagagatgggatttgaatccaagtctgtctccaagtgagtgcaattttcttcctaaaaatttcattataaagtaagacttgcctgtgaaaaaagaagtataaaaagacatgcagtgaaaaatgtttccttcgtacttctactcttggccctattccccatgggtaatcattcccagtgatttcttgttatctttcctgatatatttttaatgcatggacaagcaggaatataaaatgcacaattttttaaaggtatgtgtcttaaaaatgtatgcatttgtgtgaattttacaaaaacaaatttgagcatattaaataaatgtttctacacattactttttgcacttaaaaacatattttgaggatctttctgtattagcacaaaaataccaccgtaatatgccattgcatgaatataccatcattttttaaccagtccctcttgatgaacacttggattgtttttagccttttgcttctatcatgttgtaatgaatatccttgcatatgcatctttggatatatgtttgaggtcatttgtggaaggaatttttaaaggcaagtgctatgttgaaaggtgtatttttcttcttgttgttttagtagactttgctggaatggaaattgggtgtggtttttcactattctaaacctccccagtgtctgttgttggctgttttgtgggttggctttttagggattaaaggcacaggttggaggatgggattccctccaacttggctgcaggttgttttgagatggtattgataatttcatacattatcttcttgtcgactaagaaaggtcatcccaatttattgggctggttaccaaagataatggtggcaattcagcaatttagtgtttgtgtcattttataggttggcctgttgctgttttaacagaaacactgggattaatggatgtatattctcactccttccctcccttcccctactaaggaaaatgttttcattgttcactcagcattcccatcatccccaccagacatttattatgcaaaaaggaaaactcatgaggggtgagaaaccaaggggtgggagtggagagatttagtccacagatgaaaagaacaagaaagaaagaagaggaaaagttggcagcttgctgagtttttgattaagtgttgagaattgtggagaggttaggaagggaatcactttgaagctgctactgtatggaaggataagaggtattggaaaaggaggctttaaacatatgttgtgagttatgaattgggtggtttttttttttggttttttttttttgagacggagtttcgctctgtcgctcaggctggagtgcagtggcgtgatctcggctcactgcaagctctgcctcccgggttcatgccattctcctgcctcagcctcctgagtagctgggactacaggcgcctgccaccacgcccagctaatttttttttttgtattttcagtagagatggggtttcactgtgttagccgggatggtctcaatctcctgacctcgtgatccacccgcctcgaactcccaaagggctgggattacaggcgtgagccaccacacccggccgaattgggtgtctttttaagattaatattggaaatgccttttagtgccttttggctgctagactgattctttgaatgtcacgttcctccaaaactggaccatgtagtactccaaaatgtgcttgggttatgctaatatcactgtcatcatcatcaaccatcctcatcatcactgctactacttgttaaacacatttctgtgaaagatacagcattagatgttttacctaattaaaaagtaaggtaggtaatattactatacctattttacagaggaaaaaacagaggaaagtggttcagcattttttgctcctggcctcatggctggtgccagtgctggaacttacacccatgtctatttcaaaagcccatgcttgaatcccctatcatcctggtcaccgtcttattactgtaatctatattaatgcaagggtgttcttaatttgtcctcaaatatatgtttgagccctttggtagtgaaccccaaattcatagttgcctaaaaattttcctagagagctaggttgcatcccttgggaaacaatgaagcattaactcctaggaattgcataagggtgatcagggctggagtgcatttgtaggtaaaggaaacaagacccagtgacatggagttgaggaagtctactgatgctcaagagactgagtccgggtgccaagagatgagaccacagaatcagacccggactagctatgaaggaatctgaatgccaggcttccagatttggttttatgatacagatgtgagaaatctttgatgggttctgagtagatttcccttctaaaaaaatcacaccagctgcaaaagagatgatgcaacagaaaggagaactgggaggggttgggggacaatggaaacactgatgaaaaagtctaggtaagagatgataatgggtgaactcgggccaacaggaagggctatgaaaggacctagaaactaattggatgtggaggcggagaaaaagagaggatgcctggatgcctctggggtttctagtctgggtgactgctattttcccaggccactgcttagcatcacagagcaaggagtcccaggaccatgaataaatcctgcagccccaggacagagttctgttgtatcacttgctttctgcatttttacctccttcttattccataatccttgccctgtggaaaggggctgacagtttcttaccagagctcaattaaattatctctgagcccaccccttttgcaagtcctgtgtgcccgctcagtttccctgccgagaaaatctgcccaagcagcagagccccatgccagagatgtacaatcccctgttactatgattaatttggataaacatatgtcagagaagcaacagaaaatgagctctcctctgtgaacgagaacaagctgtgttgaacctgggatcattcaggcttcaaatttgtaggcaacttccagggagcatgggatgaggtggagttagaaaatttcaaagcaacaaggacactgtatgttccttgagaggaatctcctcattgcaattgcttcttccaagttggttgataaacagagctgagagcactggagaggaactgagccttgattttttcctcacagagcccagagaaagagctactgtttatagagacggtttaatagagtggtctagagctttggcaccaatgtcgatgggacttggggacacagcctggctctgccactgactgtggaaccttagtccagagactgtgcctctgaatctcacttttcatctgcgaaacatagggtgatgatgtgatttttaactcatctgggatcttgaggatcccagatataaagtgcatttaagcaacataaactttcaagcatcagacagcatgctaaacatcgatgctgagtaaagcagactggccacctgtcttcttagacagcacagtctagtagatgttcacacccctcaggcttcattagtgactgcctcctgtgtgccagacaccacactgagagcttttgtttattattatctgcagcttcaaccaaaagctgagaggtaagcattgtatagagcccggtgttttttctctttaaaacactaagttcatttaaggatgggattgatatgatcctctatccaccaagcccttggttaaagaggaccactctgtagcatgacaaccttcccttgttacttggggagaaactatcatctatctcgggcttttaagtataacctcattatattccatttaccaaggttggaaagagccatgttctggtcttggctgggatttgcaagacctggagcattgaagagggcctgtctactctaatccggtgagaatgaggttgctaaggagacctttgtcattattaaatcagtaaatactgggatgctgatggcttccctgaaaagggggtgctttctcttttgagaaaggaaaacaactccctttggactggaggggaaaagccatcgtggaaagtggtgtttgaaaagagaacaaaccactttgaaactctttatctttctggtttatcatgaggcaagaggagaggcaggagggacaggagttgtattttaccttatcaagaaatctaggcttcctaagcttccttctggaaaccttgtgccctatacttaagagcaagtgatttttttaaaagagagagagaaaaaataaagaaaaacaaaattaggagagccagtgtaggagacagtaaaagactggtttactaaacagcaggcacctaatgaggcaaggactttagatgtcaaactggcttgaagatgcagaaaagactgcacactgctggaggaactaatcctacgcctgagatgagctcattctgcttgcttaggaaaagcaaagcaaaagcattaatctgtttcctgattgatagcagacttggattaataaaaaaaaaagtgcctatgtatgtatttcttgcaataaaatatttattacagaattttaaagaaagattaattgaccagatgaataaatagtattccaggttgctgaagttttaagttctgtcctccaacaaatatagatttatccaaagtgtattcaaatttttgaaatcctcagccgtagctggttgagctcttgtaagtactgagactgggtctatataaagccaaaataggaaccctccaaagaactcagtttctcaaccactttcagttcataaaataaaatatccatgaattataggtgctggatggaaacataatgaaaatcttatccatcaatttcaatttgcagaagaaaaggttggaagctagagaggtttgatggcctgctcaaggtcaaacgggccctaactagaacccaggtatcctcactcctggtcctgtctaccttccacaaaggagacctgttggtttatttgatggtttcaagttcttcattgaaattaaccaaggtatggcatcctgtgatctcccatcaatttgagccacaagaatctaacttgatcaattaattcctgcctcattttattctgttctcttccttctcacaggaagtaacatttctgccaacaacaacatccactcctactcagctcttcgttccctgcaattcctgtcttgcccgacccctgcagagtggaagaaggtgatggatgggcagagaaatgggagatggacagctaccagggaagaatctgtgatttgggagccttttggtgacatgcacattcaaaggactaggaaagaatggctttttcaaacagcataaatagaaaaccagtgggcccgagcgctcactgctacataatgaacgtgcctgccttttcctaacaacattttaagtcggtaattggcccgacaggggacgtgaactgtacactgagtcacagaatagtacagaaaatctcagaatggcttcacctcccatcaggaaagcctcccgtgtaccaagccctgtagagacacatttctggcatttggaggagtgcagacgttcaaaataagaaagagcttcagaggacaaccgtcccctgggttcccggccttttccacatcagaagactctttgatatgttcccctctttccctagggccccttgttctaaaggatgcagccagcaaactaaactgctctgatcatctaaaaaaaaaggatatgtttcccacagaataaccacagatctatataacgaatgatcactcagttaatatgatgcctctaaaagataagtggcctgtctcatctaaaataatcataatatcaataataatatgattttattgggtgcttactaaagcccagatgagggatttacaatgcttatcttacttaatccttatgagactgtcataaagttgtctttatttcacagttcaggaaacagaggcacagaggagttctgtaacttaccaaactaggttcaaaactcagatttatctgactgcaaagtcacttttttttttttttttggatttagcttcaaaaggacattgcctttacaaagttattcttaaccatgctacagtttttctattagtttttttgaaatattgacactcatttgggggaatgcccatcagtttcttcacaagcttttgcaaggttggaggctttaggttaagtattgttgttttggtctcaactcttcccttaatagttaagataatggagacccacagagggctagaaacttgctcagtatcaacctagttaattagcagtaacactaattttaaatgctagtttttaaaattctgggtcctgagctctttatgtcacactcagcttcagcaagtaatagttgaacacctatcagagggagggcagataagtagcaagcatgtcatcacccttataaccaaatagccatggcagacattactaatcaatcatggaaatctttcctgctgaacctggatgtggctccatgcaggcactcccaatcaattagaattggcaaatgagataaaacttattcactattgacaccatatgcaacactgttcaaggtcctcaagatgatgtaaaacaagcacaaaatgaatgtctgctttcaaaaatgctatcactttcagaaaattatttcagtccaaagtaatttatttcaaagtactagggcagaccaacttctaatgccagtgatttttggagacaggcaatatcatgaattgatattgataacctgctcacaaaatcaagatcaaccaggatgagagtagggatagggaccaccttgaggggacgggatatgagaatgtgagtgggagaaggtggttgctggagggccagtcaataggagaaggcattaactcaagagaaatgtgtgagtgcatgaagctgagggtggaggtggaagtgtaatttgacaaggagggacactaaaattgatagctgagagagaatgcggtatccactgtgcttcagggactgcaatagtttgaatgtttgtctcctcaaatttcatgttgagtttgatccccaaaactggaggtggggcccaatgggaagtgttagggtcaaagagacagattccccatgaatggctttgcgctgtcctcatggtaatgactgagttctcactcattacttcctgcaagcgctggttgttaaaaagagcctagcatctcccctgcctctctctctttcttcctctctcactgtgggatccctgcacatacactcacctttgtcttccatcatgagtggaagcagcttgaggccctcaccagatgcagatactgtttcttgtacagcctgcagaaccatgagtcaaaaaatcctcttttctttataattacgcagcctcaggaattcctttatagcaacactaaatggactaagacatggacaaagctgagatttaagggtggaaggagcaggttaaaagtattaatttgttgcatatcaacacttgtgagtaagatagctcttctctttgcctcttcacctttttaaaataagtgaccatgataaaagaaaaggttatagaattgggagaaaaggacaatataatataggccctcccaaaacctttgggactgtttcccactatgaggtagacttggacaaggacattttctgactcccagaagtggtgaatgccacgtggtcagcaaattctgtcaagactcttccagccaaacaagtctatgtcatcttgcttgttactttacctcttcaaaggcaatggctactgggatgatggatcttggaagcattagcaaatggagtcaaaagaactaaaggaagaggacccaaatgtggagtgaatgagacggagattgtgtgagttattaagtatagaacagcccaactccagggtgggaaaagaggaattatgcaaatgccaggataagcatttccactttggaattctaagaaatgagagttttctagagaagttgttcatcaagggagaaattctatgtcaggaatgtgtcaaaatttagaaccaagcccctttcataggcaagggaagctcaggtgcccattgaggatgccctgagtttgggaaagaggacggtgtcttcctgggctaagcagctgtctgcaccactttggatcaatttccacttgaacatgttgccactgcctcccaaactccatcttctaaccccaagaatgcattgtatagaattagtctcacaattccacagacagaattagcctctgcaatgagagatcagcccttgacttgtggttaattacgtacaattcaaaatcaaccccctgttgttcacatttcccttgtgcctggagctcttggaagaagaaattgcatgctgtcctgggaaaggctggagaaggtgtatggcactaggttgcaacgtgttggcatgtcctaaagacacatgtgagaataatgtggtcgattattgtgacagctgaggacagactttgctagtcagaattctggggaaacaactttaagcataaaaatgtttcttttaaatgattattttattagccttgtgatcagtgcagtacaggattctgttcctgttgaaagaagtaaagcattcgtacatccccagcgtcctttagtgagctctctagggcagggaccagggaactatggcctgtgggccacattctactcactccttgtttttatatagtttcatcagaacatataatttgtttacatatggtctatggctgctttgaactacaacagaagatttgagtagctgcagcagagaccaaataccctgaatggctcacagagcctaaagtatgtactacctggctctttataggaaaaagttcaccaacccctgatttaaggaaatatcagagaaaccacctaaccttgtgttttgaagctggattctgctggtccatgacctcctgaccttttccctgctctgttctgcaatgcaggaagttgcaaaggagctgtctcccacaggtgtgtttgaggctcctgggtcaactggcttctgtctggattcagcaatggcagatactgacagtagactaaagagggagaagattaaacacacacatacacacgtatacacacacagatatgtatacacacatacacatatacacaaatatacatatacacacatccacacatttatacatacgcacacatgcacactacacacatatgtacatacatacacacatgcacacatacatatacacatgcacacatatatacatatacacatatacatacaaacatgcatacatttatacatatacacatatgcacatatatgcacataaacacatgcatacatatatacatatacacaatatacacatatacatatatacacaaacacacagttttacatatacacatatacacacatatacacaaacatacatatacacacatacattcacacatacacatgcacacaccacatatgcacacatgaacacacatatacacacataccacatatgcacacacatacacacacacacacacacacaattcagtcagcatctccagtggcaactgtgaaccttctgtagccccagctactgttggcttggccccctgtagtgccagcttctgctgaggagccccagaccctggactccagtaacactgtcctttgaccctccagccaggaggtggtaggagcttcctgctgtactgttctctgtgatatcccatggttgttagtaaattcctcagcccttccatcccctgtataaccagtttcttttatcaaattcctgattttaaatccatagatttgtttctgttttgttggttggatcctgacaggtccaggtcctgaccctgaatcctggccatagcaccaaagtcctgttagggtctgctttctgttttccaccttgatggggctgttggagttttgctttgaatactgggtggctgtgttcttccaaattgttggagcagacagcttcattagctaaggagtccttgctacaatcatgggcttctctagcctcaccagatgaatatccatctccatcctcaaatatctctctgctgctcacagtgagatgggaccccagggaggtggcactatcatagctctcagttcctgtgtccctattgccgagaaacgtcatctaccaccaagaaaggtcatctaccaccgagaaaggtcatctaccaccgagaaaggtcattcttctgatgctctttgcttgtttccacagtgctcacactcccaacacacctctgcccaactccagcctagaataataactccaacctcactcctaccacagattgtttggctttgatgctgtcaacatttgaatcttggcccttcctagcccatcatttttccatgatttaaaaattgatgctgaaaaacaaaaaaaatcagtggtcagaacatttaagaaaatactggattaaacaaattaaaagaggtctcttcaatacaggacttctcagagcctttaaaataagaggcaattgagacagcagtgttttcaaaactaatttgagcatggaacttttcttctctgtgtggggatcatctcatggggcttaggatccatgaaacattatttgatatgatgaatatttgttgtttctgtctgtccagattccatctttctcttacccccttcttctggtgacagtataactctcttgagtcagagaccttttccatctggtatgggtgggactgaccttcctgccatcatcttcaacaacagagttgtgatgtcatccagttgtgtccccagtgattgaggatgggaaggtatctaaattgggacaaccagagtccttagggagacttttctaacaaggatttcagggagaacttgttctttctttcactgggggtattgagttgctagaataatagtgggccaggggtctaatggctatcaggtatgaagaagctattggaatagaaaccaagccaagagccataacagaattgacagctagagagaaagcagaaccctggcaatatttcctgagcccctggacccagtcaagtcggaaactggttccattcctttgactccctagttacatgagctaataaatcctaccattccatttttattttactattattaataattttatttttgcttaaggtaggttgagttcacccttttgtctctcacaaataaaatatgcctggctaatagatggagaaaacacagcctcttctggctcaaagtacatgccatgctgccttgggtcagaatccccctgctggctttgaatccttagaatgcaatccccaaggccaagccctgtgcttggtattctgtcccaaccactcaaggtcccctgaagagaaaaggccatgtagaaatcagggcttgaacgggagaagacagatggagcaggacaggaacacagggtagcctccatccataattcatctttccaaagccaggtcgcagtctcaacatcctggatcttggttttgtgtgaacccatgagatggggccttcagggaatggacacccagcactgtgcctcttcttaaattatgccatgattctacatgtgccctaaatttccatcttctctgctgttacaccgttccaacaccaaagatcattgattccagccctggaatgatttacttggtgcaactagaaaacaacatatgttgacttgaatgatattcagattaataaatgagagactccaaggccttccagctgagaagcagttttcattcagaaattactcatgtggaatggcagaagtgccaagaatacaggtgtaaacaagtggcagaaatgagaagaacccgatgcgtgaagagaacaatgaaaatattacctcgtatgctgaacgcccctcaacattggaaaagagcttccacaaacaatcttggtgatgctcaaaccaccctctcaacaggtgaaggtgattagccccattcttcagaggagatcatccaggtggccaagaatacaaaatgacccaaagtgccccatatcaggtagccagagggggcagtcagggcttgaatgtgagatgcctgactcaggtccaggtctctttgcacatcagacagggatggttagctggtttccatctctgatcaacatggagctgactctatttcccatttttcagccatcccaacaactccaccccaaaatccaaagtttgcccctcaacactaaacaccactttgctggaatgtctatgttttccttcgaccattaggcttcccagttgtcacctggggaaactgtgactatagattccagctcaaaccataaagggttaagaactaaaaatagtgtgatagcaattaaagctcttctttttcctaatcatttatttcttgatttgttagctgaaagcctattatggcatcttaagacattaaagagtagtttttgtggggggaggaggatccattatactaaagacaatccttcaaatatggtggacataagtaaattttctctctctttgcaaacccaaccaactccattaggatgaactaacagtccctaataaggacagcggccatcagttaaacaattaacatatctttagtgtttttctccccaactcatccataaactccaggaaaaatgtgcctgtcttgttcattattctatatgctcagtaggagcagagcacggagcatgaagcaggtgcttagattagaaaataatacaataattgaatgaattaacaaaccgttgagatgagatagtcaagtcagcataaacatcttttttgtttgctgatcctagagaaacattagcttatgaactttatagacaataatagctttgtactcagtacactttactgtcattcagcaaagcagttattgatcacccactatgtgtcaggggtgtcttagactgagagccacttcatatgctttttggtaaatgcacagacactgaaacatataaacatacatacacaaatggaaacatgcacacacacatatccacagacatatacacatacaatacattcttaaagtcttggcttgattttctactagtcaagatatgcctgggtttaacctgtgcatgcctgtacccttctacacctgtaaggacttgatcttcacccacacttgctcctcagcctgaaggaccgagcttgcctacagatgggccatatttaagcctctgctgcacccatgccttggggctgactttgggtatttgtctgcactggcccataatctgatcttccacttgggcctccgctttgccctctgttccctcagccctcacctgtgctctggtttttctcagacactttggcctggatctctatctctgcctcagtctttccaggtcctcttgggccctggaccccagcacagaggctggatactgaaacagactcccctggtgcccccttctctgatctcttcggtgccctgcctgtgggacactttggattcccacagatcatgcttgctagaacttgagctgactctgtgaatggccagctttttcctaccagcttgaacccgctttggccaccagcgtgtggagtgccttttccaagaggtgggattagctgtgatccttctgcctgccccaccctattgtaagcaaatggacaaggtcctgaagggaggcaggactgtggcccatctacctgctttgaataaatgtccatgaggcttctttagttgtaaatgcttagaacagggtttctcagccacagcattattgacattttgggctggacaattctttgtggtgaattgtctcgtacattcttggatattttgcagcacccttagcctctgtgtactagatactagttgcaaccccaagctgggacaaccaaaaatgtctccagacattgccaagatccctttgggggtaaaattgtctccaattaagaaccactgcctggccaagtgcggtggctcacacctgtaatcccagcactttgggaggcaaaggcaggtggatcacgaggtcaggagattgagaccatcctggctaacatggtgaaaccccaactctactacaaatacaaaaaaatagtcggacatggtggcacgtgcctgtaatcccagctactcgggaggctgaggcagaggttgcagtgagccgagattgcgccgccactgcactccagctgggtgacagagcaagactccatctaaaaaaaaaaaaaaaaaaaaaaaaaaaaaggagagagaatgtgggatagcaaagcaaactgatgatgagtgtgacccaaagctcatgcacctttgcatgtggcagccaatctatcctttgtttgcttaaatattttgagttgagtttctgtcctttgcaaccaaaagagtactaatgaatatatctaggctacatagcacctagcactgtgctaaaacgtagtagtgacaatataaagtaaatattgttattaattatttagttgataactatttgtgtgcctcgcataacataatgctgattgtgaagtgatgagaacagccataacatactagaaggctcagattccagtctgacctcatcacctacatgtgatcttggctaagttactaatcctgtctgagcttgtttcccttatctgtaagaagatagaattggaacagatcagtcattgcaaattggtggtcagggaatggatccagaccttcttttggtgtttcatttagccctcacagtattttacaatacataaaatgtcatgagaaaattcagatgtccaacttctttaggaaaattgggaggtcagcaacattgggcccctattaccacatggcaatgacaaacaggttttagaaggggcatgtactctctgagccacccgagaccccacctccctcttccccttattttatgcttgcctgcctcactcagcccacaacctgctgactgcaaaagcatttgagtttgtgtttttgaggccatgttctttcacctctgatattttctgagatggcagaacacacccttcatgaacaggagaccaaaaggcaagagggtcaagggagacagattgagcccaagagggaaaacagccacccaggaaagcaatctgttattctaacctctgcagggccactggcaggtcctcaggcctgagacacagcagcagtcagggggtagagagacaaacaagccaagattgtctttctttgcttttcagccagacaaagaaaatccctctctgcgtaaagcctcctccgcaggctttgatgtctctcttcccagcagaggcgccacttcagacaagagaggcaggcaggggcagagagctgagaacaaagcggcgtttcctgggctgctaattattctccttctgtgtaaataattatctggaagagaaaaaaacagtccacagctaaagagctagaaaagcaaaaggaggatgaaaggaggctggggatttgatgtgtccccgggagcagtccttgaaggggaagggagtcacagcaaaatccttcttacttcctgtgttttaaacacctagtctgggactttcaaagcccctggcactggtgctgtaattaaatcgtggtttgggaagccagcgtgcgggtgatctgacagtttctgtctctggatcctgttggactctgctggaatagagacaggaagtcttagaaattaaggctctggagtcaattgggccccagtttgaacctgggtctactgcttattagaaacaggatcggggacaagttccttattataaataagatgggggacaagttccttcttcccacctagggcccgtgcaaaagcagtgtcttctacttggaagacttccccatctctccaaatctgtgtgcagttgatacttacacatctacagtgaacgctgctggtgccctgccacagccccttgcacttaccatttctgtgcatgcccacccaactatcaactgccagcagccctttccagcacccttggaatgtttctcctgggcacttgaaccctggctgctcttgcacaaagcacaccaggattaatgctctctggaagcatcccttaaccagtgaccgatgagaattaggagagaacaactctgaccctctcatcccttaagtgacgggagttggaggctgcagtatgctctacagagcctcccagattttccagatgggaactctagttccctagaatggttcctggctggataatgcaccttctattggttctttcctatccctgtctcatctcttctctcctctacaagtgcttccctggatcatctcctgaatcagctacttttattcaaatctttgtttcagggtcagattctggagaactcaaactaaggcagcagccttcaactctcagctcaaatgtcatttcctgggggaagaactccatcaacatcttggacccaatcaggagtttgagttaaatcggagtgatgccccctctatattttgctcacagcactcatgcatttgtaattttatttttatgcatctctttattttattaatatctgtctcctccagccaaatataaacttcaagaggagtgtgcccgttttatttattgcattgtcagatcctggtatagagcctaacacataagaagtgctcaataaaaacctggtgagcctgtttcctcttatgtaacatagagacccaaaacaatttctattgcatggggaaggatgtgtggattaaatagttcataatctatacaaagtgattaacttataaattgatacagtgtctggaacacagggagtattcaaaaagctaacattctctgcaaccttaactgtttcctcctgtcttacccaccaccggtatcacatacaaaatttaattgttcctaaaatactgtgagcttggaatgagtatccttgggtcacaaatgaagagaataagcctcagaaaagtgaagtaacttgtctagagtcacacagcattccaagggaatggccaagattccaaactggctcgttctgaccccaaattctccccacttcaggctcatctgagcctggattgaaggcagaagggggtggtgtcagggaggcccattagtagttgaatcagttttggagagaaacaaagggttgaaccatagaagactcaaatggtcagagaagcaggttggggagaggaggcaaacattcccagtgtcagagaagtttggtgagtcttcgtcatttttgccctaggggcacagggacatttgagtttctcccttgaggcatgggaaagacgggtaagtgggtattggagccgctgggcctggcagaggaaataagctgagtcacaggacttactccactcctatcacctcatctctgcctgacattggggccattcatcagcaggacattcaaagacaaacaggaagggcatttagaagaaagaatgagaatcaggacacctccaattacccagccatttacaaagattctttgcaaccaggggcttgtctacctggtgggcagaggaagaaaactttgcatttggctgtttggatactcccaagtaacacatccaggtaagcacgacatattatcgtcttatctgtgaactgagggagccggatcccaacgagctgttccggagtctctaatcagcaccagataaccagagctcctagctttgtgagggtcgggaggatttcctcccctcttacaagatcaaaagacagaagatattcaatattcagcccaatattgcattgctgtcaattttggatggcataggcgttgtgctgtggatgttccaagccccagttgcatggggctcttccagatatctctaataagcctctgtggtccccatccatcaacggcaataggagaaggtgacaggatagacctcaaggggaattgtgggctgagcagcaagagttattgatgaaggtgcagaattagcacaggccccagatgagcctggaggtgaagatgaagccagtttattttttctgtgttgggtaaggcaaaagcaggtttgtggggatagggttgctaaccttaaccttaatcctaaccccagttaaatttgaattttagatttaaaaagccaaaaaaataatttttagcacaagtatgctccgtgccatatttggtttggatattcgacccctccaaacctcatgttgaaatctgatccccagtgttggaggtgtttaggtcacaggggctgatctctcatgaacagattaacaacttctgggggagtggggtatgtaagtgtgagctgtcgctcgttatttcctgcaagagctggttgtttaaaagagcctaacacatcccccctctctttctttttcctcctctctcaccatgggattgctgttcaagcaggatcccctttatcttctgccatgagtggaagcagcttgaggcccttaccagaggcagatgccagtgccatgctttttgtacagcctgcagagccaggagccaaataaatctctttcctttataaattacccagccttaggtattgctttatggcaacacaaacagactaagacacttatactaaaatattattcattgcttgtctgaaattcaaatttatctggacatcttatttttatttgctaaatctggcaaccctagctggggcttggtggaaatttaacgtaggggctgaagacctgtggcctgcaggtgggaatgttttagtttgaccagcacagcgcttaaaaataagaacatttcacataaaattcagacttccaccttcccttgatatctagtcacacttccccctttttgctagcagttcattcccatctccacccctactggcccacatggccagtaaataaagagatgcataaaaataaatgctcatttattgttacctgctaggcctatgaatcatttgagttttagacccattggcttgcctcggggtacacagggagagaccctggtttactcacggcaatgacaaaccctccagatcaagagtcattgtgtggagaccccgtttcatcatgttgtagctctagtctccctctaggtggttctttactttcccatctgtaaaaatggagatagattttgccctccctcattctggaatggatgaagaggaatgcagataagagcataaaagttctctgataaagtgatcttgataatggctttctccagatgtccattcatgaggcttccaccctgtagtcagcataatctatccaaaatatgcatctttccatgcttgcttgcaaaataaaatccaaactccctcaagtggcatgcaagtttcagtggtttggcttaccccatctcatctccaaaactgtctaccccaactgcttccaggcagcacctcagatgctgaatttctcagttgctcaaactcattctgcaccctcacactcctgggcctttgggtatgatactctctgcacatagaatatgctccctgcccatcttagtgattgcaatttcagtgccatcccttcccattttacattttgttaggatatagctgtccctgatacatatcccacaatactcttcttctccagcaaagacatttctcctgcaggttccagctagggtctaaatgtcaaaaaacaactttagctcatttgaatcagaacaaggagttattggaagaaaccaccaggcttctgaaagggcatggaccagtcaagctttagggaccataaaagcaggagttggcaaatggtctctctacgacattgccatgggtgacacagtctcaactactttctgtcccttggtggccaatagaatgtcattggccaggcttggcttatatgcaagtgtccatggtcatctgcgattgacagtcttagcagagaatttcttgggtggatggtggtgcagttctccaaagagaaggaggggatactgttatcccagaaacagggaaagggcacaggtagaaaaaaccaacaggtttcctgtcctgcacagtcttatattgtcactgctttggtttttttctttgttcttccaaagattgcccatttcttgagttcagaactttctgttctctacatctagccttgtggtcccagaaactgaatagaagcttcaaaaagatttgtagaatgagcaaaagtgttccgaaagggagtctttgcagaaaagaattaaaacagcaaggctgaggatgtaatcttttaaaggcctgtttgcaagttgctccttagctggcatctgggaacttggcttttaaaatgtctcctccattccctaactgataaggttgattctttgtgccttgactgtttatagaaacaatgtaatttatggtgaacacctgctttctttctgagagtctggaattttggttgttgctagacagaaaaatcgatatgagcagcccctaaaaaccactctaaactctaaatctcaaactggctacactgggcattataaatattacaaatgaattcctgcattattgctactggaaacagtgttctgtgtgatcttccataggaggaacagaacataggaagcctgcacatggcttccagacccttatctgtgtcttttcctttactgggttgattgtgaatccttatagtgttgccttagccatgagtacaactgcatgctaagtcctgtgagtgcttctagtaaatcagtggatggtcttgagaaccacaccccccgccaacccaagcaggaccaaatctttaaagcacagtctacgatttccaaggcactttacaatattattgcattgatcttcttaaccaccccccctccattgagagacatcctgttctcattttagggattagaacactaaggctcagagaggtgaagtggtttagtcaaggatgcaaagctggtaaatggaaggatgggttatgaacctaggctgtcccatttcaatgtcacactatggtagcttccattatagagaggagagactgtccctgtcatgataaccctttagtgtccaagacaacttcgctctgtgagcttagaaatctggagtgttcttttaggaacagtcagtggaatgagtcagtgacttcttttttgtcagtagcagagctgatattggcacctatgcccattatttgactctggggcccctaagttcaaaaacattacactattttgaccatgtgacctctgatatcttactcattttctccaagcattcatcacttcatttgtaaaaaggaattaagaactatctaattgattatgaaaagaacacaaccctcccctatgaagcacctagtagtgagccaccaaatgttggttcccttctctttcactccaccccttattcactgtgtgggcctgtgtgagtcctaccattacctccatctgtttccccatctgtaaaatgagggggatgattttgacgctcccagagtccttctggggctggcatcgtatatcaaagaacaagcgtttttctggtgaagtcttttaaaatcctgccagctctgatcatgagaggcagatcaaacccaccttctgcccacttaagaaaaaggctgtgtgtaagttgcacaaaggtggtgaggcaaaaacatgctccagcctttcccagacactgatccagagaaagacatgtcagagtgttgaaaagttctttgtttaactaaggcacaggcagagggaaaaggaacagtagagaatttatagatggggctgtatcttctatatccagggttatcaatctaaatcattatagagttcagtggataatttttatagagctttgcggagaacagtacaaagaccaggtcaatagggagtggtggggactgtggaaaactacaggacctatgctagccttggagagagcatcccagctccaactgattgctgccaagtgggaatgcaagcatggtgttgccagactatctctttctctcttcatgtttaagaagtcagagttttgaagtacgctatctcaatttgtaagtgttgccttgagttttcttctcaaagatctttgtgggtccaatataactctttgcatttccaatcttgcctataggctatttgtttgcaatctcagagctaccagggcttatttgcagcatctttgtcattgaatcctgaagaatttgtgaccagaggttaccttcacatcctccaagatggccagcttcagacatgggagaatgattttctggaagagccagcatcatttaactttaagctattcttaaagtttactgctgtaaagcttacctctttagcaactcctccttgccccaggacaaagttctgacttattatttcctggcgtggattttacctttgattacccctatatctttgttcaggtgcatctctcatcaatataaaatcttatgggaaacctcctagttggccttcaaaatgcagctctcatgtttattcctctgtgaaacttttactaatcatcaccctcctctcctgaggtttagcttcctgcctcacctctgtgtatcaaccacaccactctctatgttcatatcatgcattagtcagggtcccaattgagaacaaatgccacactcaaactagacaccataaggagactttaattaagagactgtttacaatggagtgtgcattacaatgggcagggttaaaggaaactgacaaagcatagtacagcacctgggaccagcaatactggagagctgttactacctctagtcctgaagctgcaaagggaggaagagcaattataacattcacagaggctagaagtatagacaagattccctggcaggagccttgaaaaagggacacacccacactgtagtgacctgtcaaggagggagccaagagaataaaatctcaacctcacttctctctgactctccagtatcttgctgctgcctttcattggctggaaacaacaggcagcaaaaagacaaggaagtctgctgacatggtccatatggatcagggtctggaggccagagcagggtggaaaagggtaaaaaggcaaacaaaagaagcccaatatccaccattctctgcataggtctctgttatggcacttgctgtttagtgccaggtcccctagaggctgggaaatgctggtgaacagagaattagtttgtttatatctgcaccctcaaaatctggcatatagtatgtgatcgataaatggttataagaattaccaggtacatcatacagcacctggtaaaatagaaagattagggattctttttagattatccacaggcatgaagcaatcatgaacttcttcctttcatgcaatattttatcagcaccactgtgtgaggtattattcctgccatccaggagctctttatctcaaactagaaactcctagagcaaggaaagcagttatgcatcctctatttcacatttccccagtgtggatactgtaggtcactggtttgatgtgatgctcagagatgtcacatcagagtccattgtcaagtgtaaagtctgtagattaagcaaatgtcttctctacagaacttgtcagagcctttaatgtgccaaagcatcatacgaagcacctaaagggggccacagtaagcagcctttcctaaatttattttgtcataaaattatttccccccgagcatcttgtaaatcagtaagttggaatatgctttggaaaatactgcccttctttaaccagttcattttacagatgagaaaactaaagctccaaagtagttatcaccaatcaatctggcagggagcacaatttgcatacagaaccaaatgtcgaagttgctttcattgagtagccactcattgcctttgattctttctccaaactattatcaattctttctcaatggatacctctcccaaaccttgactaggaatgaacaggaagtagccaatggctcttttcctgctaaaccctcatgggcccctgtgtgacaggtgtgacccattgtgagatgttgtcaccatgatgacacagaagcttgttgggtcatatatggagagaagatgacactgagtgtgggtgggatgatggtagttgagtactgctctcctctgtggtgacaattcacttcgtctcctgaaaaagtcccatgccatcagcactgggcagggaaattccactctcaacagggtagccagaatgattgtttgaaacaagaagtctgatgatagctctccaatgctgaaaactctagcaactccttgttgccccaggacaaagttctggtttattatttcctagtataaattttacctttgatttttctttgagatggggtctccctctgttgcccaggctggagcgcagtggcacaatctcggctccctgcagccttgacctccccaggctcaagtgatcctcccacctcagcttcctgagtaactggaactacaggcatgcgccaccatgcccagctaattttttgtattctttgtagagacagcattgcaccatattgcccagactggtctcaaactcctgggctcaaacagtccatccactttggcttcccaaagtgctaggattgcaggcatgagcataaattttacctttctctttggcctcatctggtgccaccaactgcttctttgaccctctccacccaccctacacactaccttctaggcaatatacacagcatccagctcctcagactcaccaccctgtagatcatgtgcagacctttgcatgaactgttctctccagctagcgctccctcttgccattctatttgtctgaccagcctccatactaagaggcagtgtggtggctgattagtccatgggctctgaagcctaagagtctaagttcaaactccaactttgccacttcttagctgtgcagccttgggcaaatgacttaacctgtgtgggcctcagtttcctcatctctaagatgaggataatgataatactacctgcctcaaaaaatgttttaaaaagttaaatgagataattctttacccatcatatagtaagtgctcacaaaaatgataattttaattctatttctttatggtttagtttagatacccagcctctgggaaagcttctctgactcctcttaaaatatacatacatgcacatgcaagcacatacatgaacacatatgcacacacacctgcacttacacatacatgcattcacacatgcacacacacacacacacacagccctccccacatctcccccaaggcatctgtgcttcctccaaccctgctgccaatattattctaacttacttttctatatctctgcttccttagacatcagctctaggcacgtaggaactacattgcatctccagcacccagatcagtactggactcacagtaggggcatttgacccatcctggacaattcttcttacttacttttgtgttaggacagaaaaagccagtgtcagagtagacaactgagtcccagcctcaggaaaaggaaaggatgtgcgcaaagtcacatagctggttcacggcaaagccgcaattgagccaaaactctcaagtgtcgtttggtatatcctcagttcctgctgaggctatacaaagagaccccagtttccagtactgctgatgcctcgagatttgcatgctctgtctaatttgtgaaggaggtaaagaagagcctacttcgcttttttttttttctcaattccctaagcaggcatcctatttctcgaaagaaaatggattctagttacttttcagtatagcaccaatggtcttcttgttgaattacagccactgatgacttcctttaaagagcgagtacccagttcaggaaaatgtattactcaggtaaaatgactccctggggtgatgagggtgtgattcaggagagccctcccacttagatgtcctcaaatgaaatgcggagtgcatgtctctgtttcagctttgaactgtgtctttcaggcatcctgggtttgaactgggtcgccaacatcctccctgggagcagctgcaggggtttctgaaaggatgacctctttttagcacagagattattcaaggtgcttagaaacagtgggatgagttcagaaatcagttcttgctacttctttacctagggaaaccaaggctgggagatggaaagcaattggtatggggttgctaagcagaacaacaacagagccaactgtcatctgcccacctttccacagcacctggagactgtcatggctatttctgtatatccactggtagacaaagcagttagattgcaatagatttgggataatcacacaaaaaatgacagagcgctcacttagtggttaagctccttcatgacacccttcatggctcacaacacaaaaattagaatacagaagataaatatgttagctaaggtttcttgaccactgactagataccaagagctctcctaaatgttttatattcatgtcctcatttactactcccaatggcccattgaggtggccagcacccttttacagatggggaaactggggatggcagaggttacaagatttgcccaaggtcacattgctgagatgtgacagagtcaagacataaccctgcttttctaatgcagagcttgtgctctacactatttggttatcctgtcccttgttccacaaatatttagcgaggaccagtctgtacaagaagctgttttgggtgctaaaaagtcaaggatgaatgagatacagaccccaccttcaagaagcacattgtcatttgggaaagaaatacatataaacagataattgctaagttatctgtgatcagagctaaacaagggaactatacacttttgggtttactttttcaaagtgcttatatcattcaatctatgattacatgtggacacacacatacgtacacacacacacacacacacacacacactccaccaaagaaaccaaggtaggtattatctgcatttgacagatacagatgctgaagcccagaaaagatagagaactggctcaggtaacagacaaaattggtatcatgcccaagtctccagcttctagcttgggttctttctccaccagaccaccaggagcatccaaacagcctcctggtggccagaaccagtccaaatgctgaacattaataagagatgctacagagagagactgctccatttatattgttcatctgtgaatcctccttagtttcactgagaaggacatcaaagaagagaattctggattcagtagaggttgagttaagtcattggaagaccttgttggggtcctttgatcttagtctaagacatttagaacaagggcttgtttgggcttatttgaagggattcactcttcttggtcttcatgttttggccctgaaatccatcagatggaatttttggatttgtaatcttaatggtctaacccatgagtttgccaacatgttttgtaattttcaccctttccttcatatcttcctcccagccccatcctccctcaagcatatgcctgtttcctgaataatgaaggataccttatactctgcagctttaatcttaccgctatttcttgagaaaatgagttttggcctttattaactgctcagtaactgggcacatatttcccactgtgatcagaacaaaaaactagccttgaagataaacaagaagagtgtagactggggggatgtcttgcggaattataaagtgagtaaggaggcattcagactccccctgaagatgctatttaatttgtggtaaggctgatagtggttatgctagaatgaacattaggggaatgttgctctgtgacttaagtgcttaactctttaagaatgcccatcactgtccaaggtactgaccgagatattgcagagttcaaattgttgataatttccaaggcctttcacattccaggtagggcatagaacaatgtcctggcctgagagtgggtgtaagtgttcatggctgaaaacgcagaagaagatatgaattgagattgcaagcctgttattgattccggtgacattgggcaactctctcaacctctcaaaactctgttctgtctatgaaggaaaatgtgctacccactccacagggatagtcaaaagatgcaatatcattaaatatatttcaaagcctggttttgtgccctaaaaatgtgatgatgatgatgatgatgatgatgattatgacgacgatgatgacagcataaaactttcaataatattgagggttgtgtgcctgccaaagttctaatggcttcacaagtatgaattcacttagttgtcataaaatttctttatattatttggagatattattatgctcattttatagataaggtacccacaacacagagagattaaatcattttcccagactcacccagttaatggagtacatcccaaacacattgtgtatagttattatcgtgaaaaaaataaaagatcataaacacatattttgaattcccgcctggagcctcagcactgcccagaatgggatcctagactttcattctctccaaaggggagctccatgactatttcccaagactaatctccatgtcagacatgagattgttctgaaacagttgccctatcctgtcaccttcacaacttgaaaccctcaatgacaatcatcctcataagaccatgttcaaacaccttagcctggcatccaggactactcaacataggacttttctctttagatgcttccttctctcctcagttgacattcaaggcaccccaaatttctccccactctctgaacatgccatgactttcctactgcacggtcttgatgttgtttcctcatcaggaatgccctcccttgcctaacagtataactcctattcagcctcaggaagtcttctttgattttttgcttcctcccttgtgcttctagatcctaacactttaactattgttaggaatgtctgtcctttttccctcagaatttcccactcagagaaattctaaggccaggcataccttatttatctctctatccagaaaacttaactcagggattgtcatttacatgtatgtatgtttacaaacatatgtacatttgtttatatgaaaggatgaatgtggctcttcccagaaggaaaagaagggaggtgttagagacttttctttatgaaaaagattaaaaatagcaccatagtttcagatttaaaaggctgtgcttagcagttgatatctcagcacagaacaacagaaagctctagagcttgaaagctggtagtttcaagttgaacgtctttctctgcatatgccagctgtgacctgggaaagcctcttcccatctctcagcctcagtttcctggtccgtaaaaccaagacgatcatattctacttggtgggatctctgcagagagcaaatgggaaattggaatcaactcatgtttctaacaatagaagaatagatataatggaatattatgcagctgtaaaaaatgaacaaactacaggcacacacatcagaggagaatgggtataatggaacattatgcagctgtaaaaagtgaataaactacagctacacacattaatggggatgaatctcagaaacttaatattcattcaaagagataaatcccataaaaatccaaaatatataagtccatgtatataaagttcaagaacaatcaaaactaatgctatattgagagacaggagagcatagccattatggactctggggccaaaagtgggttcatgactgagtattccctttttctagctcagtgaccctaatgagttacctaacctctctgtacctcagtttcttcatttaaagaatgtcgaagatagcagtggttcctacctcaaagagttgttgtgaggattaaatgaattaatatatgtaaaatacttaaaagagtacctggcacagaacaaacactatgtaaatgttagcccttattattatttttgactagttgttgttattacctttgtgattactatcatgatttaggaacatatacaagatggttaaactgtatgaaaaacaagggaatgattaaaacaaaattcagggtagtgatatgttttagaagcttctaaattattaataatgttctgtttcatgagccaaatagtgggtgcacagatatttatgttactattattccttaactgtatatatagattttcactacttttttaggtatgatatatttcccagtaaaatttcctaaagattaaatgaaattaattattgaaaaggaccaacatcattctttccccccctcctggctagaatctccccttttctgcaggcctttggatgatgtattttccttcacaaaaagagcctcaaccttctggaggggaactgatctgttcagcaggctcccccattcatcatcccccaagaagcgtgttttacattcatctgcagatgaagataaaagggtggtgtgttgccctctttaagattgctagcaggataagcgtgaagaggaaggctttcatattttaccctaggctttccagcagttgccttccccagaattgaagaagcttggcttgcttctcaagtgcttgttgagaagcaaaatgcccagggaagaatagaagattctgaactccagaactgcagcatctctaggctagattttatcaccgatgacatcgcattttactggagcagcttgatgttctagagatttgcccagcatgcttggtggctgttatttcactatggcttttgagctcaaaggctttagaaaaataataatggtaagaatttattaagcattttctatgtaccagactctgggccaagcattttttatgcatggttttctgtaattctcaaacagccttataaagcactcacagttatctccattttattgctatacaaacaaaaggacagacaggtgaagatatttacccaaggtcacacaatgagtgggagacagagccaggatttgaataaaaattcttctttacactcataatttcatttgaatcatccagcattctggcagaggggaactattcccatccatatttaacaaatgagtaaactgagtccccatgagatgaagtcactggctaaggagacacagctaggaggtgctaggactccatgtgagtcccatctgaaaggctggaacactcctcaccttgccttccttttccattagcaagaaagaatttcctatgaacacacactcaaatcacactacactcaaaacagtgcatgaggaaagatcattaccttgcatgtagagtttgggcagaattgccttgaaagtcccagaccagaagaagaatggcatcagcaccagagtgggcagagaagacattagaggatgtgaagtggggtctgcaaaggccatgagcaggcacaggacactggtccagaagtgagaaaatacacaagaatttctggggaaaaaaatcatttggcagggacatggctaagaggtagaggtaatagagtagaagaagtaagcacaggtcatgaggggctatttgcaaaatgtccttgagtagatatgattccttagtatccaaatgctgggtactgtaaggctgtagtgggtcccatttgccctccactcccatcttcccatccatccatccatccatctgtttattcatctatccactcagaatgtgagctccttatgaacagaaaccttactcattgtggttgccactgtatccctagtaactggaagagagcccagcacaagataggcattgaagaactaattgtcagatgaataaattaactcttctattgagcaaatatgtgctaagtacccaccagccatctcaagaggagagcatggtgcatctttttggggcttgtattccagtgggaagagacagatgacaaagataatagattgataaatatacatcatgtcatataattgacacaaaagtgggactttgtgtagttttctctaaaagaaaatcctgagtggaaggttcaaggggaggtcatttatttaggaggttatccaagaaagcatcattagggagtgggaaattgagacaagaaagagaagaaagccagtcaaggacatgatattgagtgggttttcctgtgggcagctgaaattcaattctgctggagacccttgcagagacttcaaaaaacatactttatattttcccaccaactgggcatgggagctggaataatttccacgagctcttgcctctcctggcaggatatatatgtatgtaggggcatgggtatattttacatgatgtgttcagaaaaaagtctctctgataaggtaagacttaagaagagataacagaaagtgagagtaagctgtgcaaatattcaggggaagcacattctaggaggtgggaagtgcaagcacaaaggccccggggcaggactgtggctggtatgttcaaagaattgtaaagagaccaggtgctggttgaaatgagcaaggaagatagagatagtggaggatagatcatgcagggtctttgcagctcatggtaagaattacagctctgtctccaagtcagatgggaaattattggagaaattcgagtggagaagtgacataaaatgtttcatttttgaatgatcctgttggctgctatgtggagaacgaatgctagggacagagatggaggcaggaagaaccaaggggaagccactacaataatccagatttgacatgatggcagtttagaccagaataataacaatgaaagttttagcaagtcatcagagtctggctgatttgagaagtctggatttcctgatggagtatatgtacagagtgagaaaaaggaagcagcgaaatgaactccaagtagctggaaggatagggttgtcattcatgagacatgggaggtgcaggtgtgcagggggctggacaccttaggctggatgcctagtagacatctccaggtggaagatgatgagcaggactatataggttggagctcgagggagagactgaggctggagatatacatattttatatgggagtttttggggtagagcttgtagttagtgctaggagactggatgagacccagtctgcatgaatgagtgtacacagggaagagtccagagtcctgagattctgtgtagagtgtgtagaattcagccaatgagggggagccagggaaggagatgggaagggaacagccacatagggaggagggaagccagtagcatgcttatgctaagtggcttcacttgaagccaagtgaagaaaacatttctagatgaagcaaacaatcagttgtaacaaatactgttgatttaggtaagatgagcctaagaatggcccactggatgtggaaaaatgaagattatcagtgatcccgacagcacaggtctcagggcaccctgactggagtgaatgcaagggagaatggaaaaggaagaattggagaactctggatgactcttgagtaactttttttctgaaggcaacagatggtggctggagtgggatgtgggtcaaagttctttgttgtttttacttgttttgctttaagaagggaacgttatggtaagtttatttgctgatgggaataatccagtaaaaagagaaacacttatgatttgggagagaaagggattgatcactggagtgatgtggcttgatggggtgtgggaagaggaacccagaactcccatggatgagctgtcagcatcgacaggcattcatgggacagggagaggacaggtacatgagctcatctggggaaggttggcagggtgagtgtggcagaagtgtggcatggggcaaataaccccttcctgttttcttaggggaaaggaagcagggacattaaccaagactgaggaggaagagttggagagttgaagggagggtcgtgaaagttgtcttgcagctgggatcatggacttgcaataggttctgagcatacatttaaagtgataccagctgacctgggtgttttttgtcttccagccatttgtatctgtagagacacaggtgtggaaaagatcagcacttggattcaatctgggttgaagttttgccaggtgagtgtaaaggaggaagaagaacaagaatattaagattgaaagcaaagaagtgaatacgataatgggcatctacctgcctttccccacctttctttctttgtctctacagctcactttctacacacacacacacacacacacacacacaccctagaggggacatggagagaggtatttgtaacttttagaaatatgacagagctatcagctatgtgacagctccataattgtgaagtaggctgcatacattttgatccgaacgtgactgttgcaattgttctgcatcggtgtatcatatttttttcccatcaagccaaagaacaaaaacaaagaaaaactgtgtctgagaaggaggaagtcaggagcgacaactacaaaactagaagtgtgtggctgagatgcttctcttcattcccccagctccatgtgcctttaaaacaaagtaccaggttctcaagggatcatgaatgattcttttttcctctcatccaaatgcccgtgagttcctccccttacccttcagaggcataaatctcagtggggccaatttgggacaagccaattctcatcagtgtttaattcaggtacaagaaaattgctggactgcaggcagagggcaggaagctaaattcaactgggaggtggacaatggccattgatactagtgggaatgttaaatcttattgggaaagtctcttaattatgtgattcagctcttagataaaggattatttttaagcacaaatagctttttctgtaatagctgttccttttctcaggcagagagccagaggacaagagatgtcccagtgacccatctgactcgaaactctgtgtgttcagcaaggcatagcacaactgcccaaagcaagggaccaggggtgggggtgaagggttgggtgtggggagagagttgctgctctggagcccaacctctatctgttgtaaatggctgaacagacacttgcagaaggagagattttgagggtcacttggaaaacctgtatggattgtttaataatgtctgccataagaacagaggtggagagcagtggtacacataccaagtatcagccatttgtaatccatagaaatctactgtaggaattgattagcaatgtctgccatgagcatagaagtggagagtggcagtacatatgctgtatatctgccatttgtgaaccaaggatgtttttgtggaaagcatatcagtccagctagatggcagtgtggctctaagtcaatagggtagagtttcagtagacccctgccaaaagataaatccaaatcctactttgcccgtgtattatacagtgactttaaccaaatgactacatctcttggagcttctttttttctttctttttttttttttttttttacatctgtacaatagagggaacaatcactatgtcattggttgttgtgagaataaaacaactattaaagcccttggtgtcttgtgaattttgatatgggcttaagatattgtgattgcggttataattatttctattattaattgctgataaaatgtcaactatgtgccaagtattttgtttggcgcttttatgtatattaacttatttgtttctcataatagctctgcaagttaggtactaatcacagtctccattttatagaaggggaaagtgagtttcacagagggtaggtgacacatgcattgacacacagacagcaaaaacggatcctggatataaatcaggatggagagattccaaagccattgtttaaatctctacctgttgctctcttagcagtaccagcctaagagcccagttttctgggtctgatcccccgttcttttgaagacctactgtgtgtcttgaggcaagtcgcacttccacatgcaactcagtctttacatcttggaaagagacagttggaatagacccatggtttctacactttgtttgttagagttccaagagtctgaagagtttccctgggatggaggaagatttgtataccctcctccactcaaacctgggcatctctcatttgctctattttctatatcagaattccaggtatgatttaatttggaaagggatcctgctgctacaaaaagtttggaaaccatctccttagatgatggtagttgtcacttattcatcatctattatatgccaagcctttcacatatgctgtttacaacctgcagtaacaaaacaaggtaaaacattattattcacataatttttcaggaaaggaaactgagattcagagcagttcaatccctggctaaggtcaccttggtagttgtgccaaaccagggagtccaattcagatctctcttgatttggaagcccataattaaaccttcaggctgctgaatcacatctcttattgaaggcagtacacaattagtattatttcattatcaggaggagaggcattcccagacattaatagtccaagtaatggcagtgaggtcagctgagatgtgtttggattcctcagccgtagatctctacagccgccaagggcggtaacctattttcacaagcagtgttcttcttctttgagaactatccaaacataatgagcattagttgcaatgcagaactgagaaggggatttcgccagccgagaccgcatgcccagaaaacttttttagtcttttgggagcatcgctggcaaacataatttgaaaatctttctcttcaacatgctgcctcctgtcaaagaataggattctcatgcatatttcatcctgttactttttaattaaaagctatcatatatttatttttcagctgctttagagggagggaatgtaagccttcgttctataaacatttgttatgcccctttgaggtgccacccttttagtggacgctgggacaggccaagatgagtgcaccacaatccctcccctcaagggcattgcgatctggttgtcgggggagggaatagatatgaaaattaagtataataaaggatgtcaaatgctgtgattgaagtgtattcattgggggcatttctaactggtgccctctgagtcaaattcagccctttagcatattttgaagtcatcataaatatcaaacttgtggccaagaatcatcaggaagcatctataagaatctataatagaggtccacccacacacacacacacacacacacacacacacacacacacacacacaatcagaagatctggaaatcccgggactgtattcccacagggccaccattacctggagttgaatagtggcaactccccactagaagagctcaattcttcatttggcttcagtcaccaccactccctattgctgcaccaggtctactgggcttatttatgctgcctccctggcctctggatggttttaacttacaacctttgataggagcataagatgaaaatacaaaggagtcagtggttacttctacgtgggcgagagccgagaatggcttcagagaggttaccatagaacacgtcgctgctgtggaaccactggccccgacttgctgtttctcagattttgccctgggctacacagcctgggctctaactccagctcttgtctttaggtgaattgcttcttctctctagaccccaatttcctcatgttttataaatgttgatttctggtagaggtaggcattcaaaaaaatttgttcagggaaggaagaaaggaagaaaaagagggatggaggaaggagttgtatcatcctctcagactttccgtgagaatcaaacagggcattatgaacatgcttgcaaactttgaagtaatattcacatgtaaggtgtttttattctttatttttatttttttgagacaggacctcactctgttgcccaggtgggagtgcagcggtacaatcatggctcactgcagcctcaacttccctggctcaagtgatcctcccacctcagcctgttaagtagctgggactacaggcacccaccatcatgcccagctactttttgtattttttgtagagacagggtttttccacgttgcccaggctggtctcaaactcctgggctcaagtgatccacctcctttggcctcccaaagtgctggttttacaggcatgacccaccgtacccagccagtgtgtttttagtgtcataattacatttccgcagttttcagaaagcattgtgtggaatcacggaacagtgagattctactttaaaagcatggattatcaaagacattttggaaatagagttcaactcaattattattattatttttactgcaatatttgttggagcctttattataccttaaaatgcagtatgcattctcaacagagaaagatttcccgtgggtttctcatgcctggttagctggggaactcatttttcacagagtgaaggacagaggttttgtggaacatactttgagaaatgctgagctgatttaatgcatgtggacatgggtccctaggggaagtgacatgctcattatcacataaagagagagaaacaaacactatagacattgatgctgaattttagtccactgctctttgttgatagtgtctttttccagtgattctttcctgatgactaccattctctgttgataatgtctttttccagtgattcttccctattgacgatcattcttctcaccctttaggctgattttgggcctcctgttgaccccatagctccccactcctctgtacttcctccaggccagcatttaacagatggattgtagtccactaggtgataattaccgtgaggtcagattgcccctgtcttattatgtctgtcttgtacattactaaatcctcataacctagcacgtagtctaatctaatatatgtgtatactcttaggagtatagtgcctgatacatatattttctctgtgtctctgatacattttagattcatttatattacttaatatatagctattagattgtctagatagatagtatatatacctagatggttagaacctaatgtatatctaatatatacttagaagatagatacatggatggaaccttatatgtaatatatactcagatagatagaatataatatatatctaatacatactcatgtagactgatagagaacagatagatggatggaatctagtatgtactcagatagatagataaaggatagatagacagatagaacctaatatatatctaatatatactcagatagagatagatggatagaacttaatttatatctaatatatactcagatatatagaagatagatggatagaacctaatatatatctaatatttactcagacagaggatagataaatggatagaacttaacatatatatattatattcatatagctggaagatagatagatggatagaacctaatatatctaacatatcctcagatagatagaaaagaatgaaaggaaataataaagaacaaatttctcttcatggttgtgtttccacataaaatttgaagatgtaagatctttcgtgaagcagccaaataattcaagaggtgagggaaaaacaaaatttttatgccaattatctgacaaacagcttgtctggatgtttgtccgacttcccttctgggtctgctgcttcagtgtgctccagcagacacagcctcgctctgttccaagcaaattaccctccgagttgatcacactcttgcaagcatgatggaattttctgttgcttcacaaagtgtttccacaaagtttgcctttgatttgccttcccaaggcttcgcagcctcccagcttctcccagagttgttcctttgataaaagtgttcagtctttctggtttccgttttgctctgcacattgaaaggctatggggaggcagattttgctggaaaatgagaggcatatttcagcccatgggacctgaatttcatggtagctgcaggctcctggttctgaagttggcaactgagtgtctgcagagaaacccacgacctcaggcaggaaaagacagcagtggatatgtcctcgccatattccagacctagaaactaagaatcagacagggaaggggcctctcccagtcttctgagattacatttctctgaggcaagagggattttgtattttttcaacatttccccttagatttttgtgtatgtgtgtgtatgatggtgtttgtttacttgattgttctttgttttgtttgtttgtagccacaatttcctcagctctgccttgaaagagacagtatagtatagcagttaaaagcatggcctctgaagtcagattgctggagtctaaatcctggttccactaactcttctgctgcgtgaccttgggcaagtaaagcaacctctgtgattcagttgcctcatctgtaaaatggaggtaatcatagattgttgtgtggattaaatgggtcaatttgtgtaaagtgcttagaacctagtaaggactatagatgtccttgctacttttattactcataaatgtcattatttttctaatacatcctgttttaagactcacttacattgcatgttcaacatgtttgcatgaaaagcttctttatattttagaatagagtttatatatagttctttatcagcatcatggttacgtgcattcattcaacctaacacatattcacaggcttactaagggcaagaactaccctaagcagagggtacccagcagtgaacaaaacagacaaaacttctattctattggcccttacattctaagtcttacatataagcaaactagtattaccctcattagaaagcttattcatttaaaaatacttgtagggagcttattgtattctagggagtgttctgagaattttacaaatagtaactcattcagtcctcatgacaataatctcaatatcatttctattcagcagagaaggaaactgggtcgcagagaagataaacaaattgccaaaggtcatacaattattaaatggtgaagataccctatgtaaccttcttcccgatttgcccagtcatgaccataggtctcagccttcagtttgatttaattagagctgatgaattggctaaattgtcattaacccggcctcagtgtcagcacgtttactgagcatgttagcttggtaccgatcttaagccatgaagtggtttgtctacctctcacatattaacttggtgaaagtaggaaaatatctctgcaaaaaatgtctctgattcctgagacaggccctaattagagaacaagggagtggggttcaaaaccccttggtcatccttcaggaaacagcccacggggcatttgaggacaaagtgtgcttgtatcccgctgctaatgagacctcggcggttccaaggccaatcctcactctggtccatcagtgaagaaatcctgaccccaacagagggagggcacaatgcaaggtttctcaagagtcagttgcagggctaacagctgaaatcatctcctgactctctctccaacgcttcttccatggagggagggagtaggcatgtggaagaaggaatggaaggcaatgagggaaccgttcctcatttcatgaattcttgtttgctcaccacatccccttcccttccctgtgagatctctctgagcattgttttttaattcactcaatcatttatttttacttttatttatttttttgagacggagtcttgctctgtcacccaggctggagtgcagtggtgcaatatcggcttgctgcaacctccgactcccagattcaagccattctcctgccttagcctccggagtagctggaattcagtcatgtgccaccctgcccaggtaatatttgtatttttagtagagacggggtttcaccatgttggccaggctggccttgaactcctgacctcaagcaatctgcccgcctcagccttccaaagtgctgggattacaggcgtgatccactgtgactggcctcattcactcaatcatttattcattcaacaaatatcggttgagttcctgtcctgatgggtgagattgatcaccataaagcaaaatgagggaagcatcagaggctttggcagcctggaagaggtacctgatccaggctgggaggctcaggaaggctttcccaggtagtgatgtatttaaggagggatcttagaggatgaagggcaatcagccagttgatgcgagaggaagccagcacagagggatccacccgtcaaaggcatggagatggcagggtgacagggcactcgcaaagaaccaagaggaaccagtccgcctggagcagagggctggggagaggcaaggccttgagttgagcaggcctcaggggccacagcctacaggcagagcactgatgtgggagctggggacccagtggcaattcctgttctgcctctcaatccttttggacaagactgtaccctttaagacctcagtctacacatctgtcagtgggtgcactggacccatttgtaatctgtaagttcccttcccactctgacatcctagactgaatttcttattctggcttcagaggcttcagcagcctcctcccttgtcatgcctggatagcagaacagcctttcatagagcctggcctctggagtcaggcaggcctggattcaaatcccagctctgccactatctaacttaaactctccaaagctcattttctttatctgtagaatatgaatactaacatacctatgcacagaatgatagtacgaggtaactgtactcatgcaggtcaagaatttagcagggagctggcttctggtcttcacaaatggcagctcttgtactgtctcctacatggtcttggcccatctgctaccagaaacaagatctcagtctctggagagagaacaagctctcacagggcctcagtcttgagaccaagtggctgcagccaagtgagggaatgggaactaacacttaagtccctaccatgtttccgaatgtaatgtttactcttcatgatattgtgtccagagttgattccttccagtcggtttttggtctctctgatttcaagaatgaagccacagaccttcacggggagtgttacagctcttaaaggtggcacagacccaaagagtgaccagccgcaagatttattgtgaagagcaaaagaacaaagcttccccagagtggaaggggaccccagcaggttgaggctgctggctggcgtggccatcttttattcccttatttgtccccgcccacatcctgctgattggtccattttacagagcactgattggtccattttatagagtgctgattggtccattttacagagtgctgattcgtccattttacagagtgctaattggtgcatttacaatcctttagctagacacagagcactgattagtgcgtttttacagagtgctgattggtgcatttacaatcctttagctagacacagagcactgattagtgtgtttttacagagtgctgattggtgcatttacaatcctttagctagacacagagcgctgattggtgcgtttttacagcgtgctgattggtgcatttacaatcctttagctagacagaaaagttttccaagtccccccctcgacccaggaagtccagctggcttcacctcttaatatctctgtacaaaggctctaagaagggtcagttattattcccaatttagagatgggaaaactgaggctcagagaagcaaagcaaactgccccataaccatcaggacatgaactcaactctgtctgataccattaggtcagaagtcactacactttagccagataatgaattttttcagctttaagatccataccctctctgtagcaacttctcaatgctgtcattgcaacacaaaagcagccacagataatacatatatacatgggcatgactatgttccagtaaaactttaattacttaatttggcccacggaccagtgtgccaccctgcactacctgccacttctcctgaggctgactcataagaatatccttcgttattgagcatttataggtgctggtcactgtgctgggcacttgggctgcattttctggttttattcttacatcagttcttatataatctttacattcttgcatcattattctccccattttagaaatggaaaaatagaagttcctcaaaacctgcgtgttgcacaagccagcactgccagtcaagcactctgtctgcaaacactgtgtggtctcctaacacatacatcactgagacacagccaagggaaacttctggggtctcacattttcctctcctatcacacgggctttcgcattttcctctgcaacagaataaaataagaagcagacatgtgtttgcaaaggtcatggaattcaaataaagagcgtgatgcttccttccctcttgcagagagcatataaggaaatatagcgagacggcattcactttgaattcattgccaggtcagttcctgtgctgtgggaaagcccaagacctggagaggaggggagcatccaggaactaatgggctgttcccctagaatggagctgtgtgggtgcagaaagcctcccatgctggaaaacaagcaggaaataatgggcatcaccatttcccgtgaacaatggagaggattggaaaataaatgtatgcagcagagatgaacatttacatggcaaggggcaagtggggcctctacccacaaatgtctcccaacatactgtctctgtccagtggtgcaatctcagctcactgcagcctcccaggttcaagtaattctcatgccccagcctcccaagtagctgggactacaggtgcacaccatcatgcccagctatttttttctatttttagtagagacagggttttgctgtcagccaggctgctctccaactcctggcctcaagtgctccacccgcctcagcctcccaaagtgctgggattacagtcctgagccaccatgcccagccagatttctaccattactgttaccctcgtaagagtagcataagtgcttagtcaatcattaacacagtagtatgaatgagttagacttgagagcagaaaaaaccctgggctgggaatagagaaatgtggcttttaaaccactgtggctgtacagagagtttattaaggctgtggctgtcggcaaatcacatttccctctgcagaacacagaagatgaaaaatggatcaaaggttacaagtggtccatgagccacttgcatcccagagatctatttcgcctttgatatatttttaaaattttttgattgagacaattttagattgggtttgtcccagaacccagcattccctgatgtctcatatgtggctgcttctcacatttatgacaactgaatgatatctggttttaatccgggattgtaaacatcagttctggattctgatgcaatgacaaaaagctgaaagtggaaccgtaaaagggtgggactcttgtcaggtaagtctcaatgaaagggaaagtataacatctgtcttcacaaacaaaatgttttctgtggaagggaggactgtggtaggaaaccaccaggtaccaaggagataggcggagtgccatttatcctgcattgtagtgtctttgctttatgcaagatatgtacataatgaaaggatcctggggtctagtctcagcacaaaggctcaaacccaaccccaaacccacaaggaatgtttccatgggcaagtgactagacctctcagaggcccttaaccaatgagctaatggtagtcatttctttctcttttctttttgttacttcatatataatgcaagatcttttcttaaactttttttgacaaataataattgtacaatattcacggggtacgtagtgatatttcaatacatataatatatagtgatcagatcagggtaattttatatcctttaataaatctttccctctctctcccttccccctatccttaccagtctctagcatcctctcttctacattttatctctatgagattaacttttgtttgcttccacagatgaatgagaacatgcagtatttgactttctgttcctggcctatttcacttaacataatgtcctccaattctatccatgttgttgtgaatgatgggattttattattttttatggctgaatggtattccattgtgtatatatgccacattttctttaaccgtttttaaccattcatctgtggttggatgtctaggctgattccatatcttggctattgtgaatagtactgcaataaacatagaagtgcagatgtctcttcaaagtacagatttcctttcctttggataaattcccagtagtggaattgctggatcatatggtagctctatttgtgtttttttgaggaacctccatactgctctccatagtagctatactagtttacattccttccaacagggtataagggtttccttttctgcacatcctctccagcatttgttattttttgtctatttgataatagccatcctgactggggtgagatgatacctcattgtggctttgatttgcattttcctgaatgcaagatatttctacatacactgtctctactccgtgaaacagtgtggaaattgttttcaccactttatagatgagaacactgaggctcaatggatgaataaattgcagaaagtcacacagtgagccatggcaagattccaaccctcatctctctaaccttcagagcccacacaccttccatgttgccatgacaaccccatgcttcacttgtcaagccgggatgttgacgaaactcacctcccagagcaggtgaagattgcttgcctacagctgccaaaggagagcacaatgctaggcacacttgcagggctgcaggcccttctggatcccagctggttccaacttagttatttcatctagaaggttcttgcccatgaagaattccatttcctgtttctggtgaattctaggcaatgaggaaggagatgcccagaggaatccatttcttgccacctcccttgatttagtaagcaattatcaatctgctatcctcaggctgcccacaggcctgagaaggagaagatgcctggctctagactggaattattgtcggtgttgttgttttcttccagttggtaaattccctgggcttgtttctgaacagagcaagatgaatgctgaaagcgagatgagagccctgatgagccatttcccttcagaatccatctcaagacaaagaggaggcctctaaggaagaagggacccggggtgtgctggaaactgaagatcacttccacaaactgttcccaaaaggaattaccatgcagccattggcccattcaaaaaataaaaataaaaaggttatgaagattaagccaataagtctgagaggaagataaaaatcacaggggatgtgtgcaatggctcacacctttaatcctaagactttgggaggtcaaggtaggtggatggcttgagcctagggattcgagaccagcctgggcaacatagtgagaccccatttctacaaaaaatacaaaaaaaaaagccaggtgtggtggcatacacctgtggtcccagctacttgagaggctgaagtgggaggattgcttaagcccaggaggtcgaggctgcagtgagctacgtacgatctcaccactgcactccagcctgggtaacacagcaagactcttactcacaaaaaaaaaaaaaaaaaaaaaaaatcacaaggcacctcccttggccatactttatcctagttgatctgagtggctttgtttttcccttttttattatcattattattatattatcattaccattcttctccctattgagtttcatggcctgttgtaaggggtttttctctggaatagaacaagacataaattctctgaacagtttcctccctcagcctgaaaatacaatgatctttttactgagcagattgactcctcctggttaagaggaggactggagagttatccaggaaatgcaacaaagtgggcctcgacatccacaaatcatactagaaatttgttacttctatatacatttgttttcacttttttgaacttttcctatttatttatgtatttacttgatacagggtcttgctttgtctttcaggctagtgtgcagtagtaggatcacagctccctgcagcctcaacctcccaggttcaaacgatcctcccacctcagcctctagctgggactacaggtgcacattaccatgcctggataattttttgatttttttttaaagatgggatctcactatgtttcccaggctagtcttgaactcctggcctcaagcaatcctgctactttattccctcacagtgctgggattacagcattgtgtccaaccttttttgaacttttcaaagcctgcctgagaaccatgatctcatgtaagcctaataagtaagcttacatgatctcatgtaagccctggaaggtaggaaggacaggcatgctctttcccattttacagatggaaaaattgaggcccagagtgtttgggtgggtttgcccaagggcacacagcaagttccagcagagctggatctggatagaccttctgacccctgtccccaccatcatctcctacgggtggcaaggagtctgtttatttcccaggctggacttcagcccatagatacagacgggacactcagatggagtgtcccagtcaggacactccaggagatgggtcttatgaaccttcacactggtgaaggcacctgagctctcttacctggaggacctggatggacaggaacagagggctttgggacagatgaggtcagaaatccacttgcatctctgttgggattgaacctggggtgttcactgattctattatcacctgtgtctcttccacttgctctgtatttctgtctctgcctctttctccacacacctctacacacacacacacacacacacacacacacacacctgtctcttatctgacagttttcctcttcttccacaagtgatatcaagaacataaaggcagctctttctctccaaatcggtagaagccattgatctgcaaggtcttaaattttccactaccttgctcattttaaaggtaagtttcatgtctctttgttccctccatttgatactataattggggcattttcttgattccttaattcaaccgctcaattttggaaatgctctttccatggtctccccctaggcctcatttgccatacttctctcccctccccctcttcattcattccacacctggtttgcataatatccttacaattgatatatttcaggagaaaacagtaatgatttaaaatatctttggatcattttaaagctgtgtttgcaacaggactgctgctctagtcgaaaagactgcctacaaatccccttcttgccattcagggacagagaaataaagtaaggagtggagataaaacgattacacaaatcctgtgtttcagatctttgttcttcaggcttcctatcaaatattagcaactcgcctcaaggtgaaaagagggaaaatgagatctcagatagaaacagcaggagtcaccaagcagcatgttctttcagctcctggattctgttcagcccaccccagtgaggaccatccatgggactttctgctcctgactcgagcagaactgggctcaaatcccagctttgtcacttaatggctacgtaaccttgaatactaattttaatcctctgagctttgggttcctcttctgttactcatgggtttattaaaatagtagtgatagcctgttctcagggatagtgtcaggcactgttagtgatgatgactatagcagccagtgggtcctaagcacccttgaacgggattctcaatgcatcctcagtacagtcctacaagggctgatgtgatgattatacccattgcacaggtgcagacactgaggaccagagaggctcagagacttacccagggtcacacagctagtaggcagcatgcaggagctgattttttgaagcctgtcttcttaaccatgcatgaaaatgtccagatgctatgaccttccctatctagcacatacttagaaaatttttgttcctgctcttctcccagaaaggacaccattacgacaagagatcagtctcagagcctggcataataagtctctgtgtgccttctctctagagggctctggaatgaagacctctttaattagtagaatgatgctctttggggccaaagtaaagagacaataaagcaactcccagagcggacaagtgtgtgaacctgagccaagcatttcgtcctgacatggtggagattaatggtctgtaaagtggtgcaacaactgtttgttaggttcagcctgtggcttctggagggcagtcaatctgcagtggttttggaattgcagattgaaaagatgtcagacctccctttgctcccgtatgggccagtcacctgtggtcactgaagccctgtctggccaggatcagcagtccccaccatggcatagggtccagaaaccccactgcagtcttagttctgggactgatcccagctacccatgaggaattccgagtgcttacatacctgctgtgttgtaactgaccagtttgtcttgttctcaaagttgctggtctgtttacactctcaaatgatcaaagaccccgaaaaacttttgttcatgtgggttgtatcaacaaaatttctagtattagaaattaagatagaaatgtttttaaaaacatgcatttattaatttataaataaaaataataggctggtgtggtggctcatgcctgtaatcccagcagtttggggagctgaggcaggtggatcacttgaggccatgagttcgagaccagcctggccaaaatggcgaaaccccatctctactaaaaatgcaaaaattagccgggtgtggtggtgcacgcttgtaatcccagctacttgggaggctgaggcacaagagtcgcttaaacctgggaggaaaaagttgcagtgagctgagattgtaccactgcactacagcctaggcaacagagcaagactgtctcaaaagaaaaagaaaaagaaaaagaaagaaacaataataaacccaataagtaaagtaacatattcattctatggggaaataactagatttttgcataaccaaagaaaaaatacggagaagagtggcattgttttacttttttgcaattctctttaatgcctaactgaatagaatgcctagattcttctagctccttctgcatgcagtctgttgtgatgtgttggttttggtggaagtctatgaagaaattctcacacagacatgtatttagagaaaggaggacaaccaggaccctctgaaacattcttaggcactcccaggagtccttggaccacactttgagagccactgaattttagggtcaacattatttattcattcatctaatcagtcatttactcagcaaatggaaattcagcgtgcattttgggtactttaagaactggagatatggaggtaaataaactgtggtacttattctcagtgcctcatccactatagacgaggagactgaggctcagtatttattctcagtgcttcatccactatagatgaggagactgaggctcagaggggtaatgtcccttgtctctggttgtctgtgtcccaaccagagacaagagacattacctctctgagcctcagtcacatctatagtggctaaaaacatggatctgtttcttaatcagtctagattcaggataactgatgtaggggtctgtataatttgacgatgatgatgatgataatggtggtagtgatgatgatggtgatagcgataatttaatgatgatggcaatgatagtgatgatggtgatgatggccatgttggtgatgaagatagtgataacttgatgatgatgatggtgatgatcataatgataatcatggcaatgatggtggtggtgatactaataatggagatgatgatgatgatgatagcgatgatgatgatggtgatggttatgatgctgatgatgacagtgatgatgatgatggtgatggtcatggtataatggtgatgataatagacatgctcacataccagattctgtcctacctttaggtcagaatctttaaaacagttccatgaagtaaatctgctattctattcattttaccaacagggacacagaaaagttgtgtagtttgcccaagggcacacactaagcagcagagctgggattcaaacccaggcatttgagttccaggtactgtgttcttggctgtcagaatgtgcgtatagtccctgttacagacagcagtctcaggcagagaattgtcggccaaggtgggaaaatctctggagtttcagtcagcaactaaaaatacagagtgcatgctaaataggcaaagctcggtttatgcagtgttatgtttgttaaatatttgatctgggagaattaaatggcattttctctctagaggactgaggctgacaggcccccaagaaataaagctgatgaaaatagccctgattgtaatcatactcaaatgtgtacagttcacagaatgcctccatatatgctagcttatttaatcctctatttaaatgatgctcaccagtcccctagcaaatctaccctccactttttattccgacagctttggccttgaatcaggattcgtcactactgctctggatttttgctacagcctccaaactgctaacctctgtctatccactgccccatggcccccgaatgcttcctccagaggtttccttcaataataatgctaatggcagttagtattagttaagcacttaccgtgtgccaggtacactgctcaatactaggtgtggattatattatctgctcctctccgtgattatgacttacatatttttattaccacgtccccattttacagataaggaaaatgaaacttagagaagtcacatgatttatccaaagacacacaacaaggagacagagatctgggacttgaatgcagctgtctgattctctagcttgtttttaaccgtaaagcaaccctacctcccgtcagcaaagtgacctaatccattgttgccctctgtggactctcaggtccttaatggtcataagaaaaagtcacaatgatggtgataatgaagatgatggtggtgatcctataatagtgatggcattattcaatatggcacccaagtccttcaaaagctgattcctgacttatctcctggagtctccttcctgcctcacctatcaccacgcaccccactctcaagccacaccaaaatccttcattcaccttaacttatcacagtgcttcatctctgcatgtgccatttcctcccctgaccaccataccttcctcaccagtcaaattcctacatagccttgaagacctagccccatagtccacctggaaaaaaataatggatgactttctgtttcttcagtgcactatcagagtactccattcccacttgaatttaactttattatgtgtgttttgtagggcattggagaagagcatgggccgtggattcagaatccctggcccacacacagcctctaccacttactaattgtatgttactaattgcctatgctcaggtgattttatgagccctagtgtccccatctgtaaaaacgggtttgacaacagggttatctactctcccaaggctattctgatgatgcaggagggggaactctctagattactggagaagagaatagccagattgtctaggctcactggacactaacccaggtgtggccttagaattaaggatgctgctgcagagtgctttcaccaggatgctctcccagtgcctggaaatcaagagagacccaggtgtctgtcagaatggcctaaaaagggcatagaccgtgtaggttctatctaaaaggatagctccaataaatggagttataaggctgcaagaaacgagcttctctcagttctgccaggccccttggctttagggtataggtctaatctcacggagcatgttttggggttgggatgaggcaaggtgttttccagccaacccgtggcccacctgggagtctacagagggctcaataggataatctgtgacaatcacttacacagtgcctggggcaaagtgctttataaatgttacctgtttttagccacaagaatgatgcattgctgtttctcattttctgcttgaggtatctcccctatggtttctttgggtgaagaactggggtcatttccctagctaccaaaaacaaacaaacaaacaaaaaaacagtttggccaaggcaaagagccccctgggcatttgaaataaccaaagtggaacctgtgtgtaggggtgtgtgtgtgtttgtgtgtgtgtgtgtgtatgcctgcattagcacctgaatcccatctagtgggattcatacactcacacacatacacactcacatgcacacacacatgcatgcacacacatgcattcatgtacacatgcccacacatgcatttgcacacacacatagccttccacttttctcatggtgcttgccccttctctgtcttgagcagcctcagctcagccagtcccttcccatcttccttacagctgcatctcctccatactctcttctttcccttcctcgttacaactcttgcccattgccttataaaaatctgcaccctttccaaactgactgccacattcctctccggcatttttcttcccatcctatttccaagtcccccgccatctccagcccagcaccagggacttttagagaccctcagtcctctaaatagagggaaaatgttgctgcctccagcaaggtgtagagaagctgccagccgccagcgtcatcatatccaataggcatgatgttttcagtagtggtgagactaaaactttcactctgtccactgctgggggctagaggctgtggccctgctgctctccccacacctggatccctgggttttgaacatggggcgtcctctgtctaaaactctcatttccacttcaccttctctttgcttgtctagcttctctagttttaagattccttctagatatcccctcttccaggaagccttctctgatcctcagactgaatccggtctcctctggactctcaagctgcctcagcttcccactttagagcactcaataaactgagatctaactgtctgacagtgattccataaactatacttgctcaccataatatttctggaacctggtacatatttttcataatgaataatgaaaagaatgcaattctccccaagtgaaacatgatttgtgtgatactagataattttccaggatgcttccccaatttgcctcctgccccaggggcaaccacaccaggctgctgttcagctcagagttgtctgccacatgacatgttaagccagccctaaaatgacagaggatgtggctgagaagccaataatgctcttctttgtccagagtgaaaactccatgggtttaggcagggactaagcaaagagtgcagtggataccattagctattgttcttccctctttccaggtgggaaagtattttcctcctaataagatatgggctgctgggtcctgcactcccctgggctgacagcaactagggaaatgagatccaaaatattctatttgttagggacctgtattagtccattcccatggtcactctgctatgaagaaatacctgagactggataatttataaagaaaaggggtttaattgactcacagttcctcatggctgaggaggcctcaggaaactcacagttatggcggaaggaacctcttcacagggtggcaggagagagaatgagtgcagagcaaaggggtgaaaagccccttatgaaaccataagatctcatgagaactcactcattatcatgagaactgcatgggggaaccactctcataatctagtcacctccaaggaagtcccttccatgacacgtggagattatgggaactacaattcaagatgagatttgagtggggacagaaacaaaccatatcagggcctcaggagggtgtcctacaatggatttgtctcttataaactccttttgggcctttgtggtcacaaatcatgataggtttggtcttaggtggacagtgttctgttgtggaaacatgcatggtttctacccattgttattcaaacattgccttttctagtaacctttgatgacatatttttacctaagatctatgaaagaacttggcaggttgtagttttcaaaactgtgtgtgtgtatatatatatataagaatggtggaagtgatgccatgggacttccaagatgaggtcataaacaggagacagttttctcctgcagctcccctctgcatctctctctccttctccttctccttctctctcacccccctctctctttccaattacttctggaatacatccatcatgctatgaggaagcccaaaccagcccatgctgaaagactacacagacaggggccacacagagaagaaatgagtttgcaaccgatagtcaacatcaacctctagacataagaataaatgggactcgagatgattccagctccagccttcaagtcttccagcagagattctaggaattgtggagctgagacaaaccattcctgctgttccctgtctgaattcctggccctcagaatctgtgagcatctaaatggttgttttacaccactgagttccggggcaatctgttatacagctgaagcaacagaaacaagactggaatacaaaaatagagactcaaagaaattgtgaatgcgtagaaattaatcagaggggccattaaactcttatctctgtataagcaacgaccttgaagtcataactcatcaactaagtgggaatatcaaaagtgaccacctaaaatgatcatgatgattaataacctcattttataggtgatgaagctgaggtccagagagactgcccatgaaatgatcaagcagagacccacccacatccaggtttgtaaagctcctggcatacaatacaggtaacgtgatagtctctcctggtgagaatggtaataattggtaaagatttattgaatattcatcattcactgacattgttaaatgttgtcttcaccatactccttccaggtaggtgttattgtttccatttcacagatgataaaattagggttcaaggcgaggagaagtgacttgtccatggtgagacagccaggaagtaatgatgctgagtccagaacccagatctgtccctccccagtggctgctcactgttcatgctgcctgttctgtcgccactttctgctttctgtatctcaagaacatgaacaatgtcttcagtgttaatgcatgtggagacactaagctagaagagggtttggctattgtcttccaagtcagatacccatgctttgaatatttcatctgatacttacaacctatgaaacttgggtatgatgtcaattcacctctttgagcctcaactttcttgtcagtaaatggaattcaaatcccttctagatgtgagtatcagattagacaaagtgtgtaaggagactaacacagctcccattaaatattaggcacccaattccatttgattctctcttttaattatcatttaaagaccattccccatcctgtcccactgcaaagagctttcaataacaaaactaacagcttacagtggtggagagcttgctatgtagtaggcattgtttcaagtgctttacacaagttgcatttaagcttcataatcgtattatgaggtctgggtaccatcgctatctttatagaccagaaaaccaagacacaggtaaagttcttgtattagtgcactatggtttccataagaaagtaccacaaatggtggcttagaacaacagaaatgtattatctcccagttctggaggccagaagtctgaaatcaaggtgtcaacaagactgtgattcctctgaaagtgctaagggaggacctgttccaggccccacttagcttctggtggtttgctggcaatctttggtgttccttgccttgtagaagcatcacactgatctttgccttcatcttcacatgacattctccctgagtgtgtgtgtctgtgttcagattccctatttttataaagacacaagtcatattggattaggggcccaccttactcaagtatgatctcatcttaactaattacatctacaacaatcctgtatctaaataagaacacattctgagaaacttgggattaggacttcaacatgcaaatttggggagcacacaactcaatccatagcaattatcttgttcaagatcacacaactaataaatggcagggacaggcttcaaatttggttaggctgtctgcagcatctgtgttcttgaatatgctgataatagtcttccccatagatggatggggcaaaggagtctctggaaagaaaacatagcttgcaagcccagttgtgccatcctggaagttctctagctccccataaccagcccccatcatagtgtgactcaggcagcttgggaacactgggggtggcttccccaacaactccactcaagcacaagaacagttcgtttgctaaagtaattaaaaacataatctgcgctattaaattcctcctccatttttctactgtacgtgttcctcagcgtgctgagttatatgcctctcctaatcattgctgacacgttggctctgcccacagctccctcctaaactgccattcgttagaggtgatgggggtttgagacagtttgttttaatgtcaggatcgacatccctgataattatatacacaccccatttgctggaaattcactgcttaaataagaggctgggttgacagctctgacgcctcagctctctcatcagccgcagataggggtgcatgcccagggtacgggtggtagtctcttcctatgggagttcactctgagctggcttttagtggtgtcaaatgacagtcgtcatgcagtttgaactggaggagtcagtccttgacagcccagaccatttggagaaggatcacccaacccaccaattgtctctcccacagcacataccctttttacctgtgagagtaaaaaattaaatgtacacttaatagagaatgctctggttctctttttgttggaagcatttattgatgtgtctatcatgggggcatgatgaatgaaaaactatcacttatttacgcacccgctgtacctcacacactactagaccatccatatcgtctgaatcttcatagtagccctgagatagtatttttacatttctggatgatgaaaccaaagcacacagaagagaaaggacctgaccaaggcagggcagctgaattgagatttcaagatgcctgctatgatttgacctctttttaccactttatgctgttgataacacctttccatgaaactcctcttctgttaggctcggaagcacttccttttcttggtttcattcctacctttctggtcttttcctactgtttctttttctactcaggctcttctctgctgtttcagcataaaatatcaatgtgccccagggattttctaagttcagtcctctcctcttcccactacccaaaatgttccctggaggatcccacccaagccagtggcttcatccttcagcgataggctgagagttcccaagtccatagatctagctggggcttcttggctgagctataaatccaaatatctaaccaccttctgtacatgtacatgggggagacacatagactccatacgcatgtgtcacatccaatttgcttctcctctacaatctctgatttgggaattggtgccatcatgcaatcccctgcccaaatcagaaactggacagttactctggactcctcctaactccctatcccagacacacataggtaattaaccctcagattctgtatctgctccctctttttcataaacatattctccctgaagatttttaactgcttctctcaattgcctcctttttgtctcccattgtggtggttttcaaatgtgttcataaattatttagcaaccttcctggcaaaaggtggagactaatttctctcctcttgagtgtggacaagactcatttctaacaagtagaatgtagtgggggtgatagtgagtgacttctaggattaagtcataaaaggcattatttttgctcctcttctcccctctcctttcctctatcctcttctctcctccttcatcccctctttctttgtcctctgcttcttcctctcctcttcgtctcttctgttttcttctctcctcctcttgtcctttccctccttcttctccttctttttttctctctcccttccccccgccaacctcaattatttgcactgtgaaaagccagttgacacattctgaagacatccaggcagccttttggtgaggttcatatgacaagggatagagacattctgccaaaaaccagcaagaaactgaggccttctaccaacaactgtatgagtatgtcatcttggaagagaagttttcagccccagtcaagaattcagatgattgcagccctagttgacagcaaccacatgagagaccctgatcctgaaccacctggttaagctgctcctgaattctcaacccacagaaactgtgaggtaatatatgtgtgttgttttaatacgctgtgttttgaaataatgtgttatatagcgatagaaaactgatgtacttaccagtttattctctacacagcagaaagtaatcttctgaaatgtaattcttatcatgacaccctcctaccttaatctcttaaattgctcccattgaccttgaaataaaatctaaaatatttgacatgggcaacacaatcgtttagtaactggccactaccaacttgtccagaaatttttctctcatctgtccttgcaacaaacatcctctacaatcaatgcaccaaaataccatagtttttctgactatggcatactattgcaagcttctatgcccctccctttggcctggaatgcccttctcagtagatttcaatcaaagaattcctacttattgcaagtgtcatctctttggactctcctatatctggcctaaggggtaaattaaattattagttaattggtcaattaattcatccattgaatattttgggggtctactattaatatatctaagtgaacctttctagattcacataggaccctgtatgtcttgtagcacaactcttaacacatgtattctaatttttggttgatttttttgttttctcaagtaaactgaaaaatctatgaatatgagaactacttatgatttctccaaaatagttctggttgtagagtttattagtcagagttctctggagaaacagaactaatgggaggataccctaaatcatctctctcaagttcaaagttccatagatccctagagcagggacacaatacctccaacctctttgctgatgcataacaacagtgaactttgctccagttcccaataagttcctcatctccatctgagacctccttaacctagactacatagaccatattactatcagcattttggtaacaacaatttaacaagtctctaggaagttccaagctttccctcatctttctgtcttcttctgagcccttcccttcttttccaacctctccccattacccagttccaaagtcacttacacattttcgggtatctttatagaaatgcccctctttttggtaccaattttccgtattagtctcttctcacattgctgtaaagaactatctgaaactgggtaacatataaagaaaagaagtttaattggctcatggttctgcaggctgtacaaaaagcatggatggggaggtcccaggatacttacaatcatgacagaaggtgaacgggaaacagacatatcctacatggctggagtgggaggaagaaagagaagggggaggtgctacatacttttgaacaaccaggtctcatgagaactcactatcgtgagaacagcaaggggaaagtccgtttccatgatctaatcacctcccaccaggtccctcctccaacactggggactacaattcaacatgagattttggtgaagacacaaatccaaaccagattaatcttctatagcattgaggtttcctaaaagactctgatacctggcagagctgaatttgaatcctgaccctgcctcttcctggctgtgtgatcctgcataagctacttaccctctctgtgcttcagtattctctgtaaaattatggtgataataatagtatctacttttcagatactttttatttcaacacttctgatagttgtgtagtgatatgttattgggattttaatttgcatttccctgatgtctaatgatgttgagcaacttttcatctgcttttccatttatgtatcctctttggttaaccaatactcctttacacatttgttactaactttatgttgcagattaaatgagatactttcagaaattgcttagcataatagtaggcacatattcagcacttaagaattgtcctcttcggttcaacaagaagacttaactatcatatatatatgtgtgtgtgtgtgtgtgtgtgtgtgtatgtgtgtgtgtgtgtgtatatatatatacatatgtatatatatctatctccaagattggcatacccagactcataaaataactacttctagacttctagacctatgaaaagacttaggcagccacatcataaaagtgaaaaatttcagcaccttactgacagcattagacacatcatcaaggcagaaaactaacaaagaaattccagactaaaatttgacacttgatcaattggacctagtagacatctacagaatactccatccatcaaccacaaaatatacattattctcagcatatggaacatactgcaagattggccacattttcagccataaagcaagtctcaataaattcaaaaaaatgcaattataccaaccatactctcagaccaccagtggaatgaaaatagaagtcaatgcaaagacgatctccccaaaccacacaattatatggaaattaaacagcttgttcctgaatgacttttgggtaaatgatgaaactaaggcagaaattaaaaaaaaaatttgagatacgtaaaaaaagaaacaacgtatcaaaatctctgagatgtagtgaaagcagtgttaagagaaaagtttatagtactaaatacctgcccccaaaagttgcaaagatcgcaaattaatgacctaatatcatatctacagggactagaaaaacaaaaataaattaaccacaaagctagcagaagaaatgaaataactaaaatcacagtagaactgaatgaaattgagacccaaaaattcatacaaagaatcaacgaactaaaagttggttttttaaaaggttaagtaagattaacagaccactagctacattaacaaagaaaaagaaaaggaagatccaaataagcacaatcgaaatgacagaggtgacattataaccgatcccatagaaatacaaaataccctcagagactattatgaacacctctatgcacacaaattggaaaatctagaggaaatgaataaattcctggaaacacacaacctttaaagattgaatcgggaagagactgaaaccctgaacagaccaatatgtgtagagaaattgaatcagtactaaaaaacctaccaaccaaaaaaagctgtggaccagatggactcacagcaaaattatactagacatacaaagaagagctggtaccaattctactgaaactattccaaacaattgaggaggagggactcctccctaattcattctacaaagccagcatcttgctgataccaaaacctggcaaagacacaacataaaaagaaaaaactacaggccaatatccctaatgaacataaatgtaaaatttctcaacaaaatactagcaaactgaatccagcagcaaaccaaaaagttaatttggtataatcaaggaggcctctctcctgggatggaagtctggctcaacatatgcaaatcaataaatgtgattcaccacataaacagttaaaaacaaaaaacatatgataatctcaatagacttcaataagattcaacatgcattcaggataaaaactctcaaccaaataggcattgaaggaacaaacctcaaaataagagccatctgtgacaaaccaacagccaacatcatactgaatgggcaaaagccagaagcattcctcttgagaactgaaacaagagaaagatgctccctctcaccactcctattcaacatagcactggaagtgctaaacagaacaattagccaagagagaggagtaagaggcagacaaagagaaaaagaagaatattgtctctcttcactgacaacaacgttctacacccagaaaaccctaaagactctgccaaaaggctcctggagcttataaatgacttaagtaaagtttcaggatacaaaatcagtgtacaaaaatcactagcatttctatacaccaataacattcaagctgagagccaaatcaagaacacaatccaatttacaatagccacctgcccccgcaaaaaaaaaaaaaaaaaagaaaaaaacctaggaatacatctaaccaaggagatgaaagatctctatcagcagaattatagaacattcctgaaagatgacacaaacaaatggaaagacattccatgctcatgaattggaagaatcagtaacattaaaatggccatagtgcccaaagcaatctacaaattcagtgctactcctaagaaactaccaatgtcatttttcacaggactacaagaaactattctaaaattcatatggaacaaaaaagagcccaaatagacaaaggtatcctaagcaaaaagaacaaagccagaggcatcacattatgtgatttcaaactgtactatagggctatggtagtcaaaacaacatggtactgatacaaaaacagacacatagaccaatggaacagaatagagaacccagaaataaagccaaatacctacagccatctgatctttgacaaggtcaccaaaaataagcaatagggaaaggactacctgttcaataaatggtgcttggatagctggctagccacatgcagaagaaagaaactggacccctgcctttcactacacacaaaaattaattcaagatggattaaagatttaaaagtaagacctcaaactataagaatcctagaagaaaacctaggaaacaccattctggacatcggccttgggaaagaattatgactaagttctcaaaagcaattgcaacaaatccaaaaattgacaagtgagacttcattaaactaaagagtttattcagagcaaaggaaactatcaactctgtaaacagacaccctaaaaaaagagagaaaatatttgcaaaccatacatctgacaaaggtctaatatctagaatctataaggaacttaattcaataagcaagaaacaaacaacactgttaaaatgggcaaaagacatgaacagacctttctcaaaagaagacataacagcagccaacaaacatgaaaaagtgctcaacatcactaatcatcagagaagtatgaatcaaaaccacaatgagacaccatctcacaccagtcaaaatgacgattattaaaaaataaaaataaaaaaccagatactggtgaggctatggaggaaagggaacacttacgcactgttggtgggaatgtaaattagttcagccatggtggaaaatgatttggagttttctcaaagaacataaaacagaagtactattcgaccgagcaatcccattactggatacgcatccaaaagaaaataaattgttttaccgaacaatgtttattacagcacgattcacaatagcaaagacgtggaattcacctaagtgcccaccagtggtggattggatgaagaaaatgtacatgtacgctatggaatactatgcagccataaaaagaatgaaatcatgtcctttgcattaacatggatgcagctggagaccgttatcctacacggattaacacagaaacagaaagccaaataccacatattctcacttataagctagagctaaacattgggcacttatggacataaagatgataacaatagacacttggaactaatggaggggggagacgggagatggacaaggctttaaaaaaaactagctcttgagtactatgctcactacctgggtaatgagataatttatatctcagacctcagcatcacacaatatagccatgtaacatatctgcatatgtacccctgaatctaaaagaaaagttgaaattatgaaaaaataaaaaataaaaataagaatcatctagaccagaagctcccctgaaagactgctttgacttcttgttgacaagagttggccctatgcgcatccctagctgcaagaagtctctggtgtgaacgttttcaagtgaacacaccaccactctgatcataatgtaatactttagcaatcaagaaggagaaaatacatactgagtaggcaaatagcaatgtctgacacgaaatgtgaccattaaaaattatataattgtcactatgggaggctgaggtgggcagatcatgaggtcaagaattcgagaccatcctggccaacatggtgaaaccccatctctactaaaaatacaaaaattacctgggtgtggtggcacatgcttgtagtcccagctgcttgggaagctgaggcaggaaaaccacttgaacccgggaggcggaggttgcagtaagctgagatcacaccactgcactccagcctggcgacagagtgagactctatctaaaattatatatatatatgttttaaattttacacaaattatattactctgcatattatcttttgaaattggggttttcactcaacattgcttgctaactttatttattcatggaaatgtggctcatttatttcatcactgatattattccataagtaaatattactgttaaaaaaaaatgcccttatggtgcaccgagaatagaaaccataggaccctcaacttcctggcctcagaatccaagactgagtcaggaggccaaagctctatgtttggatctgtttcaatttatttggttctttcccaagcaatttttttctgcctgtacatcctcctcagagcacctgcctctttggatgaagatttgaattgttacctcccagagccaataatatacctcacctctttgctgacaaaggtaaatataattaaaaagtgattatgatctgggactactttcataagctttgctagacctaattatacagcaagtgcaagtctctgggtatcaaattctttctagatgaaatttactgacaccatcagttgtgtgccagtgagcaagggtgaggtttgtactgttggtggcagagtctgggatgtgagaaggagacactgacccagggcaaaccatgtccaagcttcaacaatgttcctagttctgaatttgttcatttgagtcgcatttgtccagcaccgtccgtggtcgtatcttgttcttgaggaattcacagtctaactggggaaaggggcttgtccataaaggcagagtaataaatttgtaaaagagtatttgctggtgcatcgaagaggatacacagatggcaaatcaacacatgaaaagatgctcaacctcatcaggcatcagaaaaatgcaaatgagacatcacaatgcaatatcacgatgtacctatcagaatgactgaaataaacaataatgaaaacaccaaatgctggcaaagatatggagaaattaaatcactcatacactgctggtgggaatgtaaaatggaatagccatgcagaaaaacagttttgcgattccttataaaactatatatgcaaataccacaagacccagcaattacactcttaggcatttgtcctagagaaacagaaattcatgttcacacaaaaatctatacacgaacgttcatagtagctttatctgtaatagcccaaaactggaaacagtccagggatcctttcatgagagaatgtacacttactccaaattggctgtgtttgtttccgaatctgtttatgctgattgtacttggtgaacacactgtggtacatccataccatgaaacactacacaccaatagaaagaaatgaaattttcatatctgcaacaacttggatgaatctacaggaaattaagctcagtgaaggaaagacaatttcaaaagtcacagactatatgatttcatctatataacatttgtgaaatgacaaaattacagaaatgaagacaggatgagtggttgtcagggcttaaggaaggggtggggtgagaagaaagtggctgtgcctgtaaaagggcaacagaatgaatcctcatggtgatgggggtgctctgtgtcttgactgtgtgaaggtcaatatctacattgtgaaattggactagtttcgccagatgttaccactggggacgattaggtaaacggtacattggatctctgtgtttcttagaattgcatgtgagtctacaactatctcaaaataaaaagttcaattttttaaaaaacagagtattggctccctgctccaaacctttcaaaacttcctattgcctttgtaataaaatacaaatgctcatcttgacttccaggccctgttgacctcccagactgtcccatgctgccccattttccagaccccagtcatcctgggctgttttcatttcctttctaacttgatttccagccttcttctgcgatgttctcactccacaaaatatcttctcctggcttttctcccagctgctccttcttgtcatttgggtttcagcctaaacatcacctcctcatggaggccctccttgatttcttccagataggctccctctaaagttctctcaatgtctatctgtaattattgtcttttctggtttactgacttaattttgtcctctctactagactgtaagttccttgagggcacggatcttgttaactgggctcactaatgtttccccagagtcagctgagtggctggcacataaaagaggctgaataaatacttgcaggtaggagaagaggaagggaggatagaagggaagagaggatgaagggatgaagagagggagggaggagaaaagggtagaagggaggaagggaatgattaaaggagggacggagaaaagggagagaaggtgggatggggtgggagatgtcaaagaagcagctcaacaggactttggctatgggcaagggggaaagaaggaatgcatgatgacatctggtttgggcttggtcatgatggcagacgctggtgccatttgttcttcatgaggaaggagaatgtttgcaacaggagaaaaaagtgtgagttcattttcaatgtgtcaaattcctctatctccctgcctaccccaagtccttctgcacctggttatcttgtatatacagaggagccctttttaccgaatacacataagataagtaattggtcagtaaatcaaaaggaaaatggttaaaactgagaatgaaaatgataaattccttaacacattttattaaacttaaagatgtgtacattcattcgctgatcttaagacaaaaggtgaggcttttttggccgagaatgttttttgctattggtgtttcatatagtttttcttgccaagtgatatctatgtgatatgcactaactctgatcctaaacagtcacctcccacacctaatttgatagcagttctttaataggtttacttaattaaatggtgtaattataacaacatgtacaaccagcataaacaggtttggaaacaaacacaaacgacttagagtaagtgtgcaccttggctaagaggtgccaagtgcccggggaaatgagagtggtgtctgctagccatcagtgggcatcagtcctcatgatttttagcaagactgagagtctgtaaacatggcaagtttgttaagaggaaattggctaagatttagtgaagtatttacttaaatatgcattgaataaatgagtgaaatttgcgatctaatctcaatcatccctctggcctcaatgtccttttctgtaaaatgggcccaagactagttaagtggcaaagttatcattgacacgagatgagcacaagtgtataaacctggcacccagctcctagctcctgcccaaagccagggttggagcagatctttccgaagccctcagcctgtgaggtctgcatgtcgacaactttttacaaaagcagccaggaccccctggctaccttccctgttgcccaaaagacataaaataggaatgtgatttattgtacccccaaaactcaaatgacaagagacaattaagtacctccctcatggagaaaccctgggcagcctgataagcagatatggcccagatattgagggcaggtagacagggcttgaatcctgattcaacttcatattatctgtgtcttcctgggcaagtgacattatcttccagagccttggtttcctcatctataaaataggagttaaaatgaatgcatgtgaagtatcacatttatgtgtagtacacagtaggtacatcatcagtagtagctactaatattattgttaattattattattgaaagctggcagaaacaggcagcctgccagagaccctctggtcatacaacaaatgaatgttgctcttctgtcctagacaggaaaaagcaatttgccatttcctctcccacttgagttgattgccgtttccttctgattaatatttatgaaactggctttgtgcctttgcaagggaagtcccctgtttgtcaaacagaggtctataaatttatatgataattatcctccccatccattccagtaccccccggaaagcaaagataactgaaatgaggtgtccatgagatttaatgggtgggagactttggccatggaggaactacatacgcaaaacctctgtaggaaatatgctggggaaaccagagtgtcctggactactgggatgtcagggttagaagatcctcagggtttgtctggagccatctctccctaactgccgggagattacaagatacagatgtggtcaatcagcatagacctccctccttctccacaatgattggtttataatgggcacccgcctcacgccggtgcacttgaaatggatctagggattctatcacaagaggtgctgctaagctggagaacgtcgtcttagaggtgccagagctgactaaaagagtctgccagcactatgggaggctgaggcgggcggatcatgaggtcaggagatcaacaccatcctggctaacacagtgaaaccctgcctctactaaaatacaaaaaattagatgggagtggtggcacgcacctgtagtcccagctactcgggaggctgaggcaggagaatcgcttgaacctgggaggcagaggttgcagtgagccgagattggccactgcactccagcctgggcaacagagcgagactctgtctcaaaaaaaaaaaaaagaaagaaagaaaaaaaaagagagagagagagagactgcccaagaagcaaacaaaatcaaaacctctgaaagacagaagaaaccaattcttgatattatttgagtactggatgcaactatgcctgaatttctactcactgaattttacagttgcataaatcaataaattattcattcttgccaaaagccagctgagttttgcatctgtcacttgcaaccaaaagaatactgttaaagtttacccccttatttgatagataaaaattctgaagtccagagcggggaagtgacttgcccaaagttacgcagcaagcttgtggtggaaaccagtatgaacgaaggaacgtagtttcactttctatattttaaaaatgcacattagacaaagcttaaaaaaaattttttttgtaggcagttgccatggttaagatatggtttgtttgtcctcaccaaaactcatgttgaaattggatccccagtgtggaggtgttgggagatggggcctagtgggagctgcttgggtcatggggaagatccctcatgagttacttggtgccattcttgcagtagtgagtgaattcttgctccagtgagactagattagttctcttgggaatagattagttcccaagagagtggaagagagtggattgttatacagccagtgtgttagtccattcttggattactataaagaagtatctgaggctgggtaatttataaagaaagaagtttaattggctcacagttatgcaggctgtacatgaagtatggtgccagcatctgcttctggtgaggcctcaggaagcctacagtcatggcagaagtcaaaggggggtcagcaagtcacatagtgagacaggagcagggaggtgccacacacttttgaacaaccagatctctcatgaactcagagaaagaactcactcactcatcaccaaggggatggcaataagccattcatgaggaatctgcccctgtgatccaaacacctcccatcaggccccacctccaacactggggattacatttcaacatgagatttggagaggacaaacacccaaaccttgtcagctgggatgttcctctgtttttcccttttcgcacatctgcttccctttttaccttctttgccatgttgtgatgcagcatggaagccctcactagaagccaggaccatgctgttgaacttcttggtctacagaatcatgagccaaataaacctcttttctttataaattgcccagtcttaggtatactattatggcaacacaaaatggaccaagacacaaatgttggcttggtatgaggaaatatcacacttgtacactaactggaaagtgtggaaattagtaagcctttctggagagagaggcattttggcaacagaatacttagaaatcatgttgatatttaatgtgtaaatagatcatattataccacaggaccccggatgcatgaatcctgcctcaaaaatatgtgtatcttctcacctaggaggaattccccttgaagaatttgtcctaaggaaataatctaaaaggcctgcaaatatttaggcacaaagatgttcattactgtgttgtttataataatggaatttggggggagaggaaatctcaatagggaaaatggctaaataagaagactacatctataaaagagaataccataaaataaaaaattaaaatcatgttatgaaagagtgttttattacacagaaaaatgcccacaatatattaagtaaaaaggccaggttactgtctgatttataccatgtaacagcatgtgacccaaattaagggaggaagcaccaatatttatgcacatttgcatatgtgaatacagcatagaatatagactacaagaaagaaagccaaagcattagcaatgtttttctctgggtgatatttatttgcttctttgtgcttttctgtgatttccaaatatactacaatgaacatgtgttacttgtataatcataaaaaattgaagtttaatatttaaaaaaaattgatttaggttggtaaaaaataactgggccagccaatgatggatacatggtccagcctctgttagccactttgtagactccacagaggttttgaaataattgccttggacatagaactgcattcatagtctgaattattacagtagcaaaccctggttcataggcagtgcactatatatgttccatgcactattttaattctctcattgacctcaaagaataggcattattactcccattttacaggtaaatggctgaggttcagagagggtaataatcttgctcgaggtcacacagctagcaaggaggcatggttgcaaccctatccagctgattcaagatttagcttgaatcctgtttgactaagcctttaagctggcttccacggggtggagagtctaagctgcagctaaagtctcgctggaaggaaattgtctgcattccttcatcataagcctgcaatggctgctgctcttctctgttctggtagaggctctgtatggcataatgtggccccattttacaagggaggtcactgaggctctgtgcctgagattactcagctagaaaatggcccctaggttgtcggtgaaggccagatgcgttctgcagccttgagtgcatctgcactcagaactcaggctgcagcaagaggagcagcctctcatgggcctgggccttagagaactgccgagttaattgccagaatcaatttgcgctaatcccccgcaactccaagcctgctgagacctgtttctatggcctgcaagcctcaaattgaccgcaggtaatggaagtcatttgtaaagagacatttattgttatcatcttcagctgtgatccaagccatgcctactcttcaaacaagcagtatcgaaagggtctttgagaagggaagcagaggagaaaactcacccattccacctgatcattctagaaatgaaaaggaaatgaaaatggaaagggaggtgctctggcccacccttggcaaagcagctgctgaaagcattgtttaaatttaaggtctgagagtggaaatgggagtatgctgattcattcatgttctcttgtctaaatctatcctcctatggaacgcacttgcccatcattcctcctgcacctattgatcacctgttgtgtacctggaatggtgctaggtactgaggtaacaggtgaaaaagacacagtagctccctgtggagagttcacagcctagagtgagaggcaggtagagctaccgtgcattcagaaagggattcactccaccatttattcatgcataaaatgtttagtgagtagctcctcagtacccctaaactctgcagggactgaagatgttgcgggtcaggttctcagggaagcagacccagagacagttaaggagcaatggagagaacctttaggaggaacacctgtagaaagaatggggaagaatgcagaactgggcagagagacatgaggaatcgtgatacagatcagggccagtcttggccatctgcatgggaggccggggcctaggatggcccttcagcattgtcctaaatttggccaacaagatcaggctttctaccccacatcacccaggaaggccaggccctggggcgaggcagctctctgcagctgagccttccctggcagcagagggccatctgccaatagtgcttgaagagggatctgggctgtgcatccccatgtccatcacaggagagaggacgatgaacacgaaaagcaccatcccatccccccgaaagagctttcctctgtctgaaaaaacaggtgttctgtggagcaacatggagtaactaggaaggtgaaaagtcattcattcattgatctattcaatattgattaaagaactgctgtgtgccaagttccgctagctgctcaaaatgacagccaagacaagagagacacaatccctgctttcattggttttgatatggaggtgacaagagctgcaaaggagaagaaaagcatggtttataatgaaagcagctttaaccgtgtacaaggtaggaaaacatttctatgagaggccttaattctggagcaaggggtgttgaggaaagacttcctggaggaagtgacatttgagctaagttttgaaggctgagtaggtagttcataggtaggtggaagtggcagaagaaacattcaaatggaaggaaatagactgtgcagagctgtagaaatgcaaaatcatacaccccaactggatgaaaagatgaagctggaccctcaactgaattttggaagcctactttctcccagtaattgggggaggttaaataggggttgtgatccagcaactaagacaacccagtccatactttgaggaggttatgccagaaagcttgagttggtgctttgataattcgggggcgggggggcgggtacaatgtctctttgatagctgctgctttttcagccagggaacagttatagtggcctcagttggtgtgacagtgactgcatgagcctatttgatgcagaacctttcacagatgctcttggcagctcctgggagaaggtgagtcacaagtagcctgagtttctgtctcagccatgcaccactaactccatttacaaagctcagtagacaatgacaacatcactctcctttcagggcaaagagcccatgcagcctgcttcctttggactaaagaaatctggatttttcggctgtcatcaatttctaccagtgtctctttaagacggtctcttggcaataatattaagaatagctaatgtttatagaggacagactacatgccaggtacattgttaagtgattacccacatcattttgaataatcctcacaagccctgtgtagggacactattattatctccatgttgcaggtgaggaagagaaaccacttacagagaggttgagtcctttatacaaggtcacagtcagtaattgcctaaccaagactcgaaatctgtttaataccaagcccaaggccaagttcataagcaccatgcaacgtgcctccctacactgccttcatctcctccttcccttgatccctgtatcaacatttgaaaacctggcttctcgcagggctcagaccatttctccagtattaagctaactggcgatggcttttcttattaaaataacttccttcaattatcaagtgcctacacattatagaaatatggttgcataaagttgaatgaagaaaattattaacagttccatgactgcaacacaacagtggttaatattttgatacatttccttccagttttgttctgaatgatatttgctgttgctgatttgtctttctgtagttgatattaaatacacattcactcaactttattataagcattgcccagtttggcatatgtattttgtaatcatcattttttaatggttatgtaatattctgttgagtggaatgaggcaaaatttattggctgtagttttgcacagttaggttgttttcaatttttcacctgttacaagtaacagcagctaacacgattctatccataaagtttttatttcacatttaggattatttcatgaagaaaggatctggaaagtactgttattgcaacaaaagtcataaacaatttacgaatcttagtatctcactgccctcaccactttctgtgagtgtttgtattcgtacacgaggcctctggcaatgaatgaaaacagtgttatttccccccttattttattttttttacacaaataaagcacgttcatgacagaacggcagtgcaagttcttaataaacctgaatagacatttcttccccaagatcatgcgatccatctttctttgagatactgacaatttagtctgttccattcttacgggggtcttacttacggggttcttactttcatcatgaaggaaggttactatagcagcacagaaaactgaaagtgatcattgattctcacgagctcagcattgtgatacaagaataggacacttagggcacccaccttaacagaaacaggctttagaatttttcaacgagagcctcctgtcagttggtcccattagaaggtttcactagcttgcaaaattacctgtgtaactgcagtaaacatatggagacattccagccctcctgggcatcaggtctgcctgcatattgtgaagtccatgctagctgacctccagcattggggggggctcattcctgagctccttgtcccaacccttgtctcctttcttgcttccaattttggctcatgactacgtcccagtttacaaccttatccatctcagatcaaaacctggcacagttgccccattgaagacctggcttctgattcctcacttgtgaggtctccttactcactatcagctgctgcactaactcctgcccctactgccacccctgggtgccaatccaccatcacgtctcaccaggactaaggcaataaccttcttcttagtctcttcccttttgcttttgctttctacagtctattctgcaaaagagtgacttcttttcttttttttttttttttgagacggagtctcgctctgtcgcccaggctgtagtgcagtggtgctatcttggctcactgcaaactccgcctcccgggttcaggccattctcctgcctcagcctcctgagtagctgggactacaggcacctaccaccatgcccggctaatttttttttttttttttttttgtatttttagtagaggccaggtttcactgtgttagccaggatggtctcgatctcctgacctcatgatctgcccacctcggcctcccaaagtgctaggattacaggcatgagccaccatgcccagccgagagtgatcttttcaatgaagctggaatcagctctttaaaatatgaatctggtcaggaggaatctgggtataaccttccaatgatttcccattgaacttgagatacagacagatactctactctcctctgcctcttcaaactcacctcccactacaatatcgccattttatttctcagcctgccctatccacagacatcctgcctcccaccttaggcctttctcacaccattctctctgcttggaatgcccttccctccttccttctttgtcttcttgactcctccaactcctcctcccagtcttggcttaagtgtcaacccctcagggaagcttttcttggctttcctcaaacaggatctgggcatcatctgcctcattgcaccttggtcacagctctgtgcttttcccagatagcatttgttaaagtttaaaagcatgcacttgggaatttgtttaaattgtggtaaaatacacataacataaaatttaccatcttagccattttagaatgaatagttcagtggtgttaagtacatttacattgttgtgcaaccaccactgccctctgtcaccataacccatttcaggtggcaaaattaaaactctatagccattaaacaataacttcagccaggtgctgtggctcacacttgcaatcccagcactttgggaggccgtggcaggcagatcatgaggtcaagagatcgagaccatcctggccaacatggtgaaacccagtctctactaaaaatacaaaaaattagttgagcgtggtggcacgctcctgtaatcccagctacttttgggaggctgaggcaggaggatcgcttgaattcaggaggcggaggttgcagtgagccgagatcatgcctctgcactccaacctggcgacaaagtgagactctgtctcaaaaaacaaaacaaacaaacaaacaaacaaacaaataacttcacattcccccactcccgctagtcctggcaaccaccattctactttctgtctctgaatttgaccttgtagctacctcatctgagcagaatctggcactgcatgtcctttgtgactggcttatttcacttttgttacatccccaccaacagtacacaggggttccaatccctccacatcctcgccaacacttgttattttttgtggtttggatagtaactgtcctgatggatgagaggtggtatctcctggtgattttgattggcatttccctaatgactagtggcgttgagcacctgttcaggtgctccttggccatttgcataccttcatgtgcaaaatgtctgttgaagttatttgcctatcgtttaactgggtttttttttgatgttgttgcagagtgtaggaattctttatatattctgtatattaactccttatcaaatattcaactttcaaatattttctcccatatcataggttactggatgatttttttacagcctatctctctacccatgactttaagattcacgagggcagggaggctgtctgttctgctcataaatgtgtggcaaacacttcgcacagtgcctggcacataaaggtgctcaataaatatttttcaaaaattcattattgaatgaattaatgagtgaatgaatgaaacaatggttgtttggagactcttccggctgggctgcctccctgtccaatacctttcttggcttctgttcctaataaggctcctaatgattcgaacccaagtagcctgctttaagcaaatattagtagcaagaatgttgccacaagagttacgtttttacttccactcctcaccacagcttttccctaatggttaaaaaagtattttatgggaagctgcagtgtttgctggtttttgttgtttttttttcctgtaacgaataacattttggttcactgcaaagctggagcatctccagcaactgtgccaagaataaaaccttgagagaataagagaggggaaaaaaatcagcttggtcaggcaaaaataagccatggaatccctgagaagttgcctgaagccagagttcttgcagaggaggcagggccgggaagctgttggaggggaagccagtgcgatgtttaatttgtgtgctcagaatggaggctggggtgagtcttgactgtaataacaagcattattatgagacgtgcagtgccccccggccagacatcagctccgtgatgctgagagtagggggatgaggtggatatgcatcatgacagtgcttttgaaatggaaatatccacgcattaggctgaaggcagaaccactcagagggagaaaagtgctgcacctgggtcaagagagtctgcaccacagggaatggcatagggcagtcctgtccttggtgagcagagatttctgagaatgctcatatgtggcagcagagcctgcccgtaaggaatgcagcgaaagacaggctctgggtatctggaggatgcagccccatccttatcctcacctccagctcctcaggtgggcgcccggagcaagcctgtttgtcccatcacctgaaatggtctctctcctttagactttctgattccctaaagccaccaacaaaggggtgactctgccagatgctccaagggcagagaccatatctgtcttgttcaccacagtatccctagcacctaggactagcctggcgtgaaataggctcccaataaatatataataaatggatgcatggatggatggatggatggatggatggatggacagatggactgactgtcttacacatagtagatgctcaatgagcatttgtcaaatgaattgacatatccctgtgtaatttatggtaacctcgatgtctgccatagaaccatgggtaagagtcagagatttgatgaatgaatgaataactttgttggatacctggtaagtactgaatgaacgtttgttgggtgaatgaatgtatccctgtgtaattcctcatggtagccttggtttctaatatagaaccacagagaagtagtcagaaaggtgatgactgagtaagtgaatggatgaatgaatgagtctctttcatatttattaatactactgtatctttagtacctattccagggcctggcaaagaataggtgctcaataaatgttcagcaatgaattgattatattaagagtacagcagtgtgtgcaagttaccagccagaagtgcagccttcaccatagaagtgtgtgttcagtatctttttaacttcctaatttgagtatcaaaagcctgtaaaataattaattattaatgctaagttctgaggttaagagacttttgaaaacttaaccgtgtttttttttttaaattatactttaagttctgggataaatgtgcagaacgtgcaggtttgttacataggtgtacacgtgccatggtggtttggtgcacccatcagcctgtcatctacattaggtatttctcctaacgctatcctgcccttagtcccccacacctgacaggccccgatgtgtgatgttcccctccctgtgtccctgtgttctcattgttcaactcccacttatgagtgagaacatgcggtgtttggttttctgttcttgtgaaactttaccatgtttttgctgtatcactagcccaggtatctttgaggacaatcacctccacctcagaaaagttgattagtagttctgaatctctcccctgtaccatccttctcatgctcatgtcatggtcctggtaatgaaaattcaacaacacaggcattagcattatccttgttctcaggtgatatgggcttcttgctaagatgtgatctcactcataggtgggaattgaacaatgagaacacatggacacaggaaggggaacatcacacaccggggcctgttatggggttgggggagtggggagggatagcattaggagatatacctaatgctaaatgacgagttgatgggtgcagcacaccaatatggcacatgtatacataggtaacaaacctgcatgttgtgcatacgtaccctaaaacttaaggtataataaaaaaataagaaaaaaaataaataaaacaacagcatgtttggccagggaaaagaagaagccgtggagtttgggattgcccccaccttctccctgcacatccttgattcttgccatcactggccgcagagctagctcaggcattcacccacccagaagactctgaggaagtccttgctcccctctccacactcacacgcatacacttgtgtgggctcccacactcatgcacactcccatgctcacattcattcactcacatgcacccacacccccacaccctcaagcttgctcacagaccctctcatacacacacttgtataggcttccatgctcacattcatccactcacatgcacccacaccctcacgcttgctcacagactgtcatacacacatgcacccacaaatttgcacacaccacattcacactcattcacatgcacactcatcagctcactcatacaccctcaatccttacaacacaatctcacactcacttatagattcccacttactccaacacacacctcaccacaggcacatccattcacacgtgcatatagtctcatacattcacacttacacactcactcatggcctcacacttatacagaaacactagcacacattgacagtctcactcatacagacccgtgtacattaacacacactctaccacaaacaggcacagactcagatgcacacactcatgcacacacagaggcacattctctctcacattacactcagacacacaccagatactcattttcactccctcattcatatatatttccgtgctcacatttattgtccttcacacactcactcacttccccacatgcacctgtatctttacacactcacacttgctcacagactcacagctactctcacacgtatgcacatttgcataattatatactctcacacacaacaccacacttgctcacagactcagacctgctgtcacatatatgcccaatcaaataatcatttactgtcatacacactctcacactgataaactcacacatttgcacactcataactcatagcatattcacgctaatgcacattcacacatattcattcagactcatacacacccgcacatactcactcccacacttattcatatgtgcacatgcagaggcacactctcacaataacattcaaacatgtattcacacactcacctgccactcaaatgcacacacacagacattcacacatacacccttaactaaccacctgttactgacgtcctcacctgctgcatggctggcaaataatgcgttagacaagggtcaggcagtctagtttctggtactgccttccttccctcattccagaaactcttcttgagttcctagtctgtgctggacactgtgcattagctagctgcacctgtgaccttgagccagtcattaatctcactgtgtccattttttcttccataaattggtggctaatttctaggtcaagacacatttatggagctccccctacaggccatgtcctttgcgagttcctggggatactcaagtgtaagatgcagcctgtcctcaaggagtttgcagttggacatgagaactacgtggccacatatgtaacggttatggatagaattgtgtccctccaaaatttacatgctgaagtattaactgccagtatcttggaataggatcttatttggaaatagggtcattacaagtgtaattagtttagccaacatgaagtcattaggatgagcccttatccaatatgtctagtgtccttataaaagggctatttgggcacagacacatacacagggagaatgtcatctgaagatgaaggcagagatcaggagatgcttctacaaaccacaggacaccaaagactgccagcaaaccacaagaagctaggagagaagcctggaatggactctccttcacagtccccagagggaatcaatgctgctcacaccttgatctcagacttccagcctccagaaccttggaacaataaatttctgttgtttaagccacctagtccatggtacttcatcatggcagcccaagcaaagtcatacattaaccaaaggctattcaaccagaattttctcattcactcaccaggcatttcctgagatggctatatactggaccatgagcttcatgagggcagacgctgtctctggttgatttttcactggatccctaactcagagtgcaggggtcagaaatactataggtgaatagatgaatcaataacagagaggaggaatgaaaaattggcaccaggactctagaaataagtctggtacagccttctcacagtgtggttgagatggaagtgtgatgatggatgggcagaaatacccttgggaaagtaggatcatagccaaagatatataagcactcctggaaataagtcagacgagatgcacagcttgtgtttacatggttcttttctgtatcaggaatggaatcattttggtttgtggattttataacatattccaaatttatccatagcagcataatatattgatattaaaaactgtatttatattcaagtccttgtactccctctttttgcctatctttctagcggcagtgagggatgccatcagaacgccatcaggaaagggagtcaaaagaacaaaaaaaaaatcaagaatcaaagtatcagctttgcatccttggatagatgtttatgaatctataacagaagccgtggtatggaagcccatgtatttcaaccctaatcctaacaagggtaatgctaatgctaatgcccttgttgttgaagtatcaaatgtttgcacagaaaaaaaatctccccacctttttttaaaagtctggaagctggcttcagatatcaagaacctagagcataaaccagaaattggaagaatgtatgaaggcataatatccatttttccatgctgcagagctgaaagaattagcaaagtgtccctcagaagggtcccagggccctgactttcaggttgaataagagacagtggcccttggaaccaacataagttgaggtacatcctaggcccctggctttccaaaccacaggattcattgataagactgacattcaccataactcctgggttagaagcccatggccaaaggagttgtccacacctcatgaagccactcagcgctccctgggctgcagtaaagctatctcctgatgaggctttcagctggaataagaagaatggcctgtgagcccaactgcagatgtgggtgtgctttataccttagcagggtgacggctgtgtcctgggctctggcaggaggttagcagagccagcgaggacagaagccttcctttttaaaaaaatttaaatttttatttttagattttgagtctttctctgttgcccaggctggagtgcagtggcatgaccacagctcattgcagcctcaacctcctggactcaagcaatcctcccacctcagcctaccgagtggctgggagctacaggcatgcaccgctacacatggctaactttttaaattttttgtagtgatggggtctcactatgttacctaggctggtctcaaactctgacctcaagcaatcctctggcttcggcctcccaaagtgctgggattacaggatgagcaaccatactcaacctgaagccttccttgaactcagatgccacctaaggataaggaaaaagggcaaggaaagagaacgcagaattaaccaggtaattgcccaagatgactcagttgccttgattccacaagatgaatatcttcatttgcaggtagaaaaaaaggctcatgggggataaactgagtttattataaagaagaataaagttttcagaagtctgtggccattgtgagccccgtagctccctattacctgtgatttctctttctgcagtttcagttaccagtggtcaactgccatccaaaaatattaaggtattgagagagagagagagagaatacacattcacataacttttattgcagtatattgttataattgttttattttattattagtgatcattgttaatcttttattgtacctaatttatcaattcaactttatcacagatgtgtatgtatagaaaaaaaaaacatagtgtacagggtttggtaccatccatggcttcaggcatccactagaggtcttggaacatacccctgcaaggataaaggaagactactgtgtatatccagtgtggctaaagttgagaataaatctagctgccttagagatactctcagagtctcttgggtttgtagctctttcggagtagacagattcagcaaataaaaatacaggatgctcatactttatctgatgaccctaagctcttggcccccctctcccagtgcttaagtggaaggcatctgatctttgagacagtgttgaggttctttgtagggcccttagaaatccactggtttgggatttgcaaatgcctagctcatgtttgccttgaaccacctctacccattagtgatagacatcgctaattgatcgttgagcctcacaattcttttcaatatagcactctagacagcaacttccaattgatcagaattggtatgtaagctggaattaattggcctcctagacggaatctgaatttaagcttaaggcggaaaaggccagacaatgaatggcagtgccaagaacagaaccagggctgggctcattggctcatgcctataatcccagcactctgagaggctgaggtgggaggaccacttgagcccaggagttcgagtccagcctagacaacaaagtgagatgctatctctacaaactaaaacttagccaggtgtggcggcacacaactttagtcccagcttcttgggagactgaatcaggaggattgcttgagcccaggagtttgaggttacagtgagctatgattgtgccattgcactccagcctaggtgacaaagcaagattctgtttcaaaaaaaaaaatttaatttttaaaacttaaaaaaaaaacaaaccaagtgtctctgctccccagctgggaatgttttgctggagccacagagttctgtgttgcagtacctataactttttttgtggccagcaccacatcatgtgtgtataggagagagggcaccagagattcatcccatgtgaatgtgggtgtagcacaccacctgggctacacacaggagggacaggtcaccaccacatgggctgacattcacaggcaacagagaatttactctgaagcccccatcttgagatcaaattctggcccctgcattttctggctgtgtgaccttggtccagctatttttcttctctgagcctcagtttccacatctggaaaatggagactgttagtattgacctagttgggttattgtaaggattcaattagatatgaaaagcccaaccccggcacatcttagatgcccagaaaatggtacttggtaccattctagactctgcaagacaattcttttgccactaaaatcctcctctttatcatctgctgttaagacatctttctttgcatgcagctctcagaggagagcctcacatttcgagctttgttagtgagtcatttgtacctaagagcaaacaaggaaaacaaatggcataaaagaagggacaactggcattggaagagacctggaatcaaaccccagttgttactttttgctctgggatgctttgcaagagaccctgtatagccaagcctcagtttgtcatttggacaatgggcctaaggacaggtgtccccatgggctccatgatggcaggggagaggatggatgtgtgagtgcctgctttcactggcactgtaagcagagctttcacacagcatcaatttctttgccaataacactctggcctggcacctggcccatggctggtgaggctccctaggcaagaggaaatgaagtttgactcaggcttttgttaatgcctggctgcggctggccagacctgcctcctctggggttagagctggcctcgcagctgagcttggctgggtgcatggggttacagggaagtcggctctgccaggccgagaatgggagactctaagttacacatcactgccattggcagtggacccaggccagaggagagaaagaggcagatcaagactcagcatccccatccctcatgtctggtcctttcccccatcagaggacaaatgttatacaagtgaaaaatgaccccaactgctctcaacctgcaatagttgaggacaccgaggcacagagagggtgtgcaatgcgcccagggtttcacagccaagaaacagaggagctaggatgtaaatcgaggtctatgaacttcccaaacccaagcagttaaccagctaacctgccttctgtaagaaacctggagagtttgccctgaggaaaagatggaaagaaacattaatagtaatcaggcacatatcatgggttgatcaagatatttgccccttttcacatgaatttatctactaccaccctagtcattttcattgtattttactgatgaagaaactgaggttcagacgcttgaagtggcagatccagtgtggcattattgtgtctctgaagttagagtccttacttcggcatccacctgccccagaggcaaatgacttcccctctctgatcttatgccctcctctgtaaactgaggatgatcacagcactcacctcactgaaatatcttaaagaccaaatgagtttgtgaatataaagtggttagaatggtgcttggtacatagaaagagtactgcaggtatttatttctgccattattgttgccatgattattactacccaagatcaagctgcaacaaacagacagggttacgtttaaaaccaggattgtagaattcaaaagtaggtttaagatgcttcacgcctacagtcctggccactttgggaggcccaggcgggaggattgcttgaacccaggagttcaagcctgcagtgagctatgattgtgccactacactgtagcctgggcaacagagcaagaccctatctctttttaaaaagtagatttaataatttctctcctatccccatgtttttgctaccaagacagtggctcccagatatttggacatcacttagcagttgaaaaaaattaaatgataggtagatagatagatagatagatagatgatggatagagagatagagagatagatacatagatagatagatagatagatagatagatagatagatagatgtagcatattccattttctattttaccaaagcagacatttttaaaaaattactaccatcttttacttccattatttcagaaggtaagggcattttaacacctaacggtggggggcaagaatcacaggatacaggaaagccctttaaattaaataaatgtagctttctgaacactctctcaacattattctcttcatttccacaaagaccagtggacacctcatcagaggtcatcccaggttttcaggccagcattttaaaagcactgccttactcccctgccaaggctctgcaggagggtgcacagaggtttggggtgccagaacacatttctaaaataatgtgtttccagaaaagtatcagctgataagtagctggaggaaaaaaaatttatatatatatatatatacacacacacacacatacacacataaatacatatatgtatatatacatatatacacatatatacccacatatatatacatatatacacatatatacacacacacatatatatacatacatatacacacacacacacacacacacacacacacaaatatatattttcctccccaggtaacagcacaaattcagcaaacctaaaagaggattttttataacaataaagtagtaacagactctgatgagcttatcttgcaatttacagagtgtcttagtccattttattctggtaaaacagaataccacaggctaggtaatttgtaatgaacagaaatgtatttggctcatgattctggagtctgggaagtccaagatggatggactatatctgttgaagttcttcccatggcagaagacatcacatgagcaagagagtgagggaagggggccaactttgataaggaccccattcgcaaggtaactaactcacttccggggttaatgacattaatccattcatgagagcagagcttcatgacctaatgacctcttaaatgtcccatgtctcaacactgttgcattggggattctttctaatacacgaactccaggggacacaataaaatcatagcataggggatgcgttaagtagaagccaaagaactccttttataaatactcatctgggaataagcacatggggctcagacacacccaagcaagcactgatttcccttggcatcagttgtgtggagcagcaggcgtgaacgagttgtttttttgcagttgagtctaggctgcaaacctgcaggcccagccagcctccagagggactgagagatgggtggaaggggatctgagattggagcatgcctctctggtgactggaacagcaagccaggggcaaggttccaatgagaaaaggaggcagacacacacagctcacaaggcttaggtttacatgacagatcaatgcaaatttgaatctaattttctctctcacccgagggtctcagtctcgtatccataaaatgtggacagcaatattcagttgaactacatgaaatgccatttttgtgggtcaaaagctgttggtagtcaaaggaactgacaatagcaagtgttggtgagtatgtaaagaagctagaactctcatccattgctggtgagggtgcaaaatggtgtagctactttggaaaacagtttggcagattctctcaaagttaaacataaacttgtcatatgacccaacagttctactccaagaaatccatccaagaaaagtgaagggatatgtacacacaaagacttgtacacaaatgtgtacagcaacagtattcagaattgccaaaaaatggaactaatccaaatgcccatagaccggtgaatggataaacaaaatgtgatacatccatgtaatggaatactattcagcaatgaaaatgaatgaagtatttgatacatgcaccggcatgaatgaacctcaaaaatatgctacatgaaagaagttagacacaaagaccatatatattgtgggattccatttatatgaaatctctagaaaaggcaaatctgtagaatcagaaagcatatcagtggttgcctacagctgggggtgggaagagaggactgactgcaaacaggcaaaagagatctttcgggagtgataagaatgtgctaaaactggatgatagtgatgtttgcccaagtttctaaatgtactaaaaatcattggattgcacacttaaaatggatgaatttatgatatgtaaattatacttcaataaagctgttttaaaaagtcaaatacaggccgggtgcagtggctcacgcctgtaatcccagcactttgggaggccgaggcaggcagatcaagaggtcaggagatcaagaccatcctggctaacacagtgaaaccccgtctctactaaaaatacaaaaaattagccgggcgtggtggtgggagcttgtagtcccagctactcgggaggctgaggcaggagaatggcgtgaacctgggaggcggagcttgcagtgagccaacaccgtgccactgcactccaggctgggcaacagagcgagactccatctcaaaaaaaaaaaaaaaaaaaaagaaaaagaaagtcaaatttttgtggttcaaccaaattatttgcttatgggggttttgaggtttcaatctacaaaaatacaattaaatttctgtttgtgaccacaatggtagacaggtgtgatagattgctaaaaatggctctaattctctgccctttcccttatccatacccttggcaatgtgactttgcaggtcctaccatcaagaaatggggagtcactagacttgctttgaccaatagtatgcagtggaggaggctgggcgcggtggcccatgcctgtaatcctagcactttgggaggctgaggtgggtggatagcctgaggtcaggagttgcagacaagcctggccaacatggtgaaactccatctctacaaaaatacaaaaattagctaggcatgatggcaggtgcctgtaatcccagctactcaggaggctaaggcgggaggatcacctgaacctgggaggcagaggttgcagcaagccgagatcgggccattgcactccagcctgggcagcagagtgagactctatctcaagaaaaaaaagagaaaagaatgcagcgtaggtgatggtgtgccagttctgagtctaagcctcaagagaccttgaatatttactctttttcttcttggaatcttgccacaactaagaacaattccaagtttgccacaactaagagcaatgtaagctagttcactgaagcatgaaaaccacctgatccagcttataaccagtctgctgctgcatatgtggatgtggtcatcctagaacagccagtcctcagctgacttgccagctgatcacaggtgcaacagcaggtccaaagtcatctgaccttggcccaaatcaacagaaccatcaaattgacttatagattcatgagaaataataaattcttgttgttttaagcccctaagctttgagggatagtttgttatgcagcaatagatagctaatagagttggggtttttttaatttgttttttcaccacttttgaaaggtttgtttggaatggcctggcttaaaatataggtggtataaatgaaagcttttctgggagcatcatgagttactgcaatcaggaaggacattgtatgttctaagatgatgcagtggaggaaatggacaatggcctcaaataggaaccccaaattaaaggccataaactgagttgcagatgctaatttgtgatccggttgcatctcacacaggtaactcttagaggcacctctagggtgagttacagtaaggatttatttatttaacagtagctaatggttcttccaagacatgccagggagccaagctggaatattaagtaaattaatggcatacaggaggtactccgtgtctttatacaattttcagagaatggagaagaacagattctagaagcactagacgcatttaaaagccttcatgacagagtttagaggctcagagtccaaacttctttgacttcacaagttaataaagaggttggtccaaactttttctatggcttatatggctgtgttcaggatatttagtattacctaagtaacgtattcatatgggtttgtttccaagaaatccccaactttgatttttcaccactttggtgtattgagagaagatccttgtctaaaaacccattgcctaaaggaggaagacaatgctttggcttgtctggtcctagattgagctgtccagtgtggcagagccagatatgggcgttgtcattgtgggtggctgctctgctccttccctgttatgaaccaaaagcttgtggccttcccaatttataccttgaagccccaacccccaatgtgatggtattaggagagtaatcagttcaagagggtgaagccctcatgatgagattaatgcccttacaataagaggcacaaagtgtgtgtgctctctctctccctcctccacccccctttgctctgccatgtgaggacacggcaagatgataaccatcggcaagccaagaaaatgggcctcatcaggaaccaaattggctgacaccttgatcttggactttccagcctccaaaactgtaagaaataaatgtgtattgttgaagccacctagtctatgatatttcattatagcagcccccatggaataagacactctccttgccccatattgggggagcaaagagaaaggatgaggttttggcttttctaagcccttgggtacaggtctttattctctggctgttagagaaaatctcccttacttttcccatgggcaagctgacaaaagacaaacctaggggattatcagaagggagcaatggagatgctatcaactcctgtctttaacagatggaattttttcacatctctggtcaaaataactaaaattccttagaattttagatgtgggggtggatcattgaattactacctccggaactgcgagaaaaggaaactgtagggaaaagaatcttatatggaccccatgcccataccaaatgaccaacccaggctcagagaagtggacaagaatttgcgtaattcctgaaaagggcgatggatgaacctcaaaagacttgctttggattgttcttttctgaaaactggctgtgtggctttgggtgagtcactatccctctctgggcttgagtttcttcatctgtaatgtgggggccataaacctgccttcttcgtaggcttgattaaaaaaaaaaaaaagcaaatgagattaaggttggcccttttgcacagtctttaaggggtgagctgtgaggaatggtggtcactatagcttcagatcttctgcccaagagaagcccaacctttgttcaagccttctgaaaactgccctgtcctttactacccattatggctaccttctctagttacctaaaagattactctcccttttggagcccctgaatcttgcagcctcctgctggactctgtctaaaccaatcttcacctactggacgtctattataggtaagacccaggagagatggaatgaacagcaggatgcagttcttatcctcaggaagctcaaagcctaaccaagaaggcaagacgggtacaggtgaagagttattagctctcgcttctgcatcctcagggtttttcacattgaattattgttttgtagccttctcctctagagcagtggttctcgagtattgctatgcatcacaatcacgcagtgggactattatttacagattacagggtcccacacccagagtttctaaattagtagatagagcctaagaatctacattactaattagttccctggtaagctcatgctgttggtctgcagactgcactttgagaaccactggtctgtattcagagtttttgaagacaggtgctgtgtcttaattgtctcaggagtctttgtctaacatttgttttaaacttactcttgttacaagaccctcctcaaatatcttcttgtcctggaagcctaaagtgactccctacacagagggagtagaactgtcttgtggtttctcaagcacagctctctattttaatgcatatatgaagctgtctttcatctgtgcagatgtttgctctgccagactgtgagctccttgaaggtggggattttgtctggttgttttttccccagaataagaatgctgggtatatacatgtctagataatggtttagatggatggatagatggtgaatgaatggatgagtagatgtatggatggatagatggatggacatgtgaatggatgggtgagtggatggatggatggatggatggatggatggatggatggatgcatgcatgcgtgcatgtacgggtggacagataaatgaatgggtggatggatggatgcataggtggatggatggagggatgggtgagcagatggatggatggatggatggttggtaggtggatggatgaatgaatggatggatgggtggctggttgggttgatgggtggacagactgaataaatggctatagtacaaagccatagatgggaagaagtatatgttaatagagagaacttgaacccttagacttcatttgttgcctatttgggggaaggtggataatgaaaggcaaaacaacctctcctgagggttgactctctgcattcgtactctgtgccctgtccttttgggccttagcttcccccttgggcaaaagaggggagctggatgagacaaccactaaaagttttttacattttgagctgaaatgattctttttcataaaatgaaaaataatagcaaaagccaccatgtagtgagactatgaatgtgaaattagcacataaatcacttggtacagttcctggaagatagtaaacagttaacacatgtcaggtattttcttcttcattgtcattattgtcactccataatgaatctaggtctttaccaatatgaatcccttcagtaacttcacctctgtggttttgagaaatagctggtatcttaacaaagtctatttcagagtaaagaacaccatctaaggataaggagggtcattccataatgataaaggggtcaattcattagcaggctgtaacaatgataaatatgtattcacctattacaaaacttcaaaatatatgaaccccaaactgacagaactagatgcagaagtaagcaaatccacaattataatcagagatttcagcatcccatctaaataattaatagaacggtagacataaaattaataagggtttagagacctgaaaaacatggtcaaccaactagacctaattgacatttatggaacactctacctaacaatggcagaatacatattcttaaagtgctcataatatgagctcatattatgggtcttaccttaaaatatggaatattttactaatacaggttatattatgagccataaagtatgcctcaataaatataaaatgattcaaattatacaaagcatattctgtaaccacaatagagttaaactataaatcaataacatatctggaaaatttctaatatttagaaaccaaaagcaaacttctaaataaccaatggggcaaagaagaaataaaaaaattaaaacctatttgaaataaatttcaaagtacaatatatcaaaatttgttgcatgcagctgaaacagtactgaaaggaaaattatagcattaaatggttatgttagaaaaatagaaacgtctcaaatcaatcacttcagtttctaccttaacaaaccaaaaaaaagaagaatgtcaaacccaaaagtaagcaaaataagggaaataataaagatcagagcataaatcaataaaatagaaaaaagtaatagaatcaatgaaagcaaagctagttatttgtgaaaaattaataaaaatgataaacctctagccataattatcagtaaaggaagatataaattactaatatcatgaaggaaagtgataacatcgctactgatgctatagatattaaaaggttaattagggaatgttattagtaacattacgcaaataaactcaacaacttaggtaaaatggacaaattccctggagaatgcaagctacaaaagctcactcaagaagaaataggttgcccaaatagcccagtatctttaaaaacttgaatttgtaggtaaaaacattccaaaaaagaaaatttcagatccaggtgagttcgctggtaaattctacaaagcatttaaggaagaaataatacaatcaaacacaaatattttcaaagcataggagaagagggaacttcccaatttattctatgaagccagcactagcctgataccaaaatcagacaaaggcattacaataaaattttagatcaatattcctcataaacttagacacataaatctttaacaaagttttagcaaatcaaatccaacaatacataagacaaaatatatcttatgatcaagtacagaaatgcagagttggtttacaacttgaaaatcaataaatggaatttgtcatataagagactttctttaaaaagggaaacaaagtaatctcaatagatgcagagaaagtattcattagatgttgaaaaaaatcaacatttattcctgatttttttttaaaaagtcatcaatccaggtgtagaagggaacttcctcactgggtgaaatggctcaagcttgtaatcccagcgctttgggaggccgaggcaggaaggtggcttgagctcaggagtttgagatcagcttgaggaacatagtaagaccctgtctccacaaaaataaataaataaataaatattagccaggcatgggggtgcatgccagtgatcccagctactcaggaggctgaaacaagaggaatgctgagcccaggaagttaaggttgcagtgagccatgctcgctccagtgcactccagcctgggtgacagaatgagaccctgtttcaaacaacagcagcaacaacaacaaagaacagaacttcctcagctggataaagggtatctattaaaaaacaaacaaacaaacaaaaccctacagctaacatcatccttaatggcaacagactgaatgctttctcctttagatgaggaataaagcaagattgtccggtcttatcatgtccattcaacattgcccagggcaacgaagcaaaaacatataaattgaaaaggagaaagtaaaactaacgttatttgcagaaggcataatcatctctgtagaaaatcctgagaaatctataaagatgccactagaagtaataagtgagttttgcaaagtcagtacacaaaaatgaaccgcatttctataaactaggaacaaacttttggaagttgaagtaaaataatctaccacaataatatgaagaatatgaaatacttagtgacaaacttgcaggcgttattcaagatctgtactctgagaactatgaaatgttgctgagagaaattaaagaagacagaaataaatggagagataaattgcatttatgggtcagaacacttggtattaagatgccaatgctcccaaacattgatccatggattgaaggcaattccagtcaaaaactcaacagacctttttgcataaatttacaagcagattatataattaatttggaaaatcaaagaacctagaagagcaaaaaaaaaaaattgaaaacaaagaacaaaaaggacctacactgcttgattttaagatgtattataaggctacagtagataaagtagtatcagtgtggtattggcataaagatacacagatctgtggaatagaatagagctgagaaatagacacatacatatatgattaatggattttcaacaaaattaccaatttaatgggggaaaggaaaatcttttccttaggtgatgctgaaacaatttgatggtcatatgctgaaaaaaacccaccatatacgaaaaaattactctaaatagattataaacctaaaagtaagagttaaaaatacaaaatgcccaagagaaaacataagagaaaatcactgtggtcttgggtatggcacaggtttttaaaacatgaaacaaacacaaactataaaagaaaatatcaattagttggagaaaatcaaaatttaaatattttgctctttaagagacacttacaaaaatgagaaagcaaaccacaaacttggagaaaatgtttataaaacacatatccgactgggcgtggtggcttacacctgtaatcccagcactttgggaggccgaggtgggcggatcacctgaggtcaggagttcaagaccagcctggccaacatggtgaaaccccgtctctactaaaaatacaaaaattagccgggcgtagtggcaggcgcctgtaatcccagctcctcgggaggctgagacaagagaatcgcttgaatgcaggaggtggaggttgcagtgagccgagattgcaccgttgcactccagcctggggaacaagagcgagacttcatctcaaaaacaacaacaacaacaacaaacatatccaacaaaggtttctgtctcaagaatatatgaagaactcacactatgcaaaaatttaaaaatatgaaaaatgaaaaaagaattgaacatacttattagtaaagaaaatatatcgatggcaaataaacacatgaaaagatattcaacatcattagtcattaaggaaatgaaaatgaaaactgcaatgagatactaccaccacaagcccagtagaatggcttaaatttgaaaacctgattatcccaagtattggcaaggatgttaagtggttgagactcatacgctactaatggaaatgcaaaataaaacagccaatttggataactattaggtagttctttaagcagttacacatccacctgccatatatataacaatttcactcctaggtatttacctaagagaagtgaaaacattcaccctcacaaaaacttgggcaaaagtccttgtagcagctttatttgtagtaacccaaaagcgggagcaccctgaatgcccaacaataggtgagtgggaagacgaattgtgatacaggcatacaatgaatacactggtgtcttgagttttctgatccgtctagtgggtgacagtacctgttttcttttcctttcttttttttttttgttttttgttttgttttgttttgttttgttttttggagacagagtctcgctgtgtcacccaggctggtgtgcaatggcgcgatctcagctcactgcaagctccgcctcccgggttcacgccattctcccgcctcagcctcccgagtagctgggactacaggtgcccaccaccacgcccggctaattttttttgtatttttagtagagacggggtttcaccgtgttagccaggatggtctcgatctcctgacctcgcgatctgcccacctcggccacccaaagtgctgggattacagacatgagccaccgagccaggccggtacctgttttcttgacagcatcggactgtatgggaaatctgtctgctatcagagaatttaaaatgtaagcacttccaaaggtaagtgctgaggtctttttagacccacctttgtaatcatcacacccagagtccatatcttcatactgattgagggattcagtctcatttccacagatttgtgtagttttaaggaatataccatataccttaagaatataaataaatatggttacttacttatcttcacatctcaagcttcatacctttgcaaaatggggaaaaaggggggctctttgaccacactcagggatttgggcttgggaaatatggtcagtaggcttgatttggtttcctaccctaccttctcttggtgtgtctttttattcattttggattcccaggagcatgatgctatctcttctctttgactttatttaaggagaggtagtgtattcctaaattataagaaaatatggattcaaaacttagttcttctacttactagctgtgtgaccttgagcagattacttaacctctctgtacctgtttcctcatttggaaaatgggaataagcagagtactaccccctggagctgttgaaagcatgcaaagctcttaacattgggcccaccctaagtggacaacaaatatttgttattcttagtacatgaacccagtttcaggagagggtctgaaggtcggattcatcttatcactcagtgttataatggtcactctcaatagatgaccacccagacagaggttgcattttaatatggtcttgttacagaaaatagattctaactgggatttggggcatgattaaattggtctggggtagaggaagggctgggagaagggcattattgtctaggaccaaattgtgtcctcatgacaatgaagactatatgagagactcattaaaatcagcattttttgctaaaatagaataaaaatataaagagttttaataaaaaatttaaaaatttgcatcttcgagccaggatcactggcgtgcccctgtaatcccagctactcgggaggctgaggtgggaggatcacttgagcccaggagttcgagaccagcctgggcaacacagcaagacctgtctcaaagaaaaataaacaaaataaacaaaaccagcatctctgaggggcagcctgggaatccacattttaagaaactctccagacaattctcatttccaagaaagtttcagaatcccagtctaaggcatatatatcagaatgtatttttttttcactatctcttgctatgacattcttgtatttctctctcctcaatttctttttcctacttttgtgtatgtttgggcaaggggtggcggtggggggggggattgacccaaaaagtccttaattacctgaaaattttttttcttattttgttctttttaggacttgtatagctgcattttaaaaaattgttataccttggcaataatatatatgtagaattgtatattctgcatcaattaacattatgccatatgtattatctcatcctgatacattttgtctcaggccttctcttcctcacctcttgcttctgcattcaggtaactactcagtgtggacagatagatgcatgcctgtgtccatgttcataccatcctactcaaatatagacagattgcatgtttgaaaatttgacatattttggtttctcttactgtatgtattttataagcactctggtatatttttcttgaaagctaaatgaatgaataaacaaaactaaaagagatatggttggcctatgcctgtgcttaaagcttcacatgagatttctatagtggagaaagttgctttacattaatgaggatcatatttactcttttagtcttacctgcaattattgggtgaactcaggtctctttagttcattaccccattagtgcctgtcaataacggagaatgtgcctgaaatgctcaagtggctgggagctttggaaatctcatctcttctaacggagggcagctctggcttgtgcagtggggagcttggatcctggtcctgtgggtcactgcaactcgggtctctccctgagccttaatttccccaactgtaaaagatagctattaggctaaagcagtatttctttcaatttgccctgtgggccatctgcttcaaaatcactcacacacgatttaaaatgcagatccccagagcacactctagacctattgaatcacaatctggggtggggcccaggaaccttcatgcttaacaagtctcacaggtggttcttatggattattacaggctgagcatcacagttttgtggttaaatattctgtgtggttgaactccaaactcctttctattctttgtcaggcagaaagcgattggcctgggctggttagcctggttctcatctccatgctcaaaagctatgtcaggctcctgggaagggatgctattgatacctggctacttgcctagctgctgtggcctcccacaggtcatggacaggagccacagcaaccacagctggcctgccccataatagctcagacctcaggagggcactccagcattgactgggcatccagtctacagagggtacactgggatctgtcaagcctcctcttacagtccttagggggacatgcctttcttcccagagcctgagattaaagctgaaatcctaagcatccaacatatatcaggaacccagtgcaagtttaatgaatgcatacagaataccgagtgagtggtgtactctggggtggataaaataaggagtgtggggtgggatcttatgtgcaagccagatagtggtggccaataaatacttgttgagcaaatgtatgtcactaagtgaaattcaaatacctggtgcatagtaggtattataaatgcagctatagtaagtcaatttaatatctgcccctgcttatcccccatatgccttcagcccttaacattgcattgtgctgacccctaactgttatatttacatgtctttggctgaaggccttctctactgcctgcaagcacggcagcccggaaatcctcaggaattggctcatgacctccagcagtcctggaaccaagaagtgattgaagttggtgtataaataccccagctccctcactcctcagaaggataactctgaaacaaacacactataccatctgtaggagtcccccagtggagtggagccccagatgctcatggaggccatttgcttgataacacgcactgtctttggctcccgtcctgttttctctctcacttctccactcccctactgatattttccaagatcacctcccaaatcaaccacttgcactcaagtggtcagcttaggtcagctgctgagggacccatgctagccttagggtcagctgctgagggacccatgctagcatgactgttgaattaatgaaggactaaagatttaatgaacagaggtggagggctagcatactatatgcttaaaacataggaagcctttgtgggaggttactgaatgaatagcattcaacaaatgcgtagagttcaaggtagatccctataaatcttgtacttgaatttctggtacaaaaaaaatgcgttttgaaaaagtgaatgaatgaatggtcattgaaaagagtcaaaggctagaagtttatgctttggtacatagtgttcaataaatgctttttgtatggatagggaagaaaaaaggagggaaggaaggaaagaagggagaaagggaggaaggagggaatgaaggaaggaagggagggagggagggaggggggggggagggagggaggaaagggaagaaggtgtctcagaggcttggagcttgaagtagccaggcactgagcattcatgaagtggcctataaaaccccccatggtctggtccttgctcagaccacaggttccccttgcaccactcattccctttttcataacacttcacatcagcctcctttcagctccaaatctttacaaattctgtttccttggtcaggaatggtctctttttaagatgtgtctccttacacttaactaagtctcagccaagaatttgcttcctctaggaagccctcccagagttctccattatgtcacacgtatatgtaactataatacctcctgtatcacctggtatttctcacttatgtaattagctgcttaatggctgactcttcccagtggaatgaaaactctcttccatgttctcggggctcatcacggcacctggcacatagtaagtgctcaataaatatttgatgaaggctcaagtgagtgatgcagccatagtgcctggtctggctttaaccttagatctagggctttcctgggaagagccgggcttccagaaactttcatctacaggcatgctgttcccactcccacagcaccccaaaccagccaaatggcaaaatgcacccaaaatctgggaaaagccttcaacaaatcatcttagaatagttacagcttctgtcccagccagcactgtcacaggcagcttaattatggtcattaggacccacattaaaacatgattataacataaaattgaaattagctgtataacacatccaaatttttcggtatgcttattgattttcctcctctattaatcagagggctacagtaaattcagatagatctggtataattaaaaccgagcctgtaaattccagtgaaaactctaattagcatctgtcttttgttaaggatagcgaggtgggaatgtatatttttccgcgaaacataatcagggctttcatgtttctttcctggatctttggtggggcaggttgtcattcctttttaagaggaatttaaaattggtttgaaaaaagatgcaagtcataaagacatctaagagatgccaaaataagaagtggttggttaaaagaaaaatgattagtcgaaccgggtgattggaggcatgtggatgaaacaaccaattgaattgttctcttttcagtatggtggagtggctttgaaatcagacaactttgagttcaagtctgaactctgctatttactacctaggtgatattgaaaaagtgctgttttacctagctgagcctcggtttcctcatctgtgaaatggggataatgatagaacctaccccataaggtatttggaaggattaatgagattacagttttttcagcttgtagtaaaatattgataattaggagttgctaccatcttcatcatcatcaccaccatcatccacaccaccaccatcatcttcatcactatttacatcatcattattattttcatctaataaagagaaaactcaatgcttgtcatggctttaatgagcttcatggcatagtgaaaacatgactttgaattcaggtagccttccactctgtgccactcataagctatgtgacctcatacaagtcattatatttctctaaatctgttttctcatttgtaaaatgagcacagctttcaagaggatgttgaagaagtaatgaggaatgttgattatgcctggcatggaacaagtcatttaaccaatgttgactccccatctcccatatccagtcctgtatcctcaacagactgcttagttggtggtatatctcaggcaagtacagaatataaaatagtctctgggtttctaatcaccagatgtctttaagaggcatcctgttggcttttcagtactgcctcctataaggccagtgttccattgtcatggctttagttgctggggagtatttatgtcatcatagaagggattgtagagctcatcacacattccacctgctcccctgcatttctcagctttctctgtggccagagtgaggttgtgtgactacttctatccaatagactatggacacaaacatggcatttccatttggagagagggaaagagcagtggtcagaaagccatcactagagataacaaaactgcagaatgggagtgacagattatcaagtcactgcagggaagacggttgtcctggaaagcagctgaaattccacaggacttttgtgagcgaaaaataaaccattgttgcattaagcaactccagttttgaagtttgttacagcggcatacgctaacctatactgattaaaacaatgatgatcaatcaagtccatttatctgattgtggttcttgctctgaatgcattagtgggttggtggatactgccctctcaggggctgatggacttacttccagagcagattttgggtagagcagatggaacctggaactcctgagtccagagatctgtcatgacactcgtgcccttttatgcaatctgaagctgttcccttacagttcacatgccttaaatagctgagaggaaggaatgtggacagcccaaacatcaggggcctcaactggctcctttacagtcacatagtccccctgggcatattggggtgcccagtggaattaatatgtggaataccatgggcatctattgttttccctgaccagaatccacactcacctttatttggataccagcaccttaattttgttttgaaaaccactgattggatgcaagcttggtgggcttttcaatcaaaaggcaccatcctcattttcccaaaagggggcacatgactcagcctcagtagtgattcatgccaaagtgcagccacttcgaagaagtggggagggtccctgcttcctagatcctcagaactggtttggtgctctcccaggttcaactccctttggtctgtgagatactcctatctttctaacacagccctccaacccttttctggctaaatgtagtcagcctcagttcctttccaccaaagaaccctaagaaatgtatagtcatgaaggtcatcccatgtcaacaaagcccctgtcatacgctggtgccttgctgcactctgttgtctcattattctaaccttggaatgtattttatgtctgatgtaaacataatcataaacgaagtcaacataactcagtagataaggaagatgtagttttatgtattcactcgacaaacatactgtgattgccaactataagcaaatgcacttctaggtactaagaataaagcaacaaatgaaacagatttaaaaaaaaacaccgccctcatgcaactgacattctagttggaagaagcagacataaacagcgcaaataagtaacaatataatattcagatgctgagacgtgcaatggggaaataaaacagcgcaggaggacggagagaacatggaacaggagctgggggcagatgaagaggcatcgcaattttaaactccttgttcagggaagaccttgcagagattcgagcaaaacctggataatagagttgtgtgttctcttgttcatgtctccaaattccattttgcaggtgattcggtttatagggttgttgtgggaacaggatctgacacttaataagtacgcaataaatatcatctggaaaacgagctcgaaggagccgccattcagatgccaagtcagctctgggtgtgtggggagcgtcagtgctcaccctccaatcccaagctgtcacaccgaggctgctgcatctcagaggccccatgcagagcaccttctccttcaggtcctgggaactgctaaggctgaggcctcagaagttgttgggccttcagatcaccagaccctgacccagactgctctaattagggacatccaacagagatgggggcaggtggggagagagagagggaaagagaaaagtggggagaggaagagaaagaggaaagagagggaggagagggagaggaaagtgagacagagaaagaggaaggaggggagaagagagaggaagagaaaggagaaataggaggaagagagagagaaaaaagagatggtggagagagaagaaagagaaagagggggagagaggagacagagagataaagaaagggagagagaggtgagagacagacagaggaagagagaagagagaggggaagagagaggaaagagggaggaagggaagtaagagagagtggaagagagagggaggaaagagaagaggagagagggaaggagggggagagagcaaagagggagagagaaagtagaaagaggtaagaaaagagagagaaaagagaaagagggatagaggaagaaggaaagggggagatggaggaagaagaaggagaggaagtagagggaaggagggagggagagagaacagaaaagcagtgcactaggaggtaggggattgtaactcattggagagaagcaggtagaactgtggggcctctgaagtgggttagtggctttgacccaggtggctagggtacagttcctccaacatctccagctcctccctgctgccctatcctgactacattcaagaaatggtccagggcatggatttgggatataggtgaacctgggttctcctgggttcgaaccccatctctgccattgcctggacaggtgaacttgagcaatcccaccactctttcattctcaactgaataatatcaacttcacaggttaaagtgaggatcatgatgtggtttacggaaggcatgctggcatgtgccaagcacacaaggggtgcttagtcaacattcgatgctgctgttatcactctaaccaggtttggggattagctctgtcctggctctgggtccttggactctggggtgaactcagcccctgaggagattcctggtctctgaaactttcatgcaaagccatggttatggttctgaacaggaactttctgtgcagtggttcttagtcccagctgcacaccggaatcaccttggaactttaaaaaaatacagatcctgggcccacacccagagaatctcacataattaactcagggtgcaacctgggcatccgaatttctaaaagctccatggatgattccaagatgcaaccaaagttgagaagcactgtctagggctttgatttaatcttccatatttattcctaaagaaggagatatacccagacaccatttccttaggcagccacacagaccactggattattaatttttttcaaatttggttccagaaacatttgttaagcatctactatgttcctggaacattgttagccactgaataagcactgttcctgtcctcaagcagcttgaagtctgggtggccatacagtgagtaaacacagtgcttgagaaggccacaggagcggtgaggaaagaaacatcacccaaatgcaggaatacgttggaaagaagtgggtgcagggtcacacctaaagcacaacgtggaaaaatgagtagcagtcttctctagtagagaggtagggggaaggtggatagcccatgctgttcagggttgaacagcatgaacaaatgtgggttggtgaaaaacttctagggagaagggacaaaatgaggagggaagttgcctataggcaggactatatagcaaagggtgaaagggtaggagaggaatccaggtagcaaaggtcttacagccaggcttagatctgtggggttcatattatgggaactggggagccatggaaggctgtaggttaaggggaagcctttatcctgtgcttaagacttcagggtgtggctgctgttaagtgctggagtgtggggcatctgaagaagaaaacgtctgtgcttggcaatttcctctcaagtaattttattccattcccttccatcatgcagaaacctgaagttatcctgagaacaaacgtcactgccatggaaacagtaagagaaacaaacaatgcgtgcactgtataaaattgtacataaaggctgtttatttttcatgccattattttaataggtggggatggcagtgatgggctggaggaacagcaggctttaatggtgccgctaatgttgcctattcttaaaatgacttgaaatgctcacagacattcagccattggcacttagatcatgtctctggctgggaactcccgctggtttcgagtctcactgccgggaagcatcacctgttcctggaactgaaaggcagtatggccaagcggttatagactcaagccagaggtcagacagccctgggttccagtcctacttctgtcacacttaccgattgatgactgttggcaaatttcatcacccctccaagcctctgtttactcatctgcgaagtggaaatatagtcattcgtttattccttcatttgaaagttaacaaggcttcactgaaaacttgctatgtgctttgttctaagggtcctggcatccactgagcttaaagtctagtgggagaacagagataatatacctgcaaacacataaataagagacataattgtagatagtgatagaggctaagaaagatttaaagccaaggttgttctctctgatgagatgccagtctagctggccacagaaagaggaggaagagccagctgcttatatatcagaaggaaaggccttccaggcagggacacggcaagaggaaagtcctagacagatctaagattagaatccttgcagctggggttttataaaaggaggtacaagataaggccaaacagggaggagagaccagatcagaagggtcctacaggataaggtaggagtttgggttataataatactaaccttctagagtggttgtaaggattacatgaaatctcaagtggtaaactctaagcagctgcttaaaaaaatgtcagcttttactttcatcaagacaactgtagcagaactcatcatctcttgggtccagttgctgacatcatagaattattgaatttcagaagtgagagatcatttttcctaatttttcatatgggtgaattaagggcaagggacttacagaagtcacacaggagttagtggtggaggctctgggctttccaatttctgcccgctgtccattgagttcttgaactcaagcccatgccatgatctctatggggaaattccttggcttctgtttctgctgggtggtacttccttctaggggacagtgtagggtcatgaaaaaccacagacctggtgctgcgagtgtgtggcttctccctgtgagcctcagagtgtccacagacattagtccttcttccctcctcctgacacagaggctgtgtctgtcctcctgtatcctcctcggcacagaagctgggcgttggctggggagctgagagaaaggacaggctattgatcagtagggacctgacccagtatggccttttcaatattccatactaagagagtggtgagatttgagaggaagtcaaagggctggagaatgttcctgtaattgaacagagcagtgctgccttagttaatttcgagtgaggaggctcacacaaaaaatgggtcagattgaccaagcccctgatgggtttggaagttttacttattctgcacccttaaccccagctgggctttcctctgggtatagacacccataaatacacataataaaccctatgagagaagagatttttctagcatttgggttctatttttcatatacaatttatataatgcatgatcattgctcctgtttattgagcacctactacaggctggacaatcagttcagcagtgaacatgcatcccctcttttacttccataataaccctaggaagtagttattaatagtcttcaccttatacagacaagtaaatccacatttaaaagttagtcacataggacagagttctgatatgtctgattccaaataaacctgctgattccagagggtacatgaactcatggggtccccaaacacaaaagtcttagaataactcatagatgtgtgctgctgtgctgatgtgtgctgctgtgctgatgcaggctgttctttatggactgaaaaatgtatgtgttacagtttataatgccaaaagagtgtataaatatacacagtatctttaattgatttttcttctcacctttgaggcccaagaacataacccttagtcaggaaaatctcccagcttggtttgcaggaacttgactgtgggggcccaatccaatccaatatgtttgtccctctctttcagcctcctccacgttcccgatggtgcactggttttctttcctgtctgaccaacaagcctctggagagtggccaccatcttacaggctcactttgtattctgtaaactttcagttggaaaataaacacactgtctccctgtcaaagctctaccgtgcatgagtatttctcaagagccagggcggatggtagagacagaccaagcatttccaaggaaaccaaaggggcataattgcttctttccaggtaatgtggatgcactggatggggtcggctgcgtcacagtggatcattttcttgttagcgtctggccagagtgatgtgagtaccacgggcttcctgaatgacgctgcacaggcccatctgcaagttacaaagaccaaattgaaaatagatcatggagacactggttggatactctgccttcccttgaaagatccacggtgggtttgtccactgagacatactattgctgggacttttttgtttcttttcattttcttcttatcttttaagatgacttttttttgtatttcatttttaccccaagacaaaagatttttctctttttttctctcagtgattaaaatctttccatcaaccaggtgttcctaagggggatacatgatgcaaggtctggcagggtgggggtgtgaataaatgtgcattgatggagaaagtagtcactgagcataggctgtctgatgacctcaaaatcaagcccctgattaatcataatctgagtagacaaagaaatgggatcacagacacatgacgacaatgacttccattaattgcaatgatgctgttttagcctcaggaccttgcacttgctgtgttctccaccaggaatgtgctgcaatctgcgcttggtgtctgtctcatcattcctttctctacttaaatgtctcctattctaggaacccatccctgatcattcaaaaagaatttgcctcttttactctcaaatcaccttgctttatcttcctcatagaattaaagctctctgaaattcctatttattaatgactttatggtctatttctcatctgtacaaaataagctctagagagcaagaactttgtcttgttcactgtgtattatcagtgcccagaacagtgcctgacatatgcactatcctaagtgctttataatgattgtgtcattgattgctaaatgatagccttttgttgaaatgattactggaaggttaattcagttgttcaaaatcacaccactgctagttagtggcagataaaccatttaaattgaggcttgttgggtttgaaggtccaggcttttaactgctctgctaaactgcctcccctggcatacagcattaattttggaagtggtttgggcccttgtgttgccagacttcactagactgtcagccctggagagccagagacagagtctgttgcatccacagcactcagcactgcttgccacgtggtagccattcaataaatagtaaatgctcaaacagtatttgtagatagatggacagatgggtgagtgggtgggtggttgagtggatggatgggtagatgaatggatgaatggaagggaggagggaaggaagaaaagaagacagaaagggaggaaagaaggaagggtaggtagagggatagataaattgctggatggatgcatggactagtaaatacatggacaaataggtgggtgtgtagataggtgggtagatgaataaggaaacagagtcccagagagactggtgactcacttaatatcacacagcattagcctttagtccatcagttcatgggatcttctctataaccctaggaaataagtgccataatatcccctcatccacgaggatattattatccatttatgtcaatcactccatgtgataagtgttatttttatccctacttctcagaagaggaaaataaagctcagagaggttaagtaacttgcccttgtcatcctataaggaagaggcaaggctaggatataaccctttgtcaccactgtactaattttaaccgcataagagctgatgctctgtttatcacatggcaaaatataaggtgaatagaattgtaggcacacatcatctaatcagcagagaagctaaaattatctccccaggtggcattgggtaggaggaagctcaccctgacaccagaatctaggcaggatgtgccctattagacagaccacaacatcactgccatggaaacagtaaaaggtaaaaggtaaaccaagtgtgtgatatcgagcaagttactttgcctccctggccctcagtttcctcatctgtaaaatggctatcaaaattgtgattgcagattttcatctgcaaactgttctagtccctttcagaattctatttctattatgctatttcttcttccaaaaatagtcttgatactgctcctaaataatcactttatgttcccaacatcacaatctcagataatcaggtctgtgtctcatttcctcaagacttttctctgtgccttgttttagccagcaaatggaatgagtaaatcacggtccatatgttcaatgggttaatggtttacagtgtcacttcttccacataagacacctgcatgcaagcaatgatctagaagttcaatgtacttaccaaagtgagtaaccccattgatggacttttagtgatgtggtccttctggtagtgatgagaggttgaagcttcagcaggtagcaaccaaatcatagcacagaggcagccaccaaatttctgggaagtaggctgtgaaggtgaaatgggttctggctctgtagtcagggctgcccttgaatctgccaaatcccaccgcttcctgactgagtgaccttggctgggttgggaccccccataaaaaatcagatacttatctttcagatggcaataaccacacctcgttttcaggaagattatgaaattgaaatgagagaccatgctcggtgtgggacagcacctggcaaacagtggattctttacacaatagtttccttctcagttgggttgtttggtttttttcctgtaaatttgtttaagttccttatagatgctggatattagacttttgcagatgcatagtttgtaaaatttttctcccattctgtaggttgtctgacattactgggtatatacccaaaggaatataaattgttctattataaagacacatgcccatgtatgttcattgcagcactattcacaagagcaaagacatggaatcaacctaaatgctcatcaatgaatgagcatatatacggtacatatacaccatggaatactatgcagtcataaaaaagaatgagatcatgttctttgcaaaaacatgaatggagctggagaccattatccttagcacactaatgcaggaacagaaaaccaaatatcacaagttctcacttataggtgggagctaaatgatgagagcacacagacacatagaggggaacaacacacacagaggcctaccagagggtggaaggcaggaggagggagaggatcagaaaaaaattactattgagtaccaggcttaatacctggttggtgaaatcatctgtacaacaaactcccatgacacaagtttgcacacataacaaacctgcacaagtacccctgaacctaggaattaaaaatagtttccttgcctccaagtatggagctaaactacctcttcgtttttctctcgctcgctttcttccctttcccctcctcctccatcttccttgcttctttaggtttccattgaacaagtctcactgagcacccgctgcatgcctgcattatactatacagagcctgagcgtatagccacaaacaggcaaggtcattccacagagagctggcagcctcatacagtaaagcatggagtgcttcatcttctccaaaggagaaatcagcactcctgcatccctgcctcagccaccttctttataaaagccagttgggtttactgccaggaatggaaacctcttgcagctgaagataggattttatgggggggctctctgtcccccaaagcctgaggcaggtctgggcctatagtcagtggcctgtaaaagagcattgtttgagtgagtaaatggggaagctctgggtgtggagcgtcttctgaaaccctgggccagagtgcttctccttccctcctccatccagtgttcacctcccccacccattctttctagggactcccggctccaccacgctgctaaagacatattcctccccctgttgctgcctgcaaccttctctccatctgctccctctgcctgttcaggctgcagtgtgtagatagtatggcaaggtagggtagggggaggaggacagcttctaaattgggtgagaggcctgtaaagcctgaccggtctgccaaggctacgcagggagagacagtcagtctccaggactgtgcataagcttgtccccacctagctctctgccaatgtctgtccccaagtatctgtttatctccctcattgattgtccctcactacctctatttgtggagaaaagactttgcttgagaatcaggcctgggcaagaatgctgcagaggtgggccttgtagtcctgctcagatagggaagcgggtacaggaagaggcaagcggctgacctgagaggaagcctcgcagcgctagtgccctgccggcagtggggttatgggagacagggctcagattaaaaagtggaggtggatcttaatttagagttcgtgattgggcttcagaggggtccagaccccctcgtgttagatgcacgattttgtggctatgtgtagtgttctagtagattcacagctgtcaccagatccacagagttacagactttctaggttatggggactcactttggaagcagtgaggccctggcggggaagcaggctggctggatcccagagggctctggaaagaactggaactgggatgtatctggaaggctgggcaggcaatggaaagctccgggctgctcataagctcggtttccagggctccatctcaccgtctggaaaatggtccgggtgctctccagcctggcctggccaggcagagctgctgggagcgtcagcagggagagaaaacgctcggctcccaggacgcaaggggaattggcgttaaactttgcagggccgacgggccggcggccagaggaggcggctggcacccccggcgccgccgcggcccctccagctcactgcccgctcgcccgccccctccctccctgcactcgctcggcacagactcggccccagccccctccctcctcccgctcgctccacgctcgttcgctcgctcgccggctcctcctcactcgcccgcccgcgcccggcgcagctcggccagagcgaccgcggggctgagcgcgcgtccgcccagggggctccggaagctgccccggcccgcggcctcctccctcgctcccgcttcccctttctcgctcaccgccgccctccttccccagctccctcgccgtccgcccgccccacagccagcggctccgcgccccctgcagccacgatgcccgcggcccggccgcccgccgcgggactccgcgggatctcgctgttcctcgctctgctcctggggagcccggcggcagcgctggagcgaggtaagcgccccgaggggcggggcgggcagggggcaaagttgccgggagagcggggcagccaggggtcggggctgaccagggcgactcaggcaccacccgccgggatgggaagcggtggtggctgtccaaaatcggggctaggaaccgcacgtccccttggcccgggctgatgggagtgtggaggcggggatgtgttgaaggactcgggcgcttccctgcttcggctgcgggctccctttcggtcttccccggctgcggggctgattctcctttgcagccaaagaggttctccttggagtggggtcgcctccaaaccccaaattcccggcgcttctctgcaaccgcacccggggctaggtgccagataattatcttcctctccgggagaggacaggaaggggggtgagaagctgacccaccctgcaactgaggactagactcaaacagtgcatttgccgctccccccgacaccacagaaacccttgactcctttggttcaggctaccccgagggtctgtgttcctggatcgatctcagccaagcgtcaggataccggacttgggtgtggctttcgctagaggccggtggagggggctgagggctctgagaacttggtaggggagggagaagagatgttagttagcagttgggaacctgaacgggctcccctctactctctcccctactgcctagcatctctgatcactgttaggaatggggggtgaggggtgttagtttcatctaccacgtgtttgttgaaggggaagaggggcccaaatttagcagagaatgacagctcctctttctcagacctggaaccataccctctctccaccccggtaaggtaccccaggaaaagttatgggtgggggagagggccagatagagagaggggtgcaacgcctaactcacccaaagctaaccctcagagcttcgggggttttctcaggcacctaggagacccgaaaatcaatgggagggttagttggccacaggacccggccttcttgcaaggtcccagaaatgcgctcctcacgtgtaaaaaagcagacagctgcagggtctgcccaggctgaagacagagggagcgcaggcactatgcttatctggggctccgcctctgtcatttgcaccgtcttgactcggagttgggggacaggcggtgttcttctccggggagttctggacccccagcgcgcgcacctgctttcagcaccaaaggccctggacagctctcagctccatgggccctggctctgggtccctttcccttcaacccttcccggtggcctggagtgcccccctcagcataaatcaggcattttatcccccatctccccgtctttttaaatgtagagcccagagtgcagagcaaaggaaattgttcatcaccttttgtttaacaaagcatatcattgaagaacccccaccccttttttatggggcaataatgtccacaatttacaccaggtctggacagtttctctgggaaagatagggaaagagatttggtttaaacaaatcgtttccaccacagcatggcctttcttaattagctgtctctttctaacaatggcttggtggccttgaactgagtccagctctccctcccccacccccttttgaatctgtgttgtgactaacacacatataaaaagaacctgaatctacccagcagcttactggattttctaaagcagttctacctctgagaactccactctccaatacaccaccttgcagggaaaaaaaaattgtcttaatggcacgtattgaattgtcatctaagacaaggatttcctattctgtttccttcacgggctgcaaacacattgtaagagcagggggagacatgtgtgtgttttaatttttaagacatttcatactatttttccaactgctcaacaccatggctagccagcatattttttaaattgacttcaggtcaccaccaaattaaagtcaattgatgtgctacttcagaaagctcattaataagtgtgtggttctgactctgagtcataaggagggagtgatactggccaatgagcattgccgagtctgatggtgcatttggagacaattgaccttccacaataaattctatttttaatgtagagcccaacatccactaatgtcagatggagaaccattcacctaactcgttgttgcgaactagttcttctgcttgcggtgaagtgaggggatttgtaaatactcaaaagggacttgttgctacattctgatgcaggtcacgtggttctctgggccatttcgctgtaaggcatgaataagtataaagtataacttgtttttgaagagcctccttattgtctcagatatgcacatggggaataattgtaactacatgcaaagactgcaaagcctaagaataatttcttttctttttctcttgaattaataaggcaaattcagtattgctcaataaggctcaaatttgctgcttccccagtctctaacgtgtgttgtggttagattcacttaaagactattttcattatggattggcattattttccatagagttttgcccgttcctgccaggggccaccgtatctaagcttgagggattcatcttgtgttcatatggctcagttaggtattaagaaaataatgttacattcctttccttccccttccagggcaaaaggatattttctgatcagagtggcttgttttcttatttttgcttacaagtccattcctgcaagctgttcaaatgagctcgatttactggccctcctattctgtccagagacaatttatccaatatacctactgtgcagacctccactaggggcgctccaagatctagctggcgactaagggcagaagagaggggaattctgacctgtgaacaaccaggtgtgtgcaacaccaaaggtcagcagaatggagctcctctcagcctggaggccttgctatcatctctcccctccctctttctgattactacattttattactgtttctcagagaaaaattattggtcacccttgacacacgcagtgaaaaagagaaagaaaaggtaaaaagaagcccggagaatgctccaaggaaaatgtcaatccaactgccctttttgtatttttgcagttttcttcatgaagccaaattgcaaaacatccaagaggctgtggaaaggctgttctggggagtttgactgaactgggcactggaattagatttataaagtccaggaaaagaagtgcagctccataattagagtgacctgggtccagaggccagctccattgtctattaacacatggccttcagcagaactattttatctgaactcccatttcaccatctgaggaatgggggcagggcaaggaggactgatgataccagcctggaaggatggctgcagggattacataatgcatgtaaaagcagctggcacggagtaggtgctcaagtaatgtttatttctttctttccctgctttccaaagggcaaactgctcctattagtagacaccaagaaaacaaatctctgcgattggcatgaagcagatgttggtgtaaatattgggataattcaggctaaagtagaaaggggttgaagggcatagtgagtaactccagttacctgtattctcacctttggcagatgagaatttgaccttgcctggtgcagacacccttcccttccaaactctcatgctgtttctttttgaacctaaatattaccatcaggaatcagagttcatggtactggagatcgagcggatgcaggagagcaggttaatggttgggaagaagacataagaagcaagtcttctggaaaaagatatttgccctttcattcattcatttgaatttaccgagcacttcctatgtgtcttagttcaacctgctataacaaaaatgccttagatagggtggcttaaacaacagaaatttatttctcacatttctggaggctgggaagtccaagctcagggcgccaacagactcagtatctggtgagtgtctgtcatctctctttctgctttgcagacagccactttctagctgaattctcatatggccaagagggacagagagcccgggtctcctcatcttagaaatgaactaatctttatcatgggggccctatctttatgatttcattttaacctaattaattcccaaaggctccacctccaaatgtcattacattggtgataaggccatcaacgtattgatttaggggggacacagacatttgatctatagcactacgcatgcggtagaccttgttttgggtgctggagtactataatatgataaggctcctgccccagtaatggcagcctagcaagagacatctgcaggtaaactactaccatccgtgccatgtggtaagttctttggtggggggatatcagacatctatgggacctcacgtggatgtgtttaattctcaccaggggtggtcagtgaaggcttcctggagcacgtagcatttgaactggccctgaaggggataggacaggtaccagcagccagaggagaaatttctacagtaggatagggaaaatcctgaaggcttcactctcagaacacatcacacccccgcggaattggagagaggaaacagaggagcgagtgggaggagaaagtaggcaggtgcacatgctcacgctcaaaaaaaagataatctgtcggacctgcctgtcctccctgctctcccctgaacttcacgggctgggtagacgagagctggaacaaaggactttgagccgcggtgttcgctgttgtccactagaggttgtgatgacaccgaaggaatcttctcagaagggagcgaggcccagctgctgagcacagacagcatcacacaaccctgggtaaacactgctttagtggatttgcatgtttgcataatcctctggttactgtagttccttagaagcatccctttggtggctgtgacaagagggagcagggcagggaataggactgctttgaggaaagggtaaaagtatggtgagttgggaggaggtcagtggacgcacgagatataatttactagaacatggcaaggactgagtttaagcaatgcaaacagcatttattgagtgttgattttgtgccaagccttataataagtgctttatatagatatgtgcagagaattctcacaatagcccatgagagagatgcagttgttatctgcattgtatggactggggaaactgaggtactgagaggttaagcaatgcctaacatcacaaagggattgaagtccagcctcagatccaggctggtgtcagaatcatgacatcaagtcccactactaccttttatatcctgcattccccaagaccacatgcagattctgatggttcataggaagggatggtgtgtgtttgccagatgcgcatgggatgtgtactcaatgcctaacacagtccctggcacacatagcaagcatttaagtaaagctggtcaaattgaagtgagtcataaggtaaaacaggttacaattttatttataggcaactaattcacaatcattatagttactgagcatttactatatctcaggcacttacgttggttattttaattaattttaacaatatcatttcattttatagatgaggaaaccaaggcttagagaagctgagttatgcataggtaaggtttaaatccttggtgccttccaagctgggtccttctgtatttctaaatgaaatgtgtgagaaagaccgtttcaccattaatgtgcagatagtctggatgggtaagtgcaccaaactccaaacactgacaggacagaaaccaaaaccaaccctcagtagttcccaaaaaagatgaacatagggattattctttccagttgaggaaaggagaagacctcgtaaaagagagtgagcagtccagctggttcattggttgacaccgagattatgtgactgcttgcaatttctcaagtttccaggtcacccaaccattaatggagaactcacattgtataaaattggtttctgtaagcccctaaattcaggacctaacctaaaccatttcctatctatgagtctcaatttttccttctgtaaaatggatcacaataatcactaccacattcatcaagctgtccttacagggctgggatgggacaagagagttaagatgctttgcacataccaagaaatcagtccttgaggaagtaagtgctggcatggaaggctgaagacctcaaacacccccatgtgtttcttcctgggctggttatagccagcattatagcaaatataacactgctgtttgccattgattgtggacctactctgtgccagggggctgtctttgtgcttttcctgtattcacgtatttgatcctcatgtgttcctatcaggtggtatgataaactagattttacagataaggcaactgggtcagaacggtacaagcacttgctcagggtctcatggacaatgagcggtggagtcaggattcaaccccagaacttttgattccaaagcccacgcttgttctaaatactggggcatgaagatgtgggtatcacatagcacagagcaaaatggaaatggagagctgatgcaagcctggagatcaaggtggtttgacaggactccaagaggagagatgctttctcatccagtggcaaatgccaggtgtcccaagtcagctttctgagacagaaaacagtttatcccagcctctttcatacctactttgatggcttgtgcgtgagccttattctcatcttactcatgctattcctgcagcctggactgtcatcctagaggagcgcatggctggttgtgtagagaggactaaatcaagttcccaactggctgattttaacagtatgatcttgagctatttactttagttctctaggcctgttttggcctgatatataaaatgagaggattagatttacattacaagattgttaagactcgtcaatatatgtgcatattcatagctcattgcaagcactcaataaaaatttgccattattgctctactattaacctggtaaacttctattcatccttcagaacccagtcctaattctccttttctgtgaagtcttctcttgcttctctcctgtctatgccaattatgaatgatcctcttgaccccttatcacattttatccctctactatgggtaattcatacactgataatgcctgagttgccaatttacataactccctccccctaaacaatgaactcttagaaaacctcaactgaatcttactcattcatatgccccttagcctgtatctaatcaggtataaattctcaacccattatgttaaatgacttttcctcttaatcttagttttggggaggtgaagttagagtcctgacatctgaatttaattcctgactctcctatcctgtgtggtcttaggcagcctgtataaaccttgattttttatctgaaaaatgggaataataatagtgtccaacctcataggattgctgtagaggaaaaccaatgagataatagatgtggaatcactaagtaactctacaaaaaaggaggaagagaaagaaaaattaaaaagtgggaggagagaaatacactttgtaaagagaaaagaaaaaacctttgtgcaaacacaaaaccacaagataggccattcatcgggtcctcactaaagccatctttctttccaaaggaaatattggatgcaattgtttgccctgtgcctaagctcatttcaaagcagaaaccttctggacatcctactgcttattgttgaatctgccttctcttaggtctctggcagctgcaaaaacagcaaatgcccagctgaaaactgggacagtatagcaaagtgaataaaaacccaggctctagagtcagagcagcctgggtttcagtctgttgcttcttattagatgtgtatccttagtcaagccactttgtcaccttgagctggcaccgggccttgcataggagtgagggtctatgatctgcccacttctcagggataatatgatatgggagagaggttgtatagttagagtaggcctccttggtgtctgtaatattaatcagattctagcagttatttgggattcttatctgcctcaatcctctccctgatattttcattttattgaggaaagagacccagagacaagaaagggcttactcaaagtcccaactgtgagtggcagagccaggacttgaacccctcactcatgtcttctgactcccatgctaaagtgacttccacctactttcaagaaaaatggaatccctatccctctcaagtttatgtcctgagacccaaggagtgtggcaatggaagttttaagggtatctgttttcagtaaaccactggcgtctattacccacatgggacatttacattatgtggccatggaagactgactgcatgaaagaggctttggtagaagtggaaatcaagccatagctccctcctctgctgacttggcacttgaatcttcaaggcaccagcagataagcttgcaccggggaatggtgccatccaagcatctggcttgagtcaagcaagcaagagttaaatgaagaggctcaaggagacccaaggcccaggctaggtatccctcctaggcttcctcactctcaccatgggtcatggatagtggctgattgagaaacccactggggatctgggatgtggagagcagggaaggattgagtgaggcatagctaatgtagttggtgccagcccggagcaagtagtagggactggtgatgttttggggctggagattagaacaaggtaggtggatacagtatagcacctggggtctggagctcaggacaagtcttagtgggtataagcctctgggtgtcagtttccttgtctggtctcacctattcccagtttagcttagtgtcataaattggtgagttcacattgccaaaatggaatgggctcttcaaagccgtacaccataataaaaaagacacagaccctggagtccaagagatatgggttcaaacctaatgctgtgatcttgaacaagtcacttaactctgagatgatgggagtgggtggtagtgatgaggatgaagaggggaattatgagttgctgttgttactgatggaccgagctgattctcaggtcagcgatggcttccaagagaggaaatagtatattctaatgtgatttttgtggtatagtgctatggttggaatatttatgtcccctcccccgacaccaatgtataggttgaaatccaacccctctgctgatggtattagcagtggggctttggggaattgattaggtcatgaaagtagaggtcccatgaatgcaataggtgctcttaaaaaaagaggcttgaggccaggtgtggagactcgtgcctgtaatcccagcagttgggaggctgaggcaggaggatcacttgaggccaggagctctagaccagcctgggcaacatggcaaaaccccatctgtacaaaaaattctaaaaattagccaggtgtggtggcatatgcctgtagtcccagctactcaagaggctgagatggggggatccactgcagcccaggagtccaaggctgcagtgagctatgactgcaccactgcactctagcctgagtgacagagcaagaccttgtatttaaaaaacaacaaatggagagacacaccttacccctttcaccatgagaggtagaaatgttgaaacaagaagctgtgatgtataagaaacaggctctcaccagaccctgaatctgccagcacattgatcttggacttcccagtctccagaactgtgaggaataatgtccagttgcttataagctacccagtttatggtattttgttgtagaagccaaaaagggtctaaggcatttagaacaaagactcattcaggatagctgaagaataagaaggtttgctctaaggacactgcaaatattgagccaagaacattccaggactctctccacttctctcttgcatgcatctgcttctccccacgcatctgttcattctggcttcctctctattgcctaactcctctgctcactcaccatagatctctcatcacctccacttacccattcgctattatggcttctccagcataatcaccacatgtgcactctctaatatggtagccatgaaccacatgtagatatttaaatttaaattaattaagatcagattgaattaaaaattgagttcctcagtcctactagcgacgtttcaagtgcccagtagctatgtgtggctcatggccgccatattggacagcatggagagagcacaaatgatttctgcccagtcctttgtactgggcaactgggcaataggttggttcttcatacttaatccagtcatctctaactggtatgggaagcatgccatgtgacacaaaaccataccttgggatacagcaatcgccactgatggtgtctcacacactttcactgctggccttgatagctgcttctcaattcttctcatttttaggatgtggctctgcaacccttttgccagttaagacacatattcatcaagatgtggcctgtctgataatcacatctgagaaaactgggaagaatcctatcatcattgtaactatctgttgacttgcctccctccgtgctgtacaatgaaattttcggggttaggagttgacttttattatctctctattcttagctattcagttgaataaatgagtgaatggatgaatcaatgaatgaatgatatgcagtcttcagctatgactcaaaagtgtttggacatagaacacaaaagtctttgcaaaaaatgtgcagtcttcacattatttgggtaaatgacttaggaaaaaataatttagggtaggagttgtgggtgatagagagctagaaaagaggagcctcataaactggtgtatttagacatttaaaagtgatccaggcattgaaaatcaggttggagtggaaaatgaagagaagcctcaaggtggggtcccaggagctctccccttttcccatgagagattcatctggaatgatgacagtggatttaagagcaataagggaggttggtaggaacacagaatgtggctccatgcatggttttggtaaccatttttctacaaagttttaatattatggaaacagggagagatgtttagaacaatgtactcagagtgagcattctgaatgggggactcagcacaggattaggactgaggtaggactgactgtggatccccactctgccaattctgtgttgtgtcatgctggggcaagtcactgaatctcctcaagcctcagtttccgtctgcaaaatgagaatagaattcttcccttgcccctctctgcagggtggatagagagaatgcaatgcatgtcactactatcctgcacaactccagagggagctatttatactgcagtgtatgtgaatggtacccctggaattaagcagtatacaacctatgctgccatatgtggcagccctgaatatggaagtatgccaccaaactatgaatcaatttgcagaggaagaaggacagagctcccaagacttttcattccctaaggacttctgatcaggcctccaccttctatgcccccttttaaagcaggtttaacagagtggaaagctaacttggggccaaccaccttggaaattaatgtaaaatatgtggaatcaagcctagttttccagggcttcaggaaaggaaatttgcataatttatggcataagtaaaaaatgatatgccaggttaatttgcatactttaacttcagttggggttaaaaacaaagtttttgttgttgttgctatttgtagttgtggcttttaaagaaagcctctcttgttaatccgactgtgtaagcttgagtaaattacttaacctctctaggcctcgatttcctcaactgtgaaatgaaaatgataaatggacttacatcctgggattgtggtgaggagttatgaggtgactctgtaaaacttgtagaatagtggctggtacgtagcagaagttcaataattatacagtatatgtaatatataataacatattatatcattatcattaagtatgcaatgtatcttgtccacttgatattacaagaaattctaaaaaatgcatatcattgtgtacccacatgaagttattttgagctcaggacctagaattgtgctagaacacagcaagagctcagtcgtgagacgcatggctgccctacaatgaatgcattattatcattattaatcactgccccataggtgcatgtgtttgaaagcctttctcccctctagactgaggtccctccaaggcaggcactgttttatctccctcccaatccccacctctcaacactacatctcccagatagtagaaactcaataagtgcagacatgtcgaatgaataaatgctgaagtgttattgttcttaattagtatgcaagaaatgattcttattagcatgcatatgaatgaatggctgtcttccttgcagactagaaactcctcacgtctaggtcaccaatatttggctcagtgcttggcgtatcagatagtcagcaggtgctcatttggtgtatgatggtgcttaagacctcagaatttaaggtccaaggcctgactctgcatcccagctttatcatttactggctgcataactttggcaagatatttgtgctttatggaaatagcatgtgcaaggaaaataactaactgtacctttttcattgagttgatgtgagacaaaaatcaggaatttttgatcaagagcttagcacagtccctgacacacaaattaggtacccaatatagatactactgtgaataaatgaatgcatggcctttcccaagtgtcttgatacaggaaaggggccctggtgtataataaccagctagaacagaatttacaattttatgatccccatagagaaaacattctgtgggaattcaacgaggagcattgactttacaacaaccacatctatgcacaccttcccaatttaaggtatgttattatctcatttgataaaatggaagttccaagcagaaggcaggggtccaagtgagtaaatccatcattctctggctgttgttttataatcaaattttatctcagatcagccataaaaccctagaggaggcaccacatgggcgtggcctgtctgccgggagcctttccatctgtgaatgagtgacgtcaggagcaacttcttagcaaggggcttccagacaacagtgcttgtgtctccaccagactccttccctgtttctaaagaaagcagacccctgggaaggctgagaaggaaacaaactcctataatgcactagaatccttattaatggcttcatttacagaatcttgcttaattattagcagaaccttcaaaggtgccttacagccatttgattatacataaagaagctgaggtcagatggctaagcagtgctggagttgtgactcttttattctttcatccaagacctactttctctttatttcagacattctactctgtaccaatcacttgataagtactagggatacagagagaaacaaaacatatccttgccctcaagaacttatctaaccattcttcaaactcaggtaggaccaagttcttttcttctgtcttctcctcacttctacgttgtcctgatgacttccgggcagggggcaactttctccaagggaccagggttgggagccatgaatttctgggaccactccctatagccctagttgctattgaaacaaagcaagctcgtttgatcttccttaacttcaacaagaaaaaaaaatctagttgatgttcctttaatgggtgaaataaatgtgtcactttaagagaacctccaataaccatcccagacttcacagaggcagaggagaactccaacggggcctgctgagagcgacgttgctgccttcaattattgcaacaatatgttggcatttccttcttttgtgaatgtgggaaaatatatcctgagcagaactgcagagaattatatagatgcagctgagcatgtgtatagatataaataatatgcacactatttccataaagcataaacttggacaatcagttaatgaggtttggccagaaacaaattaattcctttgggtcctggggtagttttattctaagtaataataaaaataaatagtcatttcttatgcttagcacgtggcaaaggatatccattattgcatttgattgtcaaaaacaactccgaggacctagtactatggaaaattacttctgtttttcagcaaactgagggtcagagaaactccaccatggaacagtgccttggtttttatttatcctgacattgacattttggaagagaacagacccattactttatagaatgaccctcaatttgggcatatagacttttgattcttacaaaatgtcagcatgcagcccatattggcctatcacttgcctttctcctttttgggtgtctttgctatgattgaaacaaggcctagaattcccccaagtcaggctgtcttcactggttccctctaccccagtgtctagtaccaagcaagggtgcccctctaccccacttctgggatccctaaccagatgcctgcctccctctccaccccacttctgccacaatgcttccacggcaccaggctggtacccttgctatagtaacgagcctgctctagtcttagtatttgtttatgcatctctctttcccactaggccatgggaaattcagaatctgattcactgattcaaccccaagaagcaaatatttaataaatgtctactttgtgggctctgctgtaggtgctggaacaaaaactaatagtgccagccctcaagaaatgtatactccctgtgatctttcattcatttactggcccaaaacattcattcatttattcaataaatattcattaatattttgtgtgctgggctgcataccccaaagcatgcggatcattcaatgtttgcataatggggtagaaacaatggtctactcctacaataaaagaaaaaaaagtttaggcttattaatctctgatagaggccagctgtggtggctcacgcctgtaatcccagcactttgggaggctaagaaggcaggtggatcacctgaggtcaggagttcgagaccagcctggacaacctggtgaaacctcatttctactaaaaatacaaaaattagccaggcatgaaggcatatggctgtagtcccagctacttgggaggctgaatcaggagaattgcttgaacccaggtggcagaggctgcagggagctgagatcgctccactgcactccagcctgagcaacagagcaagactctgtccaaacaaaacaaaacaaaacaaatctgtgatagtaaacaagattaagggcttccaatgaacttcagacattctaatgcacactatgtatgtgaaggggttaaaaagagagctgggggattctgagagcatctagaatctcaaagagaatgggaatccctctgtcacactgcccttgggggcaccagccacagccagacaccttgatctgacatataatttctcagcatgaattaccagaaagaccacccagtgagagtcagagacctgagttctggagatgacacggttgccaaaaatatgctgtgtgaccttgggcccatttctgtccctctctggtctttagtttctccatctctaaatttagtggcctgggctgaatcatagtttccaaaatggactatgagttaaaatcacatgaagagcttttaaagacccagaaacccagctatacccctgcctactgagtcggacccatgattgagctatacatgctgccttctggatttttctgaggccatcagtaaacttcacctggatgattcgacccccaagccatgaccttttatgattcctttgttcatgataattatgtccaccatttatatgccaggcatatgctaaaccctttactcacatgatctcatttaagccacatatgagaccagtggggtggggcctgatacttccattttacagcaggaaccactgaggcttggagaggttaagcagttctctcaagatcacacagctagtaagatcctgcatgcatatctgtgtctatgtgactttaaaagaatttgccacctctctgtagtacgaataggggtgggaatctactcttagcccaccatattccctccccagaggtagccctgttctcctgcctcctctattccctgaaaatctagttaactcttttaataagccaaataaatgtgccctgtgaagtgtgtgatcgatcacaccctggctgcccatgaaccaagcacaggtttgccgcacaccggggacagcctccctgacatgaattattgctaccatcagccctcctttccgctcctacacttgcaggggaacggctgagccagggacctgtggacactcaggattcaactctgggcttggccagagataagtccttagagtttggggcatttgaacaactgacaagaagccagcatggccagaatatcctgaacagagaaggaagtgggcaaatgaagttaagagaaagtattaaagaaaagcaatgattcagttgttatacttgttagagcataataaagcaaactttattcaggaccaccacattgatggggaccactgcaatgggattttgcagtgggggagattgggctaactccaaatataaatgggaaagttggaatttatagccaaggtgcagagtaggggtggggaggttagtggatggaaaactactgaaaggaaacatcaggggtaagggagattctcctaaatccacctaacaggattcttgctgaaggcacaccagcatgatcagacatcacctggagatggtggaggatgagggacctgatcagatatggaaggttatcagatatccagagcatagggttcttgctaaagtgactagcaggattctttgctaaaactggattccataaagaagtgcacaattggcctagaagaaggttcaggagcctgattaaagtttgatcaagcagagaatcattgtcagtggccaggcccagatcctatagggcagggaggacttgctgagaggtgttgggagtttattctcagctgtgcttaggagcacgggaggggatttttgggttggataatgctgtctatgatgtgaaaatgggagcattaaagacaaaagaggaatcatttaggaggtcctcacagataggacttgaaggagttaattctacctcacacctcccagcttaagatagggtcacctcttctagcctctccgctaaggttagggacaatttgtgtattagtttgttttcatgctgctatgaagaactacctgagactggttaaattataaaggaaagaggtaattgactcacagttctgcatggctgggaagacctcagaaaacctacaatgaaggcagaaggggaagcaaacatgtccttcttcacatggtggcaggagagagaagtgccaagtgaagggggaaaagccccttctcaggccttgtgagaactcactcactatcacgagaacagcatgggggaaccacccccatgatctaatcacctcccacgagatccctctcccaacacgtggggattacaatttgccttacaattcaagatgagatttgggtggggaaaatttcattccaccaagcccactgctcctggtgcaatttctcttcaattgcaatgggagggaggctgatgctctgcacttactaaaacatccacaggattcccagcctttgaccctttggctgtgtctaaaacctccaactcatctgcagacttgccgtcttaaacatggctgggtgctttgaaagattttctctgttgctcccccatagtgtctagaatacagaaaaagcagcagagaggagaggaaaagaatataaatttgggcaaatgatgattaaatccacccctccccgcctcccaaaccccgatcagactgtacagaaagaatcttatatatattatcactggctctcagtttaatgtagggccaacattgctgggtaaattaaacaacatttataatatagctgaactataaaaatgtgcttggggcagaaattagacataccaagctttttccagcaaaagacatttttacaaatgcatgagaacctgaaccaatttggaagccctgtcattttgatttaaagccggggaagtggggctgatccctagagaggagaaacaataatccaggtgagaggagattttaaaattctggtcctcattactgacctaacttggactcaaaatgtatcatgtagagaagagagttgacccataactgagaactgggacccttccttcttcacctgcataaccagcaaatctcatatgatttccacatgtaccctcttccagggagccttccctgcctgtctcagctgagttaggggcatcgcattggagtacccatatccactttgttttagttaactattgttgtgtaacaaaccatccctgaaattcagtggcttaaaataacaaatatttactattatctcacatgattctgtggtttgactgagtgcagcttggagattcttctgctcagcatggtgttgaaaagagccaaatcatctctgagcctccaaggggttcaactgcatgtctggtagcttgagctgcttgtcacccgagcatgtaagttttccctcatgtgacttggccttctcccaccatgggagctggattccaagagagagtgtcctaagagcaaaagtgcaaagtgaagctctctaaacatgacttggcagccatctataacctaccactcccttgtactaagtcatgatatagtgctgttcccatgtactgagcgggtactatgctaggtattcggcactctgtactccatcattggtttatgtctgtgtctctttgcacaaaggaacccttgtctaattcatttctgcaacgaaggatgtgcagttagttcaggttcaacagaaaagccatagctctaagtgttcacgccaagtgtggtcactcttaacccgggagattatggtgagagaattcaggaatctaagggccagcatcagtattcttttatagtaccagcagtaaaaataatagcagtagtcataatgatgattaatagtagtaggaagtattaacaatagtataatttctactgctctagcattaatacatgtaattctgccttacacttaagaggaatttgaccacttacaaaataatttttttccgttaccttactttgctattcaacaactttgtgaaatggcccaggaggatttttgttataagtcatagtttataaatgaggaaactgagtctgggaaggaacagaaacttgtcaatagtcaattaaaattgatattgtcaagtacctactatttgccctctacaccaatgacttaatttcctccttgcagcaatgttgtgaggtagataccattattgccaccatttcacagatgaggaaactgaagctcagagaggcgaagtccttgacttgtccgggattttatgtttcctggctgggatttgcatctgaatcagtctaactcttgagtcaaagactctttccacaatgctacacttaattcctcccagattaccattttctaaattactttgagctgagaaaacattcacataaaaatacagtcaatcctcccctctgtatctgagagcttctcatctgagtattcaaccagctgtggattgaaaatattctttaaaaacaatgaaaataacaatacaatgatagaaaataatacaaacttaaaatttaaaaaccaatatactataacaactatttacgtagcatttatattctattaggtattataaataatttagagatgatttaaattgtatgagatgatgtgcataagttgtacgcaaatactactccattttctataaggaacttgagcatccgtggatcttggcatcctgggggtcctggaacgagtctcacatggatactggcagacgactgtaatatgaaaaatcagaatgagggactcttccatgaaaaacttccaccaggtgcggtggctcacgccggtaatcccagcactttgggaggccgaggcgggcgggtcacgaggtcaggagatcgagaccatcctggctaagatggtgaaaccccatctctactaaaaatacaaaaaattagctgggcgtggtggcgggcacctgtggtcccagttactcgggaggctgaggcaggagaatggcctgaacccgggaggcggagcttgcagtgagccaagatggcgccactgcactccagcctgggcgacagagcaagactgtgtctaaaaaaaaaaaagaagaaagaaaagaaaaaagaaaagaaaagaaaaacttccaccagttttaaagcccgctttgaccatttggaagtttttattcttcacccattgttagttcttggtggtttccacatagctgaggttaccacgaaacaaattttcagataaacaagttgtcatatgtgtaaagttacatgaggttattgagtccaattttcccagggattaactcactttgaagttataaattatgcacttgatgggagcaaagatatatacatatatattttagcacctataaaacccatcaactggtacttttggaggacatactgtactaaaaggcaggatgatgataggttaagcacgctgacttaaaatcaggctgcctgagttcaaatcccatctctgccacttatctcaggcaaattatttcatctctctgtgtctcagttttctcatctttaacaggaatttataatagtaccaatttcacagggttgtggaggagattaagtctatagttggccttggttcatgtgctcatctttgaacaagtcgctgaggctggaaccatgtaggaccctgattggccagccctgacctcccccaacacatggactgaaagagagaggtggggacttgccaaaggaatgtcaggagatgttcgccaagagaaaagtcacagagaagtccagcatgttaaggaactaagagttttctttttatttttttcctgccatgtctcaatcaatatctgaaagactcataaaggaactgagtgtgtgctaataataaaatgacccaattgtgaattaagcagatatgtttctctccagcagggttaacaaagtggcttgcatccagacccaacactgccatttactaccttaccttctgcaggagaaagcatggaaagtgtgcagaaaaagatacggggtgtggcaagacagaggcatgtcagtttagcagtgacttgtcattggttgtaaaacactatcctataaatgtaggatgtttgagcaataggtccatgccaggtctctctaagaggcaaacatttaagcaacaacctcttgtttaatgagaataaagaaaatctgccacccagaaatagcctttgacccagcaatcccattactgggtatacattcaaaggaatataaatcattctattataaaaatacatgcatgtgtatgctcaatgcagcactattcacaatagcaaagacatggaatcaacctaaatgcccatcagtgatagactggataaagaaaatgtggtacatatacaccatggaatactatgcagccataaaaaggaatgcaatcatgtcctttccagggacatggatggagctggaaggcattatcctcagcaaactaatgcagaaacagaaaaccaaatactgcatgctctcacttgtaagtgggagctgaattatgagaacacatggacacatggtggagaacaaaacacactggggcctgttggagggttggggggtgggaggagggagagcatcaggaagaatagttaatgaatgctgggcttaatatctaggtgacaggatgatctgtgcagcaaaccaccatggcacatgtttacctatgtaacaaacctgtacatcctgcacatgtatccctgaacttaaaataaaagttggaaataagaaataatttgccatcaactaagtcctttcccttctctgagcttcagtttcctaatctgcaaaatgagcaagttgtaccatctggcctcacaggacacttccagtccttgtgttcaagtgattgtgactaaatttaaatgtctttaatgacagcttgaaagtcaggagtgagggcacatccactaactcactgaatgatattaagcaagtcactccatccatccatccatccatccatccatccatccatccatccactcattctcccctgtccatccattcatcaatgcatccagttatctgtccatccatctacccacctcttcatccatccaaccgtccattcatcctttcatccattcatctgttcatcacatcctgtccatcaatttatcaatgcatccttttatctgtccactcatccacctgttgatgaatccattccttcatctgtccactaatccatccttccatctctccatcaacctgtccattcatcaacccatcctatgcaaagccattttaagaccttggtttgatctaagcagtattattctggagtctcacactcacgtcatagcatatacatttaaagaattcttattgtaacatttaagaagaagtattaaagttatgtttttgaaactatattgttaccagtaactctctcaatttacatatacctgtagtttcttgaaaatcatcaagcatactcaggaattcttgtgaaatgagactctaactcatcaacttttttcaaatataatgaaacttttatgaacactaaatttaaaaaacactgaggttgatataacggtatgttgtggaggcatttaatttaagcctttattaattttgcttttgcagttttcttttactattttggagccgatatattactttcagctctcaggcattttcatgggctcttaaaaagcttgtaggcctcagggcctaatgggtaaaataggcccatttccaaagtcttttaacatccctcctgcatttcccagatcctaattggatgaagacagacagattatgcaaaaggcctatctggtcaacccaagataataaaatagatgtgtaaaggaaacatacatgaagcatcaacctcacactaaggaaactgcttcacgtttgccctccacccctttaggtattcctgtcctgaatagaaacaataattctgggcagatgcggggtgaagataaggatgatttcaagggttcactgtaaatcgtaatgagtacctactctagcagggagtattttgattgctttttgaaatgtgaaatcgcagatttatctcctgtgatcacattgggaacattttttttcctatataaaaagaggtttcaagaagtgctgaaaggtttaggataatgaaggcaaattacttttacaacagcagggaattgtgagcagtttgtgtgtctttgaacatgggaaaataagagaattctccagggagaaaaactcccagtttgtcactggaaaaaattcgtgtgagacaaatatggcttaatgcttcagcatatatatgaactggagcccttggtgaatatcctagcctgtctcccttttttaatgatgaagcatgttccacacagggagtggaggtaacatactcaagatcacaaggcaagtttgtgcctagacagaccaatggctgaccctggcccaatgtggttctgctatcacatggtgtgccttgtcctaaaatagtggaaaatgcataaatgagaacggtatgcttttttacaatttgctttttttctttattagacatttttgaacatttgggagatgtgttgagaaagttaattaacccatcctcatcccactgcaccaaggaatcctctgttaacagcctgtgcaaatcttttctttcttttgttacaattttgaaaagcaattttctctttatgtttctatatgcttcttgagtctccatgatatacagacttcccatggcattcaattctgctcaatcgtctgttgctattggaccaaattcttccaggaataattaccatgctggagttcatggtgacgtgtatgcagtacactcatgttgggtatctcctggatatcaggaactgtgctagttaatgagggaaagaagttaaccagaatggaatcactgcctgcaagagacttagaggctggggggaggttctgtgtataaacaattttgacaaagagcaatgtgtcctgtgatagggataagacacagaagtccaggaatgcactgacccagactgggagtcaagggaggcttcctggaggagatgatccctcctagatcccaaaggatgagtaaaacttggcaatgtaaagatgagagagaaaggcattgcaagctcaggaaagagcaagctcaaggcttgtaggcaagaactttggggctgaaagcaaccttacatgccaccatactcccataattcctatgtcacagatgggaaaatgaagatctttttgaagcccttggtgccattacacaagatagcacattctgttgttctttttggcctttacaaaagcaaacgttatttgcagtgggatgcaaatggaagacaatggtattgtctagcatgattatcctgcagatctttgttataactagggcatcctgaagttaagaagatgtagattaaatgtgtgcatggagtgctatccttacccctgaattcagaaagcctggcgctacagtcactgggtggcaagattggattgcaggtcaactgtttgtgatccactgtaactttaatcctggccgagctgatgacattttggaatcagcaatgaatcaaccattggacataatatgcactaggctcttagaaaagagttgagggatcatggggaagagatgttcctggtagtgtaggaaatagaacacaattgtcaagagcttgcactctggacttgtacctaccttgatttgaatcccagctcctccacttacaagctgtgcaaacaaagcaagcaactgcatttctctgtctcctcacctgtcaaatgggagctggaatagctcccacctggagggactttgtgtagatacaaaagcatgtaaagatcttacttaagtgttcagcatatcctaagtgcccagcaaatggtgtagttcgaattatcttattttaatccaaaccaagttccctcagcttccagaactggttggggtcagctttatccactgacatgttccttttaataacagtttttgctggacaggacataaagaaatagaaagatgctctgtgctgcaaagcctcccaggcacaactgggaatgactcagtgtggggagttattttggttcactcttttgtctgctctgctctggttgttcagataactggactttgcctgactttgcaagaccagccagactgggcttacctgacgtgccacctcaaactctcaagctatctttgatacactgccaatgagttaaatattccttgtatgataaagcaaagagggggtgatgaaagtgtggtaaaactcttcagagtattaggaattatatagtgacttaaaagcccagcttggaaagtcagaggaagcttagttctcatttcagcctcgccactgcctacctatgtgaccttggtcttaccagcacctgtctcctaatctcagtttagtcatttcgaaaatgggggtactcatgcctgtctcattaggttatcatgaagattaaatgagatcataatatgtaaagtgtttggcactgtgcttggaatgtagtaagcactcaatatattctagatattctattatgttgtatttattcacttatttagcaaaaagaaatatgtaaaaattatcactatgtgtcaagccctggggtggaagctgatgatacagtgacaaaatggatgtggtctccatgctcaatctatcacagaagaaagacaataagtaagttaatatgtgtgtgtatgtatacgtatgtgtatgtatgtgtgtgtgtgtatatgtatagtgtgtatgtacatatatatagtgtgtgtatatatatatatagtttgtgtgtgtgtgtgtgattacaaataggaataaatgctgtgaaagcatcaatcagggtgctgagatcaggtggtcatggaaggcttctatgaggcattgacctttaaactaagatctgatggatgaatagggagttatcaggccaagagcaaaggaaacagcatatgcaaagccccaaggaaggaatgagtgatatagttttgatctgtgtccctgcccaaatctcatgtcaaattgtaatccccaatgttggaaattgagttggtgggaggagatttgatcatgggggtggtccttcatgaatagtttagcaccatcttcttggtactgttctcatgatagtgagtgagttctcatgatatctggttgtttaaaagcatgtggcacctcccctttctcttcttgctcctgctgtggccatgtaagatgtgcctgcttccccttcaccttccaccagttttgtaagttttctgagacctccccagaaggagaagccactatgcttcctatacagcctgcagaaccatgagccaattaagcctcttttctatataaattacccagtctcaggtatttttgtatagcagtgcaagaacgccctaatacaatgatctcactctgtctgagtaagaactaaggccaatgtagctggagcatggcaaatgagggcaagcctgctcagaaatggggtggaagacaaagtcaggctccagaacacacacagccttgcagcaaaatttggaggcaacttaagaacagtgggaaggaagccactgagaggtgttaagcagaggattgtgtgatgggtctgagcttcaattttcaaaactcactttgactgctgggtggagaatgaatggtagggaaagaccaggcagaaagctggactcatctcagtgaggcagactggtggtttggacttgagtggaccctatgggtacagggagaagcaacaggttcaaggtctattttgaagttaaagtctatagacttgctgatagataaaatgtggggaaatgggagaaaatagattcaaggacgtctcccaggttactgcttgagtgactggctggatcagatggtacctttgccgcaatagggaaggctttagagagtaaacaagatcagttgtaaggctcttgcaacactaacgttgaatggaaaatccctattgtcagcaacacagtgcatagggcatgtggatgcatcttgtttgctgatacattttagagagatgcatgtagatagttttaggtatagctacacccacttccatacagacactacttctttcacatcatcttattttatttccttcaagccactcaccacaatcagaattatttgttttttttttcttgttatttatttcttttcattttatctctccgactagaatggaaggtccatgattgtgaggcacttactatcttgttccctattgattcccagcaactaagcctggttctggcacatagtaggagctccataaatgctcattgaaaacaaaattttttcacattgctacgtgtacatttaccttctattgcatgacaggtgttcagtttcacataactaaaatggccaagtgggttttcgcaggttggggaaagcccgagcctggtcttactgggtgagtaagtaacattgtgcatacattgtcatccttcccaggaggagagaactgcaactctgctgaggagacagacaggaggggtcctggtatagtgacaaatgaaaggcatgagctttctattatggaaatggggtggctggtggccttccaggaagactcaacaatgttgattgactgtaggaagagttaataactactcccagcccagtcaactgggctcagttgctaagcaactacctccccagggttatataatatgtaagagaaacacttttttttctaaatggaacacaggcttccttcctaggtgacagagacttttcaccttgatctttccaatctccagtagacttgggtgacttagacatgcgagtggcctttgggttgctttcaagctgctaccaaagagaatgccgccatccaataaaggatggatttagagaaaggggtaaatgggcaatctgtgtagcttcctttacttgcatggaattcctaggcaaccctggcatggtcgtctctctctgtggattctctagagggctttggtgacaccagatctccctgaagatttgaccaaacttatagatggactggggcaaaaggagaagctactggtctacctagggttttcttaactcatgcaattatccatctctttgctctttgagactacaaatgtgtacaaatcagacacaactgagttcaaatcttggcttccactgggcaagttatttaatcatgctgagcctctggttttgcttctgtgaaacagaggtgatcagaatgataacaattatcatgatgatgacaatgaggctagtcttaaaggcttagcaaggctctggccaatatctaatggataatacatgtaaaagtacttcagaaagtccataaagctatataaatgttgattgtcactgagattatccaaagactgtaagcttagattcagggattcctttgaaaacttgtggtatggacagtcattgcaagagcacagatgttcagagagacaatggggacaacaagcataaaataaaaccaggaagtatcttggttagtttatgctgatatgataccagcatatacacagactgggtaatttataaataatagaaatctgcttctcacagttctagatgctggcattggcaggtttggtgtctggtgagggctgttctctgcttccgggatggtgcctgttgttgcatcttccagagaggatgaacactgtggcctcacatagcaatagacagaatggccaacagggcctcgctagttccctggagcccttttataagggctctgatcccattcatgggggaagaatccttgtgacatttcctttaggacctgtgaagctgagactgctcccggtagacattcccacctcctcctgtctttaataacaaaatcttcacattagctggagatgtggccacctggaatatactgcaattctctgcctcccttgtggttggatgtggccatgtggcatgttctggccaatgggaagctggtgggaatgttcccagtaacttggagagacaactggataagcagagtcattggaaacgtcatgacacatacagcttactaaggacaagtcagagattatcagctctggacaggtctctaaaataatcttctgcccattgagaagatgagaaaattgaggcctaaagaatggaaaaggatggtccaaatcacttacaaattagcaatggagaaaattagcccattaccaatcaccaaccaaccttttgcaccaattactgagttaaagcctatggcgcaaaaatgaagaaccatacccagcgctcaaagaacccagggcctgttgcttagtagggactgaacacagctcccaacttccagctactgtttaccttctgggctaatctttagtctgtttttttcagaatagaaagcctgggagggaaaggtttttctgagaactgatttaacttgtatctattcatccgagagaaaacccagagtttgatgatgttgggagccactttatacaaaatgacaacttaaaggagaggcaaaagtaatctctttaattgcattggttcaatttgtctacctgatgcttttggggagagattaatttaattgattctctcatatgtgaagttccattacctctcgatgcttccagggcatatttatgcagcaaaacttaagcaaagagaagtacatccaggactagaggcaaggattcatttcagactgtcagtgcagctttttagcagtttggtgaattcccttctcctaagttatactctcagcaaatgggtagagtcctctttcagcatgacaagactggaagttgtagattcagttctacaagacttgaggccgaactaaacaaatgaagaggaggaaagggagctgacagctctagagcacctcccatggccagtgagtctcatacatctcatattcaccaccttacatctgtgtttatcaggagtaaggtgcttggctgagcatttcacatgagttggcccgtttaaatctcacaacagccctccaacttgatactgttattttacaggtgaggcactgagactacgtagttaagctactgagcaaagatcacaccaataggaaatggtggggatgggactggaatgtagcactgcttcccaagcattcctgaattcccctccttccttctccctgcctcaaacaacttcctccttctaatgtatatatttccttttaacttcccttctttcttccagtattgaactttggaagtgtgtgtatgatggtgtgtgtatatgtttgtgtgcgtgtatgtgtttgcatgtatgtgtatgtgtgtgtatgcatgtgcatgcctgtgtatgtgtgtttgtgtgcatatgatccatcctttcagtaattttttttgagcactgactatgcaccaggcttggtggttggtgcaagagacaccgcttctgctttcaaggggtgcacaggctgacagcaagtccttctttcttcagtcccacctcaagttagtggacaggacttgtggaatccccaccagccacctccttcccagtatcaccttcctgggctgagatctcactatttctgagctactggagtccctatgtgagaaggggtggaaggagatgaggaacgcaatgtggtgcagtgggcatagcccaggctttggtctcagttaatatgacttggaaagccagcttggccactgctcccagtgtgccatcagccttctcagcctccagccagttgctggatttgtcattttaaaggacttctctcatcatgcctatcccctgattaaacatactctgtgcctctgtccagttccagctttcatcctggggttctgggtaacatatctaacctcactcctacaatcgctctctgcttgaaccacgtggatgactcactatcccccaaacacattccccacctctcagcctttgttcaagctggaccttccatatgacttacctcctccagtcaaaaccccaaccagtcaaaaccccatgcagaatcccagcccaatccaaagactcctccggttcccccaacagggctggttcccccaacaggccttcttgaagccttatgggtccttgcactctttttcctatgtcatctaggttttgctcctcagtgaacttgtcttttctctcagctgaactgtaagctcttcagagagagcatgttttatgcagctcagagcccgagcctctggcagagactggcatacagtagacactcaataaaagttaacgtaattgattaaaatgtctctggaggctgggcacggtggcttacgcctgtaatcccagcactttgggaggctgaggctggtggatcatttgaggtcaggagttcaagaccagcctgaccaacatggtgaaaccctatctctactaaaaatacaaaaatacaaaaatacaaaaaaaaaaaaaaaaaaaaaagaggaaatttgccgggtatggtggcttgtgcctgtaatcccagctactcgggaggctgaggcaggagaacggcttgaacctgggaggcagaggttgcagtgagccaagattgtgccactctactccagcctgggaaacagagcaagactccgtctcaaaaataaaaaataaaaataaaataaaataaaacgtatctggaggcggtagaagggtgggatgttaaaaagcataggctttagcaatgactacttatatttaaagcccatactaccactgcttgtgacaactgccttaatttctctgagccttggttttcttatctttaaaatgagaaaagtaatatctgccttccagggtagttgaagttggtcaaataagctaatacctccaaaaacattttcacagccctggcccagagtaggagaccaatacatagtaactgatattattattattttattatttttctaaaaggaaggcaacagctgagtcagattttttgttgttgtttgtttgtttgtttgcttgagatggagtctggctctgtcgcccaggctggagtgcagtggtgcaatctccgctcactacaatctctgcctcccaggttcacgccattctcctgcctcagcctcccaagtagctgggactacaggtgcccgccatcacgcccggctaatttttttgtatttttagtagagacggggtttcactgtgttagccaggatagtcttgatctcctgatctcgtgatccacctgcctcggcctcccaaagtgctgggattacaggtgtgagccactgcgcccggccaagtcagatttttttattctctctcatgcctgcatctatctgcacatacattcctttaaacaaatggttaaatctctgaatcgtgtaaaagcagaatctattgctagatgatcccataggaaaatgaaaaggtcacttccccatcctcctgagccacaggaaggtacagctgaagcagcacaaaggttctcatgggtcttcataaattcatgatggcacattccctaatagacagtgaaggaggcacgggttgtctatggaatgttcctaacccttgagattgatggatgagagggctacccagcttcctccccaaaactctcccttgaggacactgtcaggcacagaatcctaagctagagcgacaggaaggtgacaggggttaactctgatattcttttttcagtaaacaattcatcaattttatgtcttactttttttcagatgaggttagtggcagaggggagggagaatttaatgatgatgtgggtggaagggcaggtctgctattcaatcacaaccacacaaaaatagaggaaacctttagaagaatgatcagcccctggatgatttagagtattctccactaactgtagtatcgagcttgcataggacgagtcattagtcatcattaactaaagttcaaaagaaataatttaataccttaacactgggctgcaataatttttcctaattgtaatatttagagagcactatttagttttcaaatttgtaacaaagtttccatatattgcagaccacttttatttttctgcttacaccactgaggacagattatcattgcagctcccactggtggagcaattcctagagttgctttggtgagaagcagctccactgcaaatctgtgcctgcaacttagagcttctgcctttgtgtttcattcatgaatcatcagggtgtcagtgtctagaacatctctctaggtcctagaacactgtggagtacaaaagtgtggctccttagacatttgttgaaatgaagctgtcagttgcaagttgctcactttcatctctgtgccatgcacctttgactggaatgtccttagccctctctggacccctccagattgagttagatgaggcctttttgttctctgcatcccagatatgttccttcacgtatagcaccattgggcatgttgtgattgttaactaatagctctatccccctagcctctgagctctctgagatgagggttgtttattgttcacatctttggcaagcagcaaatatatagaaggtgtaggtacaagcttcttgaatggatgagtcaattcatttggatttatcatttgtcacatttctttcctctctgagcctagtcttcctatataaaataaggatgtaacaatcacaggaacacttactaagcacatgctgtatgccaggcatcatcttctcatttaagtcttacaacaactctagaatatggacactttattactccatgctacagttaaaaaaaactgacgttcagagaggtgttggacacgaccagggtcccacagttaaccaggtttggaaccctggtatgtttcactcaagagctcaagacctgaaccatcatatggacctctaagtgaggtgcagaaagggttattttgaacaatgtagaccccttaagagctgaagaagagtaggagcagagagagggagagggtaaggtgatgtttcaacttttatttctggtaatttgccctacatttgatgaggcaagagggttgttactgccatggctttgaatgggggagaaagcttccgaaatgcttccccaagtgtttcaaatctccagacaccctaattctagaacttactctgcaattctagtacccactcctctgtgacctcaggaaagtactcttccattcctacatcttattgctttctcatgtgtactatgaaaatttgattagatactgccattcaatacatagttcttgagtatctacaatgtgccaggtactagagtcatagaaaggtacaatacagacatggtccctcttgggactcttaatccatatgggaagtcagtcatgacacagatgatcatacacataattactaactactattgtgatgggtgcttgaaaataacagtatagagggctttaaaataatagccataccacaaatatagcacttactacatgctagtcatcgttctaggcactttacatccattagctcaatatataatcaaattgaattatgaaacagatattacaaatatcaccccattttacagataaggaagctgaggctagaagaggttaaggagttttcccaacatcacacagctataagtggtataacttaaatccaggcattctgatgccagagcctttgttcttaactaccaagatctattgctgtgagagtatctaatatccatttctaatctagtctggaagtttggtaaggcttccttttttttctgagagtggacagaggtgaagcagtttcctaggtggagagcaggtcgaagagtgttctgccagagggaacgctatatgggaaggctccaggcaggttggagctcatcacatttgccaaagacaggagcagatatgctctaatgagctggatccattttctggaccttctgacagctttttcaagaaacttcacagcaatctgtgcagtggttctgttcactgcccctgcccagctctatctctctttctgataaaagacctcacttcaaacctatgtgacatgtgccagccagaagcccacttggcttgtcatgtgaacagacccatgtcaggtaatcaagagataactgaaccaccagatctggttccctttcatccttgttttcccattcattattcctttccattggtataactggcaaataaatctcaatgtcaaatttaaagagaagagaaactcgctttatgtggcagatttcactgcctcttacttgttcaagaatagggatgcctgtctttggtacagtccatcaacttaaacactgccaattaccaacgccttcctggcattcaaggccctttcaagtctggtgactttttactctccaagattatcttcagtgacgtacatgcatcaggatggtcttctcattgccagtgagtagacatcagttgttactagttctgaattcctcacctaaaatgtgctccccactcctcttctcctcctttgtgtttcagctcacaactgaccttcttcctcaggtttaccttaattgcttatctcacaaagccttgcttcaattcagttttgcaaagctttctaactacaccatgcctgtaactcttttatccctaaactgctgtttctgtaagtgtgagtcctggaccacctacatcagaatcacccagggcaactattaaaaatgtggtttctgattctccatcttaacctctccgcagcaaaatctcggtggtgggggatggggaaagggaaggctgaaattggcattttagcaactcctccaatccaatcacactgctctaactaaatttctttattcttgaattaattgtaattctcccgagagtctcttcaagaatcaatttagcagaatctcttcctcctcaagagaatgaatcttttttttcttttcaagcatttcccagtgactagctagtagtctgtgtaatgatttgagataccaacgctgtccaggccaccattcccactcatgggaaccatcatgtcagaacttcccagtccctccaggtgtccagtttatgctctggaactcatccttcaccctcctgttacagtgatcttcccctaaaagagcctgcaatgtgtcactctcagcatccaataacttggcctctcctatagaataaatgtgcaactccttcactctacaaacataacccttcacaactctgccatatcataaatttccaggcttattcccaccactctaggcaatgcttcactacctgtctttgcaaatacttttagtacaatctggaataacctcttcattctactccctttgaaaattactgcttgcccttgagggcccaaccccaatcgtcccttttctgagaaaatgtccagaaccacctcctttacccccaattcctgctccagagaagtgacagcacctcaccccctatgatccaagagttctgcatagtatataatttttaaaacattgaattaagtgcttactatatgccagccactttgttacatcctttgcatgtcttatcttaactacctttcaaaactcccatgcagtagataccatccccattttgaaaataaggaaactaaaacccagaaaggtaacattccttgtccaaggttacacagctaatgagatgaagagccaggattcaaaaccacagccatctgattaacactaaactgctgccaataacatgagcgacctaaaaatcccaaaaagcacagaatggcccttgtctgtgacgaaacagtgagatggtctagacatccataatatattacctctagcgtagataatcacagtatcctaggaaataaaaaaacagcacccatttgagttgctgtcacataacctagagaaacttgttttaaattaaattatcagagaaagttagatgaactcagagtaactgagctatctctttctggacagaaaattcaaaatggcattgaagtattggacttaaagctaatcttctaggcctgatgaagccacagtgatttattttgaaagctccagggacaatttatttctaatagagatctctggaataacccagtgttttgtgaacctcgacaacgcttattttcttcttaatgcatctaaaattttgtttaaagcaaaaagcataaattcaatattagctttactaggggttggcatatagggtcactcttgccaaaggtagacgttgggacagttatttttctcttatggtgctctttttctgttttgttttgttttgttttcaagtcacttgcacccactataattgttaggagataactgggaaggagaaggcaccacagtattccattcatcttgctttgacaccacaaggcatggtaaccaccttagttagaggcaggatgctgtaaaatgattgtaagctttgcagggagacctcatatattggctttatcaattgttgcttcatcacctgaagcaagacatttagcttccctgaccctcaatttcttcatcaatgaaatcaaatatttatcttacaaagttgttatcaggatcagatgaaataattcacgtaaagtacctggcacatcataagtccttaacaaatgttagctatcatcataacaacacttaaggtgtttattgatatgggtggatttaaatcttccatcttagtatttttttctatttgcccttctgtttttcttcctctattcctcctttccagtcttttttcaaattattctaatattttagaattacattttaatttacctgttggtttttttgctatacatttttgcattttgggtggttgttctaggaattacattatatatccttaacttttcatattctacttaaggttaccactttacatgaaatttagaaaccttgcaattattgaccctttgacccctcatccaccatcctttatgctgtggtcgctgtgtgtaatacatctacataccttataagcccacaggcaatgttataatttttgctttaaatattcatgtgtatttttttttttttttttgagacggagtctcgctctgtcgcccaggctggagtgcagtggcgcgatctcgactcactgcaagctccgcctcccgggttcacgccattctcctgcctcagcctctcgtgtagctgggactacaggcgcgcgccaccatgcccagctaattttttttttttgtatttttagtagagacggggtttcaccgtgttagccaggatggtctcgatctcctgacctcgtgatccgcccgtctcggcctcccaaagtgctgggattacaggcgtgagccactgcgcccggccatattcatgtgtattttaaggaaactgagacaaaacattagttggttatttacattgactcacatactgacaacttccaatgctcctgatttttcctgaagaacttaatttctatttggtgtcattttccttcagcctaaagaatttcctttagcttttctgggtgatagattttcttagttacttttatctgaatatgccgttagtttacttttcattcttgaaagctattttaccttggtatagaaatctattttgaaaaatattttctcttttaaaactttaaagctattagttcttggcttctggcttccataatttatgatgagaaatctatgaggtttcaacttatcatgcatatgcatacaatatgtacacagtttcaaatacatcctgtatatgatatgtttgttttctttagatgttttcaatattttctctttattttaggtttttagtagtttgactatgacatacatagtcatagttttcttcatatttatcctgctggagttggctaactccttgattctgtaaatgtatgtttttcatcaaatttgagaatttttcaactattatatatttaaacatgtttactgccccattctgtttttttctacttcttgactctctctctgtgtgtgtgtgtgtgtgtgtgtgtgtgtgtgtgtgtgtgtgtgtgtgtgtgtgtaatgttttgatatttcccgcaaatccctgggttttattcttcttaatcttttttctttattttcttcagattgaataatttctgttgacctatcttcgagtttatttacactttcctctgtcatcattctgtttttaagctccatcagtgaatatttaattttagatatagttttcaattccagagtttttatactttttacttcattactgatactttctatcttttcattgatttcaactatgtcttcttttagtttattaggcttagttatagttacttccttgacatcttggtctcataatttcaacatctagatcatcatggagtgggtcttagttgatgtcttgtttcctgagcctgtgtcaaatttccctgattcttcatatgtcaaggtattcagggttgtaacccatatgctgccaatactttattgtagaaactttagatttggttacatttctttgaagagtgttgatatttttgtttcagttggcaattgatttagttgggctctagcaaatggatggatgaaaaggagagggaaggaaggaaggatatatggatggatggatggatggatggatggatggatggcagggaggaaggaaaaaagaaagaggaaagaggaagtcaaggaaggagggagggaggagagaaggaaggaagaaagatggatagatggtaggaaaaaaggaaagaaggagggaggagggaagaaaggaagaagtaaggtaggaagaaaaaagatggatatatggatggagagatagatgacaggaagggaaggaaaaaagaaagaggaaggaggaaggggaggaaggaaggagagagggagagaggagagaaggaaggaagcgagggagggagggaagaaggaggaaggaacaaagatgaatagatggatagatggaagaaaggaaaaaagtaggaggaaggaaggaatgaaggaaagaagggagagaggaaggaaggaaagaagggagagaggaaggaaggaaagaaggaggaaatatggatatatgcatgaatggatggcaagaaggaagtaaaaagggagagagggagggaggaaggaaggaagggaggaaggaaggaagaaggatgggtcaatgaaaaaaaatatgtattatgaagctgtaaataccatgcactatgttagcaaaaaatatcatttgtttgtgaaccaaggtgaggaattgggaggatgacacttagtccaaccacctgggaagcctctcagtagagatgaaccatggccctccccctgcccttcaggccagtgcacataccacatcttcacattggttctgatctgagaccatcaggtggagttctgttgggggaaagacaaagcaacaataaaagcaaaagaaaacttttcggtgaactaatcaaaagccttaatcaattctccctgtttccttctctgcccccagagaggagggaaggctcacatgcacaatgagctcattttcctgagtgggttctaataaaggacagaacattaggtttttctctttaagggaacataacgctccttttagaattcattgggatattttggaacacaaataacaacagtggaaggcactcgtgtggtgataatttaatgtaattccgatgtcagtgacacgccacagtggcctagtcagcttccctgggggcggtttcttttgtgttttgcctgggagagtgagtgcgcggacattcatataccagcctggcagccccgtgcacatttcctcttttctcatctccattctcagaatggtttttttattataatccaaaggactcctagggagacaaaagaagttggagatttttccaaactcctaatcagaagagagtccacaagccaaaactagcccacatgcattttcgggtttggcctggaaatattttgtaacactttaaaggatttgttccaacatttaaaatagaagactttgcatggcaattccaatgtcaggcatccctagaaaaatcagaagagttggcaacctgggactcaccctcctgcactccaacaattggctggggtagagtagcagtagcctgccccttaatttggcctgccacgttctcttatatactatggacctatcagctccacttcactcatccgcattttttgccagcctttgtgggcatctgaccctgccaatcctgcccttaagctttggaagcctcaagccctggtcttctccacagactagcctaggtctctctatttcttgaagaagagagctctgggagccaaccgggtctgtactgttgtgatggaaatttccacccaatgaaaggaagaactagttcaagatttcccttttctctttcaaaaggttttgctgtagtacactttcagtcctgccgtttagttgatgcagtttgttggaatgacattgggctgctaatggtgttggccaaactctttgccatttcactgaagatcagtgtcatccagaagcaaggctatggagaagaagcaacccaaccacccacctcaggtcctaggcccagaatataagttctaaaggaaggtagatccagctctgcccacctgcccacactgctactccattttatatgcaactggagctgcaacaatagctctacagagcgttaggctcaaaagataccttacaaataattcagtccagtgtttttttccatcaggagccaatagaaatcaagaaagtgatggtcaggccagatggctttagagcctcccatcccattcaagcatcatcagatatttgttaatagcccattttgtagccaggtgtggtggctcacacctgtaatcccagctactcagcagggtgaggtgagaggatcacttgaggccaagagtttcagaccagcctgggcaacatagccagacctcgtctctaaaaaaaaaaaaaaaaaaaaaaaaatttaaattaaataaaaataaaaattaaaaaaattaaagagactgtttgtgacaagcagaatggtaagcaaaggtagacaaaattcatgcccacccaaaataaatcaaatataaatgaggagaggaatatgggggccattcatttgcataacagggatttcagctagacctgatggctgggaaagatttcccagtgaaataataaaatgtgacggacaagtggaagctaactaggtgaaggggagcaaggacagactattccaaagaggatggcagatttcagaggcctgggatgagagggaacacgcagagtttaaggaattagaagcgggtcaatgggcggagatgagacagggaaatggggaaatttcagaccacacatggcctttcagatcatggcacggggcctggtctttatcataaacagaatgtaaaggttttacagtcccatgaagtttcagccaggaaactccatttttatcttctttctatgttgagattcatgatatgttctcattggaataaaagattctatagctaaaatgagttggaaaccccattgctccaagcaatacttcaagacaaaggacttttttaaaaaaatttttttctgaggcaaggtctcactgtttcacccaggatagagggcagtggcgccatcatggctcactgctgcctcaacttcccaggctcaggtgattctcccacctcagcctcctgagtagctgggaccacaggcatgcgccaccatgcccgcccaatttttgtattttttgtagaaatagggtttcactgtgctgcccaggctggtctcaaactcctgggctccaaggattctcccacctcggcctcccaatgtggtgggattacaggtgtgagccaccacgcctggccaagataagggccttgaaagtagaccctgccccttgagaaagaaggatggcacagtggggagaaagagtgagaagctggagatgagaggaaaagccaaatgtggtccctggagaataagactgcaaatggtggccatgcatcaatcagagtgggattagagtgagaggatggacctcagccttggggtcagaactcccgtgcttgggatgggggttggcaaaaataaagtagaattaataagacatgggctgaaggtccagatgaagacagaagccctgttatcagaaccaaagcccagtgctagatatgtgtgcatccaggagggctgggttctaaatcctggaggatggggatgcttaggctccctacattcctcccactaataatggtcagtatgaatcatgtggctggctgaggtgaggtttaacttagccatatagtcttctccctgacccccaggttttcttttaaagcaaaatacctgcttcatcatggaaacagagtctttgacttaacaatggactattacaattccacatgagagcattagagacctaatacaaggaagcaaggaagtgaattcagcttctggctccagacaccggctgggtggtcctggacatgaacccttaccatgctgggcattcgctttccgacgtgcagagcggaaatactgatgtgttcagtttagcttgaattttgcctttactatggaagctgtcataacacatgcaatctttatctgtttagaggattgtaatccactcatagccatggacattgtcaccccaaaatgcagttcattcacagatcactaacccggggctatccctgcaagttaacaacccctggttacttttatttattttcttccttgacaagaaggattaaaccttcccttctcttcctaacacccagcacacagctggactaggcaaaattcttaaattagagtgtggattttaagaggctgaggcaggaagatggcttgagaccaggaatttgagacaagcctaagcaagaccctgtctttacagaaaatacaaaaattagctgggtgtagtgccgtgcacctgtagtctcacctacttgggaagctgatgtgttaggattgcttgaacttaggaagtctaggctgcagtgaaccgtgatcatgccactgctctccagtttgagcaataaaatgagatcctgtctcttaaaaaaaagaaaaagaaagaaagatcttgagcaaggatggattgggcccacaggacaagcccaacattgtgcaaggcacagggcagtacaaggacttcccaatgatggcctctgtccacacattgcttaataaccagtggcattcatagtagtatttcaagaattcaaagaggtctgccactgcaagagaaactaatgactttggagatcagtgaccttcttgagtaacttgggaaggaaaagctatacagtctaatggttaagaaaaaaaggcattgggataaattttgctttaaacctagctgtgtgtcctagagcagctcacttcacctctctgagcctggtttcttcatctgagaaacggaagcagtgatagttcctgcctcacagagctgtcctgaggattaaagaagtagatgcatgtgaagtatttcatgcagggcccggcacacggaaaagaaccaataaacgtcagctattcttagctacttgcatcctagacccgttttctcagatagaacatttgcaggaacatggattaaaggttatggattccctgatggggaagaagagggaagaaaaaactttaaagtcctgaaggagccagaactatacaaagcaggaatatcatgtggagtattatatataagaaatgctggtcggatctcctgcggaatttcaggaaggaagcagcttgcccagagaaaaggtgtgaacagacagacagcaacaccttgtttttttcagaagcttcaacaaaaggattttggcgccagttggcccagatttggaggggaggaagaaaagagtgggttgcctgcagtcagaaagagactgaaaggagaaggggaaaaaagtagaaaacacagaattatgacttggggaatagacagagtttgcggggatgtttctgggtgggtggtgggcatggcattgatcaaacttataacactgatgaatagaaacatataaatgactacataaaggaatacatttagagtgcctggcatatgacaaaaaaaaatgctcaatgtgatttagtacgtattcattgggcaggcactaagtaagtgtttattgaactaaagaaatgaaagtggtacatactttttaagggaggagaacagaatcgttcaagaaaaatgtttctcagccctgaactttcatcacatgggtggtgcttggttagaagcgaagaccgaattacatgtatcagtaactttgtaatttacttaaatttattgttttaatcatgatgttaactgagatcattgtagagtttatgtttgtcctaagatgtacttcttttttaaaaaattttaggttcactaggtatatgggcttgttacacaggtgttacatgcacaatggtggaggttagactctagtgcacccatcacccaaatattaaacattttacccaataggtaatttctcaaccctcaccccacctcccactcagacatacttctgcatgttcttggtgaggtcctggtcttctttttccttgcttggaaaacttgctggatagatgactcccaccatcttgaaatggcaaaccaaaatgggagaggcgattcgttttgtttccaaaagaaaacagatccctaatggagactcaggaagggatgaaagaaaaaaagaaaaggctcaatccatatcaatccctaagaacactggagagcctagctgtgagaggtaaagagaaaaaagggagcaaaaggaaaccccataaagaagtaaatgaatgaatgaaaagaattccccaggccttcatttcatagactgaaggttgtgcccccagcctgaggtgggtttggatcaagtgctcaatcccagtgacttgtcagggatcctttcagatgtgttcacctctgggaagaagggccattcgcctggggtgagcagggatctgaggaaacgtttagggcatcttgactgatgagctgagccttatctacagagcagtgtgaacagcctgatgtgatgagctcgctttgcaaggcactgaatcatcccagcttctcgctgacagaagcagagcagaggtcccggatgctccttattgcatgacgggagcactaggtgaagccacggaaattggatttgagtgattcccatcttcctctctccctgcccccaaactagagcattctgaccatccagcaagcttaaaggaacagaagcaaagcccagagaggaagaaacagaaaccctgtcagaagcaaagcccagagaggaagaaacagaaaaccagggagagctgggaccttgcgcagtcccacgtggtcagttagtggaggagctggaaatgatctagctctttctgctaaatcagtctttcctgtctcagaacttttcctgagaaatcactcaatccctaaggggacagctgacctgtccccaagtggtggatgtttagtttattgtcctaagaaatgatccagcaggggccgagtgtgatggctcacacctgtaatcccagcactttaggaggctgaggcgggaagatcacttgagatcaggagttcgagaccagcctggccaacatggtaaaactctgtctccactaaaagtacagtaattagctgggtgtagtggtgtgcaactgtaatcccagttaatcaggaggctgaagcaggagaatcatttgaacccgggaggcggaggttgcagtgagccgagattgcgccattgcactccagccttggtgacagagtgagactccatctcaaaaaagaaaaaggaaaagaaaaagaaaaagaaaaagaaatggtccagcaggtaaaagtagtgtccttatgtgaataaaaccaatttggcaatcatcattatcatcatcaaaatggccaaaatttatcagacatcatgctattaatttgtattaaatctgtacaaccacccactaggtcattctcattattgtccccagtttgcatatggaaaatctaaggctttgagaggtaaagtcacttgcttaaggccatataaccaggagggaagtggtagggtttagcctggaccccttgatgtctggtgtcaatgccagagctcttaaccactgggctctcctgcacccctgaggattaaatgggaataactgggatttgaacccaggacttctgactctttagtgctttgcttttttgactaatgatgataacagtaactcactaattatcatctcatttattccacacaatagctttaagtacctgcgtggcaacttgcactcctccaggattacagtgctagtaggtagcagagctgggaccccagaatgccccattcttcccttcccaccaccatagtgacatttccaaacccaacactgactataaccctccaacccttgaaaccaaacccagactcttctttggaacttacaagacatgcacaatcaggtcctggctatcttctgtatcagtgacatcctcccttttttctttcggccacactgatcttcttgtggcttctgccaacacagggcttttgcacctgctgttccctcttcctaaacatttctgtaaaccccttcctgacttttggcctgattaccttctacttctctttcagacctcagtgtaagtgtcacttctgaagacagctctgtctcttcctctggggtatccgtctattagtgggtccacattaatgtgattatttaattaggtaatgttaagtctctgcccatccaatttcaatttctatggccatgagcaagtcccccactctgggcctcactcttccaatctgtaaaatggatgacaaggccccacggttctttcaagatcagcttatatggccccaagtgggcctcgcaaatacaacatgttgtgtgggactcctcctcctcaaggaatttcccctttaggtcctgccatacggcattttctaaaattcccttgccacctgctgcgatggaaggcgaagtgcctggctttctttcatgagagttgaattgaattctgaacgtagaagacacttctgaggctgatgtcgacaagaaatgaacacagacacaggctccctctgcaaacagttcctggagacccttctctgtcctgtcaatctcctgggtgctggagagcagaggtaaattagacacacttcctgccgttgataaacacacagttgagtaggaaaacagatgcaggaatatacacagccatcaggtagagagaaagaaaaacaatgtctcccatttattgaggacatgctttgtgtcaggccagtgctgagcactttataaatacccattcattatccctttgcaaccctaaccaaagccatctgaaccactagttttgtttgtttgttttgtttttttacttttaagttttgggatacatgtgcagaacgtgcaggtttgttacataggtacaatacatgtgccatggtggtttgctgcagctatcaacccgtcatctaggttttaagccccacatgcattaggtacttgtcctaatgctctccctccccttgctccccacctcccaacaggtcctggtatgtaatgttcccctccctgtgtccatgtcttctcatttgaactgctagttttatatatattactgagacttaaagaggtgaagtaggctgggcgtggtggcttacgcctataatcttagcaatttgggaggctgaagtgggtggatcacttgaggtcaggagttcaagaccagcctggtcaacatggtgaaactctgtctctactaaaaatacaaaaattagctgggtgtagtggtgcatgcctgtaaacccagcactttgggaggccaaggcaggtggatcacctgaggtcaggagtttgagaccagcctggccaacatggtgaaactctgtctctactaaaaatacaaaaattagccaggtgtagtggtgcatgcttgtaatcccagctacttgggaggctgaggcaggagaaatcgcttgaacccaggaggtggaggttgcagtgagccaagattgtgccactgcactccagcctaggcaacggaatgagactctgtctcaaaaaaaaagaaaagaaaagaaacgaaaagaaaaaagaaaaaagtaaagtaagcaaagcacctggtccccctgaagagtcataggcttttcctttctatttctttgccttaaatcattccccagccatagccagaaagttctggattcgagtgctggttatgcctttaattggtacatcacttctttaagcctgagctccctccactagcaaagtagaaatagcatcaccttactcacagggcggctgtaatgtttaaataaaacaaatcttgtaaatattcccagttggtcatagaagatgttcgagaaatacaagttttttttttttttttcgctcctggcaaatatcagtaggaaagcaggtaggaagaaaacaaccccacaatgacaaaaatgaacaagattggacaagtctgagccctcttgcctttttattttttttgtttgtttttttacaaaatctgttttatatatagacagtttgaaagaatcaagaaattagaaagtttcactgagcaaattatagtgcttgcttctttattttccatacggactcttgtctcagacttcaagaacctatttgatgtgaatccatctcctgagcccaggaaacctacacaagccagtaaattaaccactttctaagggcatttttaaaaatctgaggccatgagaaaaagaaataataattaaaacaactaagaggagaagttcaaagaggatcattaaagttctgggtatgtgaatagggaagatgtaatctcagcaataaagaggatcatgcaatgcctggtgacagcgatgaaaataaaaagaacagtgtcacagggaagggaacaacacacaccaaggcctgttgagggaggtaggggagggagagtatcaggataaatagctaatgcatgcgggacttaataactaggtgatgggttgacaagcgcaacaaaccaccatgggacacgtttacctatgtaacaaacctgcacatccagcacatgtatcctggaacttaaaataaaataaaaatctgaaaaaagaacagtgtctttccaacagcacaccaggtaggtgaagaggcttctggggtggggatgccagtgagctttgatgggtgaagtaagcctcacaggaagtggagagacgcagatgtgggagtctgatagctccagttagaaccctaggtccaccacctactcacagtgagaccccaggcaagcggctccacctttctgggccacagatgccacagatgccatatctgcaaaatggacatcatcatacattgatcattgaacaaatatttactgatctccggccttgtaccaggcagggtcctggagctacatcaatgaacaagactggcaaaaccctgccagtgaagctgacatttgcatagaattgtaagtcagcatcagtaataacagcgaatctgccattgaccctctcctcctcaattctccccacatccctttgaggcaggcagagcagctgttgtgtccccattgtgcagatgaggagaccgaggcctagtcacacacctagcattgggttgcagggctcctgactctccacttagttgcctgtgtgttagttgcctgtctgtcagttgccttgggtgaagcaggtctcattgccaggtgagatgatgatgagacaggtgctacacaggcttcttcctctggctggaactcatccctatgatgtcactatatgtaaagcctacagaagctgtcacagtcactgtcatatggtcctgcaatcccctgcctgtccctcccccattagattgtgagctcatccatgacaggggccactgggtatccccagagcttagcatggggtttagcacccagtaagcactcaggtagcacatgatgaataaaagaatggatgaattgagagaaggagaaaggaagggggaatgtgcttacatcacacaataaatactgtatgaatggatggatggatggatggatggatggatggatgggtggatggatggatgatgagtggttgattggagggaaggaagaaaggaaggaaggtgggagggaaggaaggaaaggtgaatggataaaagaagaaagaaaagaaagaagagagggagaggaagaggaaaaagtagggatggagagagggagaaataggcaaatttcctttggaagagtcagtgaatgtcgaacaaataaagtattaaatacaacccagatcccttcttttgcctgcttagcttaccccctggccttattcacctgaccttcccttcatccttcaaactgcagttaaatcttacccctgtggtctgttccagcccacagagactggtcttttttcaagccttgtagtgttcctccaatctaatttccaattaacatcttggttgcacactcttacctcccctaattgaaaccaaccatagcagtttttagcattgggtagtggttaccatcacaggcctataggaggaaaactagctggcagaattttggctctgtcactttgctagaaagtgactgagaaagtcattccaactcccagagcctccattgccccaaatatgaaatagacacactgcctcacagaggtattaggaagacttacaccctgagaaagtgtgcaaggagcttcatgtgaatcccggcacatagcaagcactcgctcgtgtcaatggctatcattactattgttgcctaacctgtgattgtctcatctactcaacaatattttaaggttctaagagaaaagcaccatctctcgtacctggtgtgtgtgcacctgaattcatgcgcgtgcacacgcgtgcacacacacacacacacacacacacacacacactccctagcacaggactggatgaccagaatgcttattggttgatttctgcttggacccaagtcaagaaagtttcatttctaaagatttattgtaggtgagaatcaattcgccaatggttttatctaagccagtcttttagaaagggccttattgcaggaaaccagagacaaatgaaaaggcaatctgtgtgcatgttgtcaacaagcttgtgggagctcctaatactatttccctgtcaaggtatcaatagaagagaagacagtttcccagaacatgggcccggtactccctccacataatcgcctggggtggcagtgggtggctgtttagaaatgacgatttctgggatccattccagacttactaaatcagaaactctcgagttataacctgggaatctgcattttagcccactccttagatgattctggtgcatgctcagggaactgctgccatgcccagcctcacaggaacttagagtgcagcacttggagggcctttgagggtttctagtccaacttcctaactttacagatggagcaagtgaggcacagagaggttaagtggcttatgcaaggtcacactgcaaggcagtgacagggctgaaacacaaaccgaagacctcactggccagctgcctttactccattgcatcacccacctttttctctggaaggagttattgctgcctctgcaaggggaagaggtgaccagcattattgagcccttcttgtgttctagccacttgacataggaccttctagcaatcctaaaggctaggtattaccatgcctatcattctggagaaaaaaaactgaggattggagagaaagcatcatgtttgctgaacagcaaaatcctctggtgtataagacaaatctcaatatcatagggaaaaaccggggggaacgcccacatacatgtgaaatgatttgaaaatgggtttacataaaaaaatttttttcatttatgtaagcaggatatattatatgctagaacccagtaggaaatctctggcccatgacttgctgttgttagaattttatccatcacagtggttcttaaccaggggcaattttgcccaccaggagatatctgacaatgtctggagacatttctgggggtcacacctggggtgtttgctaccggcatctactgtgtagagtccagagaggctggttaacatacaatgatgcatgggacagcctcccacaaaaaaaaaaaaaattatctggccccaaatgtcaatagcgcctaggttgagaattcctgatctgtaagatgtgaactttttacttttgttgtgacatctttgtggccacctccaccgtaggagttgtagcagctcaccccaaacgtggtagtcacaggattctttccttagctgttctgtcttccacccacaaaatgggtatatcacggtggtgttagatgttgtgagtagaagacagaaaataggttctatgtgaaccaagtctcctgtcaaagataatgcagctaccaagaaataaaattagactccaagtccaggtaggtctcattccagaattaatgatatttcaagtgttgttcttgcctcatagatgaatcctccatatactccatatattttgcaacataagccactaaatttccttgcattgaacacagtctatttttaattatattgtagagtaaattggatttcacaagtttaatttcaagcacaaattgtggctcctcagcctccccttcagtggtaagaggtattgcttgggagctaagaatgtggatttatgatcagcctgagtttgaatcttggcccagctgatttttagctgtgtgtccctgagaaaaaaaaatcccttcatttctctggaactcagtttcctcctccaaaatgtggagataacaatagaacccacttaaaaggattattgtgcattttaaatcaaataatgcatataaaacactttgtatggtgcctggtacatgaaatgccctcaatgaatatcaacagtaataattattatcatcatggtcattgtcatcataattgttattataattaaggcccccggatagggagaaggtggtagattggagagtttggggaatactaggcatttgtaaaacaaagctggtacagtctggatctgataattcatcacttactaaatttgacccatcatttttgcttttaatgaaaatatattcaatattggaactaattactattaaattggcctcgttattaagcatcaagggatcaatggtggactcagtgggttatcgtcattgaataaaatgtctcaaggagaaaaaaaaagttgaattaatacacaatcctggagccaattgaaaaatccctaataacaccggctgttgctgacaattaattctaggagtctgtaaatcatgaaagagctttggaggcagaaaccaagttagaagaagaaatgaagaattcaactcatgctggctctctcagaggttctataaccaagagggagttagggagatttgaggaaacctattactccaacgaggggtatggggcagaaggagacctgaactaggagtcagcctggcagggcctggctcagcttctgttctctattactgggtgcaggagtaaagggggagagaaatatgagctatcagagaaggagacagacacagatcatctagtgcccttaagcccatggcaaggagtttgggcttactctatgtgtaatgggaagtctttgttgggattagagcagggagtggcttcataggattgtgtaaaactcactctggccactagacttcagaaagacaaagtgggaaactggtaggaagttattgcagttgtctagataagagtctacagaggtttgacataggattagggtggtggcagtggtgatggagaagagcatacagatacaggatatgttttagaagtcaagctggcaggaagtgctaatagactggctgtggagggtaaaggagaaggtaggcaatcaaggatgctgcctagattagagcttaaatagttaggtagatgttgataacctccatcagtcagctattgccacgataatgctgtgtaagaaactacccccaactcagggacttagaactgcaaccacatgactctgcagccatctgcagttcagctgggctataattagaaaatctgttttagatgtgccactagctattgttacaaaaaaaaagccctacaattaacatgtttcactttggggcctaaaacaaacaaataagctactcttaacaaatgaaaaaaatcaatgtttgaagaatctgtggtggtctgacactaaagtgacctgaaaagatttgtcccagccattctacaactcagggcatcaagagagaggagaacactccaatttctcccaggctcaagtaatttcagttttctgattagcttggtgcagctctcaggaactctgttaggcagatgacttgtcacaccaaacacaggacgagctcatcactggtcaggaagccaactcagtcagagagattggcttgcctccccctaatcaatgccatccacaaaacactaagagtcacaaccactgccaagccagctcttgctcctccatgactagttttgagcagcgggatcactcagtctgtcagaagctattagactcggattggctgattttgagaaagagggtggggggatttttttcaaggacaagctgaacacatagaagggaaaacacagtggccctagcccagcatccacggctgaggagaggaattagatgactcgaagaagaaagacaactgacaaaatgatgtttttagctgtgttagggtaatgcattgtgttccccactgagaaagagggattagggatgtgcttgaggaaaattgttgccatcccaagtggtaatttgcaatctggacaggaagtaaataagtgggactccacgagaaaccttaagcagctgcatttaggaacaagctgggctgactgactgtggctgtctggaaggtgaaggagtttgcaaataaagaatggcttctagttccacccagcagcaaatcttcccttggctttcacttctcaactcaagattccccccatgccctagacctggtcctgtctctgcattatttgctggcttagtgaacgatatcaccatatctatggttgagcaaaacaaaaacttggaagtcatccattactccttgctctctctcacttcccttatccatccatctccaagtcctgataattttgcctcataaatatttctcaaagtaactcgattttctccatccctgctgccaccaccctggtctaagccaccatcagctctcacctggccaactgcaaccatccctcactgggcctttggcttccagcttgttttgctttccatccatccttcacattgcttgccatagagatcttttcaaaacacacatctgccaattccaccttcctgttataaaacccttctgtgactccccattgctttcagaataaagaccaaaatgatgaatgtgatccactgttcccagcatggtctggttccttgcccacctctcaccactgctcaagctgttccatgggcttgcaacacacttccctccaactttcaccaagttcacttagtggcttctcaaattccagctcaagcatcagttctggatagcacctctctgttgctcccaaacacccttacatttgaaatcagaaccttaagcatatcagagaatcaagttcttttccttcagtgcccttatctcagctagtaaatacacctttgtgggttttttgtgtgtatatgtatgtgtgtgtgtgtgattattcagtggaaatcagactcctggtgagctctgtggcagaaactgtggataagtttactgaacacccaaccccctcccatcctctctagcctttctctaaaatggctgaatttccagccttccttgcacccaggaatggccatgtgacaccatctggccaatgggatgtaagcagaagctgccagctgagacatgcaggaaagattttgaagagagcagactcaacttggatgccctttttccttttgccccatccctttgttcctctctgaaatagagagacaaagaccccttctaccatgaagaatgaaaccacacaataaagatgagagagcagaaagaggagctggggtccttgttgtcactgttggtggtctggtcagctttggtccacgtaccacagaactcttactgccagtaggtcagggtttcctgttactagaagctcagttcaattctaactgatacaagctccatgaacatgtgcaccgtgtctatttttgttccccacgcatccccagcgcagtgtctggcacatagtagtctctgctcagcgaacatctgctgaatgagtggctggagagagcacggtctttggagtcctgcatattcaggctcagagtcttgctctgcagctgaaggctgtgtggccgcttaatttctctgagccccaatttcctcaagcataaaaactggatgataacatcccaaggttttattctgagggtctaatgagctgacgtgtagaaagtgccagaccttgactagaagctcagttaatagtatttgttactatttttagtaacataatagggctttgttttatttttagagttgaggtctcattctgttgcccaggctggagggcagtggtgtgatcatagctcactgtagccttgaactcctggattcaagcagtcttcccacctcagccttctgagtagctggggggctacaggcatacgccatcatgcccagctaatttttaattttttttttttttttgtagagactggttcttgctatgtttcccaggctggtcttgaactcctggcttgaagtgatcctctcacctcggcctctcaaagcactgggattagaggcagaagccaccacacccaccctttgttcgtagtacgattatgagtgattgggtctgtcacctccaaatgtcactttgggtgctgactgtgtacaaggcactatgataggcacttggggtgccagggaagcctgcagagtggcctctgccctccaggactgggctgctcacttagtgatggaagatttgcacacatgcatggagaactcacaatgcccatctgtaaaaacgtgccaatggccacagaagggacacaagccccgcgagagtggaggaaggggcaaaataatgtgcattgataaaattgtccctgggaacagtgcaggacagggagcctgcttcctctacattcacttacttaacaaacacttgtcaatcaccttccatgaagcagctaagtgctaggataacacaggcacccaccaacagaggtgcagaaatgattaaatgaatatgcttgcctgcctgaacaatggattaaatgagcaagtgcgtgaacaaatgaacttctgaagaaaaacaaacgagctagaaaatgaaaggagtattcccaggaaataaccatgctctaaaaaatgagagtctgggtcgatgaagggccaggctgcaggcttgtggcccaaatcagagtggggaaatgtggtcgggcgaggttaatgaaggtgaggggcggagttaggatgggaagataaggctacaatccacaccctgccccctgccccaatgtcctgtatgtgacactgtgccatttgtcactccacacgtttttactggaaaccatgtatacaccagcatggtgctgggcaatgggtacccagtggagaagaggacaaaaccgttcagccctctatgcctcctcatgcttgccaaccttccctccttcccagttctgcttcctcctctcagcccaccttgaagatagcagagatgatggtggatctaatctaatatgaatggtagttgccacttactgggggcttgcttagagcaaagtactctccaaacatctcctttaatgatcacaataacaccatgggttaggaagccattgcaatgaggaaattgaggctcagagaggaaaagaaacttccacgaggtcccacggctattcattggctgcaccagaagaggaacccatctggcctctttgttactgtgctcgcctcctcaagtttttactctaagcaagtgaggctcaaagtttaaggtgcatcagaggatgctcttgagggattacctatgaccaccgtgttgattgtagtggtggtttcatggatgtatgtatgtcaaattgtattaaactgtactttgtgtttttttgagacagagtcttgccctgtcactaggctggaccgtgtggcatgatcttggctcactgcaacctctgcttcccaggttcaagcgattctcctgcctcagcctcccgagtggctgggattataggcatgcgccaccacacctggataatttttgtatttctactagagtcggggtttcaccgtgttggccaggtttgtctggaactcctgacctcaggtgatccacccgccttggtctccccgggtgctgggattacaggtgtgagccaccactcccagccttcagaggtattttaatcaattatgttaacctttattgagtgtctcctatatgtcaggctctgccccgggcttgtaactgtactctttaaatgtgcaatttattatatgtcagtaatgtctccagctgttttaaaaaaaataatcaaaataattaatatgcataacaatctctcaggctgcgtattagaagactctcagaccccacccattgccaatagggattttgattcagcagctctggggtgaggcccagcaatctgtgacttaagaaacatcctctggaggattctgactctgctgccccaatttgtgtgtagcctgaggtccttaatacaactgcacctcagcatcccttagggaacgtttacaaaacaccaaggcataggactcactccagatccacttagacagggtccctggggatgggacctggaagcaggtattgttttgaaagttccccagatgattcaaatgtgcagccaggactggggaccaccactgagctaagaagcatttcaggacgtcaggctagggctgttcaaagccaggtgcaggtgttaacaaatgccccctgctctgccaggaaaggcaagtcaggtcctgcagctattccagaagaaatggaaggcccaaattctcttgctaaaataagccttctctctctgaaccctggaattgttcttaatgcatgtggcatcatgttcgtcaataatctcctgggcacagcatctgagaagccatgcacagtgcccgcagctgtgaagacgtctgctgtgtaggagctgaggctaagccgtggccctggcatcagcatccacaggaacaggcatccctccagctcagcttacaggctgtagagctaagggtgactgagacaagcagaatctgctgtttcatgaaacccagaggcagagctagcagggccatgagaaccatctcatcaagcccctcactttacaatttgggaaactgagggagaaaaaaagataaccatttgagagttactccttaaccataaaggtaaaaaaaaaaacaagaagaagtttctcctccatgcagcctgccttgactgcactgtctctctcgtgctttgggaccctggtcaggtcgctcagtcattcaacaaatacttattgagcactaactctgcgccaggcacagagctgagtgctaggataacagccatgagcaagactgacaaggttcctgcttttgtggtccttatattctaatttctaatggaatgaatcagataataaacattcagcacacagctagataaacagaaagtgctgctagaacaaggactgaggaaatccttcagggaaacagactggagactgcctgcagtcaccactggccagagtggccagatgaggcttcagtgaggaggggatatttaagcagaagcctgagaaaagggagggagagagccccgggaagaaccagggagaatgttctgggaagagccagagagaatgcattccaagctgtgaatgcaaagatccttaggaggggaagattttgatatgtctagggaaccaaaaggaggccagagcagctgaagtatagtgagccatggggaggctgattattgacgaggccagcacagtgacctagggacaagtcgcccaaggctttccaggccagcatggaagttagttttaatgaaagacgagcaagccccaaaactggggcttagcccaggagggttcttggctttgcctaggaaagaattcaagggccagccagtggtgttaagcagcaacttttattgaagtagcaatgcacagcagcaggcgcaagaggtattgctccctgtggagcccggctaccccataatagtgtgcccagagcagtagctcagaggcagttatgcacccatatttatacccacttttaattacatgcaaattaaggggtggtttatgcagaaatttctaggatgagggtggtaacttcagagttgtctggtcattgccatggaaagggacagtaacttctgggtgttgccatggcaatggtaaactgacatggaactctggtgagcgtgtcttatggggagatgctcccaccctggccctggtttagctagtcctcaatttggttcagtgtctgagccctgcctccagtgtctagtcctgcctcctacctcagcttgattctcaatatgctgggaagcctatgcagagttttctgtttggaagggatgcctctatctgtactgcaaggagaccagcagtcattgtccagtgagagtttgcagtaggggatgcagtttctaccacactgagtaatggccctagaagtagacttgctgtccacatttgttctattcttcctttggtgctgccttcaagctaatatctctgtgtcaaggcccaggagacagatcattcatcacccgccctgccttggcatctggctccgcaacttggcagaggcagaaagcattctgcgtttccttgcctgcccccacgatgcagaagcccccagccctctgtggctaagcaagtgaccactggtcaaaatcaattccaacctaagtttggcccttagctgtcacctgagtggaggccaactgcaagtgccatggctgtggaccctggtaagccagtttgtcatcctgtgacatgagggacatgcaagtggaggggaaggctacctgccctggggtccccacagcactccatggggcactgcaacagacctgggtttgaatgcaagctccaccacctacttggtccgtcactctgagcaatgacttagattctctaaggctcagtttcctcaggtatgaaatggggctcatggggtaggtgaggagaaaaaagtgaaggcgtaacacagttcctggcacctagtgagcactcattcaatcagaattcccattcttcttctggtttcagagcaactatagcaccaggaaaagtccttacccgaaaggagtctcagtttccccatctatgaaaggaagtagcaatatgagctgaactctgaggaccctcctgccctgaaagtcattaagtctctctctctctctgtctttcacacacacacacacacacacacacacacacacacacacacacacacactaagagcccaaactctggaaacagacagacgtgtattcaaatgtcaaccttacctgccctgactatgtgactttgtacaaaatacagccatgtgccgcataacaacatttcagtcaagacagcccacatatacaatggggatctcatcacattataataccatattttcaccgcacctttttcatgatccgatacacaaatgcttaccattgcattacaactgccaatagtattcaatgcaattacatgctgtacaggtttgcagccaggagcaataggctacaccatccagcgtaggtgtgtagtaggctgtcccatctagtgcacttgtgcaaatgcactctctcatggtcacacaaccacaaaaccatgtaattatacatttctcagaacatatccctgtcattaagtgacacatgactgtatttaacccctcgagcctcagtctcctcatctgtaaaacagggaggaacacggggacgatgtcagaaagtggtctggagcttcagaaggaccctgcaggtaagcacttagcccaggggttttagaatcaatgtacaaatgtcagctgttagactctgtcctcccccgacacacacacccttgtgtactcagcggcgctccgccatgggttaatctaagattgaagcagagacacaaattttccattcaaaacccgaagaccatttttgttcagtaatagatttaaacaaagttttctctcacagcaatcgtccctaatctccgattgttccctttttggagatgcagtgtctttttgcattgcttagagaatacaaattagatattgtctgaagcctttccctgtctccagcagtgctgcttcctcagggacattcactctctctcctcatgcggcgcctcttcctggagctgccttcatcctgtcatgggtggcgtgatcccccctggcacatctttgcaggtggaaggtggacatttgtccaggattgcgggctgaggaccctggaggagcctccccgaagtcctcactctccaccttcccacccagggaagaaataataaggaaagaggagggctgtgctgtattcatagaaccccatgcctcctggcaccatcatgaggaagggaagtctattacgctcattttacagatgaggaagctgaggctcgaagtcgagcatgcggaccaaggtcccacacctttgctccagtccctgattctccaagcttagggagaatgtgccagatcagaacttccattccctcattctacatgtatttattgagcacgtactacatgcaagcctctggtctgaacatggaacacagatgacaaacaagtaaacccacaaataagcaaggtaatttgaaattgtgacccctgctatgcagtgtcataatgagtgttggggtatgggggaagagggtaaatgtggttccctagaaaggtagtcccccatagaaggtgacatttgagctggggcctgggcagtgaagaggagccagccaggtgaagacctggaataagatggttccaggcaaaggcaagcaccagatggaggaccgggctcacccatcctggctgggcattgggaagaaaggcaggagtgcaggaagtgaggctgggaagccaggagtagtcagttcacatggggttctgatgccaatgtaggagtttgattgtattcttagtgcaattggaagccatggcatgggggacgtgaatcagccacttgacactttagaggacttcctgaccaccttgtggaaactggggtgtcaggatccaagagagggggcaggggagtcattctgaaacatcacgttagctccttgctgcatcttgggaagttcccaggaaagacagattggcccgaattggaacccaggtttgtgtgatcccaaagcccacgctctcttggctccagctaggctggaccttgggggaaggaaataatggggccagcagagagaggggaacttaagccaaagaaatgttccatctgaaagccagtgcattccctccctagcagctgcgagtaaaaaatagagtgggtcggaattagcagaccttttttttcctttctaatttatagctcattggttgacgtgctccttgggagaacgaacgtcttgctctctggcttggcagcaaagtcaatgacaaagtactgacagcccagaacagcattcttcctctgtatgaggtcatgaataaggctgggggctcatctctatgcctgggcatctcagcagaaggtggggaaacccaactgctggcttgatagccacaataggcctatttctgaagctcattttcccaaacatttagtaaactatatactgtgctctaggcaccagagaaataaaggcaaatagagcacagcccctgtcctcagtctagaagggacacagccacatatacaaataattacaggaaagtgtgatgaaaactgcagtagcagagagaaatgacctcgggtatcagggaaggctacctggaagaggtgatatttaagctaagtcttgacagattagtaggagttcaacagggtagagatacccccaacggctgatactgggaggaattcaataaatgttagtgtcttattctgtttcctagtgctttctcggatgttgcttttgtgtgtctcaccatattgcgtgttcactgggaatgggaaatatgcctttgccttctcttccatcccctacagtagtgaaaacaggacctagtcatagagctaagtctctcaaatttggcactattggcatttggggttggatattccctggtttgggacaggagggtggagaaggggaagcccattgtatgatgtttaatagcatccctggcctcttctcaatggatgccagtagcacctcctccatatccccaagcaaacatgtccctctgggaacaaaatcactcttggttgagaaccactgtcatagagtatccatgtatttattcatctacttaattttcattaatgaattcaacaaacatttactcaatattcaccatgggccagacacattgctaggtactaggaacacagtgttatataagatacagccactgctgctgccctcagagttgcctggctggaggggcaaagagacaaggctatgatggggaagcaccgaggctgtgggagcatgtagggtgagggcatttgagatatggacacattccaggaagggtccctggatgaggtgataaatagacattagccaggtgaaagagagggaaggcattctaggccaaggaagaaagagaaggcattctaagccaagaaaatgacaagcaaaaggcttaggggcttgaattaacttgcccttttggggaagtatagcagctcatacctggagcatggatctccaaggaggacagaggggtagaatagaggactctccagtcattgagaagagtctgcttcatccggagggccatggggaagccatcggagaattccaagcggaaaaagaaggaatatgatcagatcaagtaagaaaaactctggctgcaaagtgacagagaagtttcatgaagctgcatgagtcactgggcttgcggccttggaagatgctctcataacatcagaggcacctcctggccttggcctggccttggccctgcacttcaggttggatcttgcccccctgtctcgggcaacttgaaatctgcatctcaggctgctgtgcccacaaaagcctccttcccgtccaccagtttcccagccatgactgtccctccaggtggatgcaggaaagtgttttatctacccatgccattaaacctgccactgagcccaaattgcctttggagtttgagggcagatggcagtgcaacgtgtggctcagctctggagattcggcatggccaacccattagttctcctggagctgaacagagggggaccgaccctctaattgcttgagaacttgggtattattgaaactccctcatgcctgaatgatgtatgactctcacagtgtggctcagccattgccagcggctctccaaaacagaccctgtcttattttttattccatttatttatgcatttggtcgatctctctgggaaggtaagtttttaaaatactgggtatggaaacaggagatagtcaaactttccgagcctgtggacttgattgattgaggttgtgacatttatttccaaagcatccttcaaaaagttggttatagactaaaccaccagtttcaaatctggggtccccctgactctaatagtctttgaaaggagtgatgggcagggagaggagggggctgagagagaaacgaagtgttttgaaaactctaatggagattctacttagcaaaactaaggctgaatgtgctagctaaaaaggtcaggtttttctggcttaaaatcaatcagtaatacctgcaggatgacatcctgaccatggcctctgagcctcagcttggtgtggctaccattagcctctcctctgccttctgtccatgcagaagcccccatacacaacagtccccctaacacaccagccttattcatatccagaaccctcaaccagaacctgtctctgctccccctttcattctctgcctcgctctcagtcttcccactcccagaagctgccactgaccatccaggctgggctagctgccagggagtcctaggcagtgggatgttgagtcacacagggataggttcaaatccaggcttagctgctcaactcgaggtgtgacttccccacttcccctccctgagcctcagtttccctgtgtgtcaaacaaggataatcaagtttctacctaatatggttgtcatgagaactattacgtaaagcttcttagcactgactcgctgctgagtaagctctaattcacgttagccactgcttcattccttcaattacacgcctgtttcccacaatgagcagggaccaggtcttttgcctattctcaggttctggtgcaacgtctcacaaataggaaactcccaataaaatgtttgcatgtagaaatccaaagatgtcagagtggaagccagagccacttatacagtggataaacctggcaagttatttcacctctctgtgcctcagtttcttcatctataagatgggtatcctgatgatacctacctgttgggttgttaggaggatgaagtgagttcatatatgcaaagtgcttggaacaaagtaaacactacaccagtgttgctcttattgttttactaaaaccaaggaactgagtgatttatttgttcaccaatacagtgtggaagacaaagcacattttactgtggacaatgcatagtgggtgggtggatattaatgatgaaatggttagggctactgaggcagcctcatctgccacccaccccaccccacctgctcctaggcctccaagcctgtgaaggtggggaataatgatttggattttttttttaatcagcagagcacaagtgtgctatttcacatgccggctgtttaagtgtacacctagttacagctgactgccttggatgattggttgagagggctgagttcccgtttgtccccaatcaatctggaaactgaaaaggagccagaatattcattttccaccatcaagcctgcagcccaggattattgttgataaaggagctgtggaacccaagttccccgggggagatggaagagtaaacatcttactgatatcccagggcagtggatgaacagaggtcgggatttgagcaaatcatgtccctattattaattaaaggggcagggcattggtcagagcaggcagaagggcaaaggggctaaggaatagctgtgggccccatgcagttgatgaaaaggttgtgtcctagaagggtttagcctgaagggctgcgtaggcattcaggctggtattttgtacggacccactgtgagccactacggggcaaagcactcaggagggaaacacagaaggatgtgcaagaactaaaaatatgcattccatctggaagaagacaaaagttgaggaaccgtgtttatgaagatggcctcatgacaagatggcattcattcaaccactccttcatccacttcaaaactgttgattagcacctgtgttgagccaggcagttccgatcccttgcggatgtcaaataggagtaaaacgcaggcactgcttcccaggagacagcagcataagtggccagataaagaaagtacataaataataacagctgtagcaataatagcaaaaatagtaatacctgctgttttttgggcaccaacaataagccaggcttcgcataagttatttcattcaatattctccattgcttaatgagatgataggtcctatttttaccctgagtttgcagatggaaaagctgaggcatggaaatcgttagtcacttgactgaggttcatgcagttaggaaggaaccatgattcaaaccagttccttccaacttaaacccctgctggtcacactaggctgctctgcctctcgaataactagaacaacatgttgtaactgctgggttgaagctgcagaaagtccagtgtgactttagaagtgtaactgggcctctacatagtggctcaaccctgtaatctcaacactttgggaggccaaggtaagaggatcacctgaggccaggagttcaagactagcctaggcaacatagcaagaccccatctctacaaaaaatttaaaaaattagcagggcatgatgtcatgtgcttgtagtcccagctacttgggaggctgaggcgggaggattacatgaatccaggaatctgatgatgcagtgagccatgatcgggccactgctctccagcctgggcggcaatgtgaaaccctgtctcaaaaaaaggagggggagcatctggccagctggggggcagggtggagtggagagggctgtggctttaggtcccctatccccagcacacacctcagcatttgctcatagtagatggtcaagaagcacttgccagttagccagcaagttctttggaagccttctcaagcatcatcagacaggttctgcaccctcttgttcaatgctgttcacaaagcagcattttatccagtgagaccatgaaaagggattgtgggaatcttcattttgtatagaaggaactgcaactagcgagaaggagaatccacacctaaatccaagcctccagtactctgaaaccaaagttctttccctcagccttggagcctctgggaggactgattcaagatgagaccccagacccctgactccaaccccaaatccttctaactccacctgctacctcttcctcagatccaaggggcaacttatcttcccctggtttcttatcagcatggaacagctgtggttttctgactcacagagccgctgaggttgtaaaacattctcttttcactttccatgctggccaaatgcatcctgaacctgctggcgtgaccttctgttgctgcatgcaggcccaagcacaaagccattcattttgtattcattctctcccaaccccaatcccctctgccatccccccacaaccgcacacagccccctccacccgcaccttcacctcacccttggcttaactcagagaattcaacttccctcaacaaggctggggctggggcttcttgagctgcaaatatcaatttgcagctttctgtgtatcccctcaacacacacatacacacatacagacacacacacacacacacacacactcacacacacacacacacacacacacacaccattgcatcttgccttgggctgggcacatagaggatgcacaagaaatacatctggtagacccccacacctttgctcatgctgttccctctgtctcatataccctctctcctcttgtgtttgactttttttcaaaggctcaaaccaaacagcccctcctctttgatggaaggagagtcccattcatcaggtacgtcccacattcaggcacccaagtcctgaaaagaggacttgggactcaggcctaggtgtgatgctgaatcagccccctattccttgtcaactgtgtgaatgtgggcagtcattcctgagcctctgtcaaatgggcacgataatagtacctgccttatacttggttgttgggaggactgagtatgtagttaatggcatctggtcccatccagtcctgacagacagtggacacaaaattgcttgaggcaatttaataataattaaataataatgttatatgctatcattattgagctactactgtgttgtgggaaccagactcagccttccacatgcatcattcattcagcattagtggagcacctactgtgtgccaggtactgttctaggcgtttcagagtcatccatggaagaaaaaggccataaatccttgccctcgtggagcttaccttctaataaggagagacagagggtgagaaacaaacaaacaaaaatatgtgagttaacacagagtgttggagggtgtcaggtgctatgggagaaacgtggagcatgtcaaggagagagcaggcaagagggcattctggaaaggcctaggaagatggtgacatttgaccttcatatccaccaacccccagcacaaagcatttgccagaggcagacagaggagggcaatggacagtaggcgtccatgcacccaagtgagggagagagacatgcagacactctagagaagagtgtccaggcaggggaacggccctgttcgttcatcatttcatcctcatgagatatgttacgtgttatccccattcgaaagatggtgaagctgagactcaagagaggttaaagtcacatgagagggtcacagagctagcaagggacagcacttactggttgcaagtccatgctaaatataagaccttgtcatgacccagggcttggtgccccttatagtgaagatcagaagaggaatggatcgtcatcttcctctgcttgctaccctcgctggtttcaagacctaccctcagctctgcctccaggaatctagcaccgactgtgtctcacgtggccttgcctcatgccctccaagggatgcagcactggacagaggcaaaagaaagggaaatgtcaccttcttcttctgggcttggctcctccgtcttggaaagcgagtctcagaacatctgttaaaccaagccccagcatattaaacagccactgaaaatgtattgttgcttcgttcaatacatagcaattacacggcgagttttgctcattagcgggaaattgacacagaggcaatcctgctttttaaattaccactaatctcactgcacctgtttgggaagaaggcaggaggagaaaggaaaaaagttgataataaccatttcattacattttaaaaacaaacacttctaaaattcccttaaatatagcttttgggctctcagattcccatcttatcttaggaggagcctctttgcctcatgccacaggctggagtaactctccattaatgtcacaggcttaatggcacatgagtctgggcaccaaggacaccgggaggacaagctaggctcccttaaggtttatttaaagtgagattctgtgattaactatggttaagggacttggtgcacattgaggagagccaccatacctcagaggctcatggaaaactgacttattcagtgggtgggcaggtgttaggggaggtggatgcagatgccgctacaggtgtctccagagctcaaagacaaggtgtcacttgaccaaatcaaacagctgtcagtgaagctggcattcagacttgctgcccaggcaggttgctgaaatcatggagccccaattccccatttctgtctcagtgcacggggttgcatgccatgcccagcacagaggctgacttcacacagtaggcactcaataaatgcttcctaacacaacctcggggctgcttcctgagatgctccttcactgatatcctccagtccatggggccaggctcattctgtatgaggcacactgccctgggctcaagcccctccctggctgggtgatcttggacaaacctctctacctctctgagtcttggcttccttatttggaaaatcgggataatgatagtaagtccagctcaagctcgtggcttgctggcttgttggtgagggtcttgtgtgatcatagggctgaaagtgcttgagaaactggaaaagtggtttaagaaccacgactattgatacccgtggaaatggagagagaaaaaagaaaaataaaagcaatgtaaaaaagaacaattattattattctggagttggttgctccttggaagaggagatgctggggcctcggattaacatgaaacttaccagaacttaacatagcactgtacacatagtggttcttgatgaagacttgaaaaatgaattcttttatttacctaaaaaaatgttggtagagtgtcttctcttgccaggcagtggtcaagatggcagggattcagcgggaaacatgctcccagtcctcctggagttggttagtgccctagggccaccatgacaaagtgtcacaaaccaagtggcttaaaacaacagatatgtattttctcactcttctagaggccaagagtctgaaaccaaggtatcagcaaggttgattccttctggaggttctgagggcaaatctgttccgtatctttgtttctggtgtttgccttgcaacccttggtagtctctgctctacctctgtctcatatgaccttttctttgtctctgtggccaaatttccctcctcttataaggacaccagtcattggatcaaggcccactgtaattctgaatgatctcatcttaacttgattatatctgcaatgactcaatttccaaaaagttcacattcacaggtacagggggttaggatttgaacatatgtctttgagggagacaatttgacccaccacaaggatatcaaggataaacaaatatccattgaatttatcagagggtgccatggagaaagtgaagcagggttaaggaggatttcagataatgaataagcaggaaaagcctctgtgagaagacagcattgagcagagagagctgagtgaatgaggacatgagccatgcaaataactggtgcacagcattctgacagagcatgtgcaaaggccctgaggcaggaccacactggggatgtgcaggaaacagcaaaaagtccagggtgctggatcagaataagtgagggaagggtggagatggagcagaacaatcatcttagagactgagggtgtcttaaagagacaggaagccactggagggttttcagccatggagcgaccttattgtggtttacgttttataaggatcactctagctgatgcgttgagaagagattataaaaaggacaaggatgagagtagggcaactaaaagaagaggaggaggacagagctctaagttcatcaaagcacctggtctggtaattttatttaacccattaagcccccagagaagaaaaatgagcagggaggcctggcgtggtggctcacaagagaagaaagatgagcagggagacctggcgtggtggctcacaccggtaatcccagcactttgggaggccgaggtggatagatcacttgagctcaggagttcgagaccagcctgggcaacattgtgaaaccctgtgtctactaaaaatacaaaaattagccagacatggtggcacaaacctatagtcccagctacttagggggctgaagcagcaggatcacttgaacctgagaggttgaggctgcagtgagctgagatcacatcactgcacccaagcctgggtgacaaagtgagaccctatctcaaaagaaagaaagaaagaaagaaaagagtagaaaaatgagcagggtgacccatcacccaagttgcatgtgcattaaagaagctgtgaaccttgcaataaaatgagctcatttgagaagccctgaaatcatggaaaatcaccgtgccctgttatgtgaatgacttaaaaacttacctgcttccatttgtttcctgagcaccctttggtgttaagtcctagccactggggagagggagggcacaggaatgaggaatgcagagtttctacattcaaagggcttcccaaggagagagaaaggtgctctctgcacacacagctcagccacagggaactctagaacagagagatatttgttttaaatagtgtatctaggaagtcttactggaggaagtggcatctgcattgagcgctctaaggataggaagaatttggcaggagttgaggtgtgcacctacctggtcttggaggaggcatcttgaggagggatgtcaaactccaatttgtctcacaggaaactgaagcaaaggctatgttgagggtaggaaaagttggcactttttattcctcccttcttttatatttttcccccttcccaagtgcctactacgcaccaggagctatacgaggcaccagggaagcaacaatgaacaaggctgtagggatccctctgggaaaccacagactgatgggatttcagtgcagctgagttggagaagagagacagagagggagacttaaatagcagaacgaggggtttgtgtttgctccttcagcaatggggagccacggagggttttgagcagggaaatgacatgatctgaactggacaagtaataattatttgggcagcacgcaaggatgggtttgaaggggaccagaggcaaggaagccagctcgcatcaaaagataacccttaagtacatctgcctttgttggggcgctctggtttcccgtgcccctttgtggtggggaggtgagggatggagcatcaggggagggagaacaggctgcaggtctgagaagggatgaagggtttccatggcaaccttttgcttgcctgtagccaaggtagctatgcaaattccccaggcaccattcctgtggaccttgaagccagcatccccggctgctgagagcctgactttagaaaaactgggatgcagtaaaattgaacaagagagacgagagacaaagatgttcggctggaacaggggtgcaggctcccaggcagcccttgaattcccttgaacctgttctgcaggctccttctccctcctctagggagggactctcccaagcccacccttccccatttggcatgcattttacaccatggggacttgggccacctggaaaatgggctgacctgatggtggtgcctcctttaagtttttgtgatgacttgcaatattgtttgccaagcttcgtacacaatgcctgggtcagggtaagcaggtcaaaatgctagcagttattgttatttggcattgtgattaaagaatgctggctcttagaacaccaggtcctcctctgagagtggccgctgattgatgtgtgaccttgagaaagtcacttcccttctctttaatcttcctgttcttatgtgtcagatggggatgctggctctacagtctctttattagcattttattgttgttgttgttgctgctactgctgctattgtcaccattattattagtattgctgttttatcattgctattattataacacctatgttgctgctacctgctacaaagggcaatgatgatgattcctgtaaatactccacgtagttagaacgtgaaactctatgccaaagcagaccatgcaaaaatgagttttcgagaaattgttacatgaagagtttataaaaatgaaatgctgtattctacacatatcaagacaggattgcttgtgggtgttgaaacttattaggcgaggtagtccttagacattcacttgtcttagtcttaataattgaccaaatctcctctccttgagttctcacactgggtctgggttccatgtccgtttccattctaggtgatcctaaattcaattgagaatcctgagttcagacccttgtaagacacagcctctcctgttgtagaaagacaccttcctttacctaacacagatttagtccacatcgtattactaaccctaaccctaacccaacctgagtatttggcatgtaatagacactcacatttgttgaaaggaagaaaagaaagaattagaaggaagaaaatggggcacactgctttctaatcccaagaccctctagttattaatctagagaggaaggtagaagccaactctctcatattcgtctcagtggaaaagccatttttcccctctaactccagactttctgtcttctttttttactcaccaatgcccaaaggaaaaaaaaaaggtatttccaagtacgaaagtacaaagtttcaaacccactcgtgctcctccttacaatgcagtcgattaatcccacaacatttctcctgggtggttgccgttaattgaattaaatgagataatatttgttgagtacgtagcactgcgcctggaaatgtttattgcatagaattgaatctgtaatgggtagagatgattagcattgttgttgctgctcttaattagagctattaataacccccttcattagcacagtactttggaacttccaacccatcttctaatgcatttccttatggcaccgtctgggtctcaatgtttctgtcagataaatgggggtgacaatttgaactatgtgaaattcttgagaggtcattctcacagtgctgagtgcgaacgtgctttgcagactctagaaggctttgcaaatatcaagggtgtgctattttattgttgtctgaattgagaggtagagatagactctgatatatgaataggaaaaccccataccctcatctcatgatgtgaaatgactgcctggctgtgttctttttgcccacaccaggcacacttaagattcaagtaaacaaagggcatttgtagggcaggtaggtcccaatgatgttattaagaaaatcactaaaataggcatggacttgggcttcacggaatctgggttcaacactgagctctgctacttcttcaggcaagtcattcctcctttgtactgtgtcaaatagtgtccccaccctccccaaattcatgtctgccgaaaagctcaggatgtaaccttatttggaaataaggtctttgcagatgtaattcgtcagatggggtcatattggattggggtgggccttaagtccaatgactggtatcttcctaagaaggtcatgtggaagatgcagagagacacactcagagaagaatgccatgtgatgatgggggcaggtaggagagtgatgcaactgcaagccgaggaacaccaaggattgccaggggccaccatactgaaagacacaaggaaggattcttccccggagcctacagaaaagacatggccctcctgacactctgatcttggacttctagcctccaggactgtgagagaatatatttctgttattctaaaccagctagatggtggtaatttgttgtggcagctctcggaaactaatataccctctctaggctttgggattttataaaattgtgatgatatagcggaaatctcacatctcactagacagattctgcaggatgatccatgcaaaggttgtagaacagtgccagcacttaaacggtctccagatgatcacacattgacaccatcaccgttagaacccacaatgacctgggctgtctccttgatgtccctgcctgccctcagcctccagagagtgtccaggcagtcacctgactctaactgagagttctgtctgtgtctccatcacagagagccagactggacaaagagttcagggtgcatttggaggattgcagggcagggacaaggaaaagctgcaatacctggacaagtccctgatgacagctcagcatcaggacctactgtgtgccaggtagttcgtagaagtcacaccaaatattcagaatgcctccagtgtcaacatcattgtactacctccttaagccacaatgtcttcatctgtaaaatgtgaatggtgacattcctacctcatagcattggaatgagattaaggatacataatgacttgtacataagtgtttagtaagagggaactactattggtatcttttttgtttagagagagacagggtctcactcttttgctccagctggagtgcagaggcacaatcatacctcactgtaacctcgaactcctgcgctcaagcaatcctcccacttcagcctcccaagtacctgggaccaccatgcccagctagtttttctattttgattgttgtaatgacctctttttcacggttgagaaaatgaggttcagagaggtaaaataactggcacaaggttgcccagccgtgaatcacgggatccaggatttggacatacaattctgactctgacctcatgcatcgaagatcctctcttgccaacttgccttctgcttccagcaaggagacagaatggttaagttgtgagtggcattttcaactctggaagtttaggttgaccttgcataaaagaccaactccattttccttggaaaggactctggttttaaggaaagaaatttcatggggtggatcctgctgcaaagctggtacaaacaacccagtggctgaagcggctatgcaagactgccttcctaggggaacctgcccatgccccatgcatttcttttcttttttctcctgataagaactgtcttttaatattttggaatggtaaagctaaagtaataagattcaaaaagagccatcttctggttgcactaaaactttctcttttttaagtattttttaattgacatataataatcttatgtatttatgggctacagcgtgatatttcaatacgtgtacacaaatgatcaaatcaggataatcagcatatctatcacctcgaaaatgtattattgctttgtcttgagaacattcaaaattcactcttctagctatttgaatatatacaatcaattgttaattatagtcaccatctagtgctatagaacatgagatcttattcctccgatctagctgtaagtttgtatccactaaccaacctctccttctcctctccccttatccttcccagactctagtaaccactatttcactctctacttctgtaagatcagccttttcagtttcaacagatgagtgagaacgtgtggtatttatctttctgtgcctgacttatttcacttaacacaatggcctccaagcttatccttgttacctccaatgacagatttcttttttaaatggctgaatagtattcgtgtgtgtgtgtgtgtatgtgtgtccatttcttggattttctttatccattcatccattatggacttaggctgatttcttctcttggctattgtgaatagtgctgcaataaacatgggagtgcagatatctcttcaacatactgatgtcctttcctttggatatatacctgagagtgggattgctggatcgtaaggtagttctacttttaattttttgagaaaccttgatactgttttccataatggctatactaatttacattcccaccaactgtgtataagagttctttctatgcatcctcgccagcatgttattttttgtctttttgataataaccatcctgagatgagataatatctcattgtagttttgatttgtattttcctgatgtagtagggatgttgaacattttttcatatacctgttggccatttacatgtcttattttgggagatgtttattcagcacattgtcacatttttaatcagattatttgttttgttgctgttgagttgagttccttgtatattttgcatattaatcccttgttgaatgaatagtttgcaaatattttctcccattctgcaggttgtctcttcactctgttgattgttttctttgctgtgtagaagctttttagtttgatataattccatttgtctatttttgcttttgttgactgtgttttgaggtcttacccaaaaaatctttgcccagaccaatgaaccaagatgtttcccctatgttttcatctagtagattcatagtttcagatattacatttaagtctttatcattttgagttgatttttgtatatgataagagataggggtctactttcattcttctgcatgtggatatccagttttcccagcaccattaataagagaatgtccattcccccagtgaatgttcttggtgcctttatcaaaagtcagttagtgtaaatacatggattcatttctgggtttgcgattctgttccattggtctatgtatctgtttttatgctggcaccatgctgttttaggtactatagctttgcagtatattttgaagtcaggtagtatgatgcctccagctttgttctttttgctcaggattgctttggctattcgggatcttttgtgcttccataggaattttagaactttttctatctctgtgaagaatgtcattggtattttatagggattgcattgtatctgtagatcacttttggtaatatagtcattttcacaatattaattatttcaattcatgaatatgggatgtctttctatttttttgtgtcctcttcaatttcttttatcagtgttcatagctttccttatagaggtctttcacctccttagctaaacttattcctaagcattttatatatttttgaggtagctattgtaaatgggattgtttttcttgatttcttcttttcagctagtttgttgttgatgtatagaagttcctctgatttttgtatgttaatttcatactctgcaactttactgaatttgttgatcagttctaagagttttttggtggagtctttagtttttcctaaatataagatcatgtcatctgcaaacaactttccactttggatgttctttctttctttgcctagttgctctggctagggtctccagcactgtgtttaataggagtggtgagagtaggcagccttgtcttgttctagttcttaaaggaaaagcttttcacttttatccattcattatgatgtaagctgtggattttccatatatggcctttattgtgttgaggtattctccttttattcctaatttgttgaaagttttttttttttttttatcatgaatggatgttgaatttcattaaatgctttttctgcaagtcttgaaataatcatatggtttttgtctttgattcttttggggtagtgtatcacatttattgatttgcacatattaaagcatcagcaagtgctgcatgtcccagaagctacttcagggcctgtaaagactgaaggggagctggagaaagtcaggcatcttgggtttgtgtatttggggtggtgggaggaggcttggagtcagtttttcattctaatcccatcttggttagcttagggctgctagggggatccttgctaaggcagcaaagtgcctgcacagaatcagtgccccctggaaaggggatgtcattatggaaactgctcagtggtatttgtgaaatggaggtgtctcaccccaggccagggagactcacagcccctgagccaggatggacatctatatcccaacacacattcaagtcttgcctgatagagcaaaggagtggtcctgtgtgtggccactcatccccctggaagtaagtgggggtgtcctgcccactccctgctcctccccatgcatctccctggatacctttggaatcctgagatcacccccaccccacccctatttaaactcaatggggcaaaataactccaagtgttgtctgtgaatggcggcagcaggagcagcggcggcagcagcagcatcagcgacagcagcagcacaggcagcagcagcacctgggagctagttagaaatgcagacgcttggatcccatcccaggcctacccagtcagagtctacattttaacaaggtccccaggtgtctcatgtgcacattcaaatttaagaagctggactagagaatgaaaaaaggaaagggttgggctaagaaaagggtaacctaactctagaaaggaagtaatttagtttttcagtgatttatgcacttatttttggttatctatctgaagttcagactctaccaaagatccttgaaaaacccctttgcagaatcattccctacctcagatgaagttctcaaaattgacaaagaaacatgtgtgtatatatatagatatttcaacttttattttagattcatggggtacatgtacaggtttgttacatgggtatggtacatgatgctgaggtttggagtatgattgatctcatcacccaggtactgagcatattacccaatctttagtttttcagtcttgtccccctccctcactcctccctctagtagccccactgtctattgtgaccatctaaatgtacatatgcatccaatgtttagcttccacttataagtgagaacatgcagtatttggctttctgttcctgagttaactcacttaagataatggcacccagttgcatccatgttcctgctagggacgtgattttgttctttgtttatggctgcatagtatttcacagtgtatatgtaccacatttattttatccaatccatcattgatgggcacctaggtggattccatgtctttgctatggtgaatagtgctgtaattaacatgcaagtgcatgtgtcattttagtagaatgacttattttcttttggatatatgcccagtaagaggattgctaggtcgaattgtagttctgctttaagttcaacaaagagtaatattaatagtggtagcagacagtcttcggggcctacctctgggccaggcattgggctaagagtttagagtgaattatttcatttaatcctcacatctccctagaagggtgggtattattattctcctccattttataaatttgaaatccaaaatgatgtggctggcccagaatcacagtgtaagcaaattacacatctggctttgaacgaggtcttcctgctcctaggcctctctttgaccaccaggataccctttcttatgcatcagaagggcatcaccagcatagtcttggcttcagctctccactcctgcataaaatgtgtatgttcccctgcctctggaacctttattgttggtggtactgctgctgctgctgatgatgatgatatttagttggtttttttgactgtccctagacccttatttaggctgttccttttacccccctacttgcaatgtcctttctcaacgttttcacctatttgcattaaaagtcctagaagaaaagatatcagggctcttgacttcattttttaaacccacagtgccgagctcattgcttgtacaaaatagatgcccagaaaatgcttgttgaagttagtttattatttagttcaattattatttggttctttatcattagtgcgttattatttagttgaactatttagttaaatttagtttactgtatacattctcaatgagggcaatgttgcccccaaagggacaaaaattggtgcttaggttcctgtgtatgtataaaaaacagatctcctatggtatataaataagtatacagtatatctgcagtattaaattttcatggaaaaagtcatcttaaaaggctcctgggacaggtgataatgaggaaaaaagattttataaggatgagtttataatataattcattcaaagttttagtcttaaaaatctggacgacaaaacacaaatagacagaatacttaattaaataactcaccaaggatgaaacacaagtggaaaactcatgggaaatgttcatccttcgtagaggtcaagtgaatgcacctgcaactacccttgagggaccacattacaccaactaaattagcttagaatgtttaaaccaataacacttggtgttggcaaggttattagaacattggtaagctcaggggctttgtgatttgaaagaccccttaggaaagcaacacggcaattctgtccagctagagcggtaaaactgttcatgccctttgaccaaaggatttcattccagggaatttctgcttgaagatggattcaactgtagcaaaagttgtatacacaaagatgctcattaactacagctagcactgaaaaagaaaaaggaagaggagaagtgaggaaggaaagggacggaagagggagaaggggaagcagaaacggagagcaggaaggaggaaaggaaggaagatgggagggaaggaaaaatgtcaaacaaaatgaacacatgtaggccagctgcagtggctcatgcctgcaatcccagcactttgggaggccacggcgggaggattgcttgaacccaggaatttgaggctgcagtgagctatgattgtgacactgcactccagcctgggtgatgaaatgagatcctgtctttaaaaataaataaataacacatgtaaaacacccaacagagtgctgagcatttggtgagtgctctacagacagtactatcgccattaattcttcctctctactagcagtaagaccagagcaattgagcatctgtcctactggggggcttcagaaggagggtgagtgtcaggggtcttaatgaggagggtctagaatacagctccagcaagctaagatagtggacagctgccaagatcgtggatagagggatatcctacacagctctatttattaaggagtgggtgtctccaggcatgaatttgagggctgtttcctgtcctcagaattctatcacctggtcctagctcattgttgatgagcaagccactgtttccagtttccttggataaaggagcttccagcagagccaacctgggatacattgtgcagaccagttctaaagaatactttagaattctctctttttaaaaccactttattgaggtgtaacgggcataccaaaatgtgtaggtatttgttacatgcaatttgatggatttggagatgagcacacacccatgaaaacatcagtgcaaacctccagtgcccatttttcctatgacctaaggatgtgaaggcatcttaagacttatccgtctaaggcccaggcatctgcatttacaaacttgccttttgcttccctcgggagcctggttaatgcttgaaggaggcctagaataaatcaccaaagctttcctatctgggtggccttcatagagaagaagaatcccctctgctgtgtaaacattaaacaatttgagatttcaaagtggtgtctccaaacaaagaagatggctaacacaagcctcccttgcccactacatggaagagaaggactttctgtgaggtttgtgagcctgaatcaaaatgccagcacctgaggccaccctgagaaatccttcatgactcctgaggataatttttgccgagacagagggaattaggcctgttcctgtctctgctaggaaatctcagaactcatcccagctcacagttgctggggaaagagtcttggggctgtcacctccatgtctactttctccagcatagcaaaagcatccccagaggcaggagagggtaacgcgcagcagttgtctatctgacctcgcagtgttgagcacctgctcagggaaggcttggtgctagtcactgggaatccaataaaagtgaaataaatagggcctctgccttcgtggagcagacagccatgtagggcagacaagcagccatcatcccatttaaaatcattgtaaacttacagctgtgagatctttagtgttggaagagcacatgagtggggtttaggctggcctgggagatcaagggagtgatggttaagctgaagttcaaaggaagattaggaaggaagggaaggaagaggaagagagttctatgtacaaaaacctgttgccttattcatccttctcctgccctctcttctcacaaaaggagaaataaataagcaaagataaaaatgggaaggagcatgagcaagtagttggagaagtaaggaaatgcgtaagagactaggtaaacaatgaaaggcagataagctagaggggtattcggggatgccagggacgtgtgcatgaaagaataaataacaaaggaatatgggtacaaggagataagctaagaagtgaacaaaggaagtgaataagaggtcacctgagtgaggaggaaaccaacatatgaatgaaaagcaggattcctccattccagtatttccccatagccaaaatggccaaaaggctctttccaaatgcacacagaatgtagaaaacatagaagagacccatggcttgctctgtgccacagtacagaagttctcggccttgtctgaaacattggaatcacctggagagctttaaaagacacagatgcctcagtgccaccccaaagaggctgatgcagtgggctggggtgttgcccaggcataaggattgttgaaagctctctaggtgactctcgtggacttccacggctgggaaccactgccataaggcactggtttcatagcctggtccctggaccagcagcatcagcatcacctgggaccttgttaaaaatacaaaatctcagacccttccgcagacccactgggtcagaaactctgggggtagggcctggcatctgtgctttaagaagccctccctggggttctgatgctcactcaagcctgacatctactgccatggagggagtttgtcatcggctgagattccttcaagaggaaacatgctcctgttgcagcagagaaagttcaggttagattcaaagcaggaccaagtgtagactcctgagcatgatcatcagagccaccatggtctgggccagtggttttcaacaggggtggggagcaattttgctctccaagggacatacggaaatgtctggagatgtttttgatggtcacaacatccccacaacaggtggggtggggttactgctggcatctagagggtagagattagagatgctattaaacatcttaaaatgcacatgacagtctcctatcataaagaattatccagcccaaacttcaattgtattgaggttaaggaaccccaatctaggtaaatgcacctaagcaagctctagtccttgaagagaagcacccaatgcaaaatacttttatcttgatctcattcctataagcttatagatgatggatctggggaaaaaatcccctacaaaatcccatttaacttctcattttacaggagagaaaacaagccgcaaaaatgaaattattttctagcatctcacaacactcctaattcctgtctattaatttcctccataaatatttattgaaaacttgctaagtgcaaggtactgtgctgataagaagaatgtaatggcagaccagatggacaattcctgccctcagggagctcccaataatcaaaggcatcagtaaaattataaggacttcttaatttaaggtggcaggagaaggctcttctgaggaggtgacatttatgctgaggtctgaggactaaagagggaaaaccatgaagagagggaacaggtagtacagaggctgtcctatctccattactccagcctgcaaggagaacctagcttctccctgcagccaggtgtctgccgctcaccgatctggagggagttgctggagcttggagaagaacaggcatttaactccagacagcattcagagtcttatagaaaccccagggagtttatcacatctaagaccctgatagcatctgtattagaaatgagaatccgaacagactgctcatgaaagattagctttaattctttcagaagaataaatgcttataccaactctggcccgctttatctgcttgctcctgccagccagctgccctttccctctatcaagatggccacgagaggacttccggaatgagtctgtcatctccaattcattctaactaaacagtcttttgtgagcatccgctctgcccagatctgggtggagagctatggaggagagaccagaggagaaggtacagcctctacctttgaaatacacaaagacgcatagggagagtaagtttcttacatatccattcattcaacaggtgctccccgagtttaaaccccacatcaggcaccgcaccaggcactgaggatgaagaaaggaagctcatactcacatagcatgtgtcagacatgtgaatggttacaggacagtgtaagaagtgggcagggagtcatcaccccagctgcagaatccaaaagggcttcctggaggaggcaatgcctgaattgagagttgaagacaagctagcaattaaccagatgcaaaagagagggcaaaagcaccagcatgaaccaaggacagagaacacagcacatttgatgataattaaaatggcaccatgttgagacctcttgtgtgaattatctcattcacctactacatttttttctgtgtttaaatgaggaagttggggtacaatgatattacatacagctagcaaattgcagtatttattgcagtctgactgttgggcctgtatttctaatcactatgttgtatatcatatctatctagaaaatgatgcataattctctataactgaattataaaggatctgtggtaagaaggggagtgaaggagttgaggctgcaagtgcagacctgggtagacttgaagggccttatacacaatgtttgaaaaagtcagaccttgttctgagggaggaaatatgaaggattttaagctggggaacaatatggtcctattagaattttagaaaaatcatcatggaaggaggatcttttggagggagagattggagtcagggcaactagtgaagagacagctgtaatcatctaaggaagagaagatattagtttgggccagtgggcatggcccaatggaggtaaaggaaatgataaagtttaaaaacaaacaaaattttgtgattgactggatacagagggaacagaaatgggagattttcagatttctggcttgagctaggactaccacaatagctgaaaagagaagaaaaatatttttcatcccaaatgagagaaagaaaagagctttggggtaaggttggggtgagaaggtgaggatgaaatggtcagcaccaagagaggtaggataataattgttgatatctctctctatccttgacaatttttgaaagaattgaggcaaaaatagcccatatacctatagtaatgatttcaaaatagagtttagccttcaagggcaatctgaggaggagagaaaggtgaggaacccatgtaattgcagctggaaggctactctgctccaactagctttccttttcaactcagcctaccaagaaaaagcaaaagcacaaattcaacatgatcggtaagaggcaaaaactgagtacaaatattgaaacaacaggaaagatcatggtagaataaaggggtcaggagggcagagaggagactcaacttagagagataccctgaggcttcttaacacaggtgtcggagctcttaagggcatgatctgctgaggtcgccatccaccacgtgaatagctcaagtatttaaaggaggcacccatgcggggtgctgtccgctgtgctgaaatgccattgtgttctgggctgcttgcagggccaccttctaatcctggaatgccaatcatatctatcacatctcccacagctcataatttctcctaatttattgatgaaaagcttgtgatttatgtgctattaaagaaaaaaattgagccacgatttaggtgtgactatatagggatctaattttatgaacatttgattatgtttccaacaattacaaattgattttccctctgggaacttgagtggggaaatcattacaactacccacctcccatatcctgatttggcatgcttagggttattattaatctaatagaggaataaattatacacaatgcaaaggtaaacatcagtttgaggtatgcatttgatgaatatatccaacaaacatttactttttaaaattttttttttatttccataggttttgggagaacaggtggtatttggttacattagtaagttcttcagtggcgatttgtgagattttggtgcacccatcacctgagcagtattcactgaacacaatttgtactcttttatccctcaccccctcccactatttcccctgagtccctgaagtctatggtatcattcttatgccttttcatcctcatagcttagctcccacttatgagtaagaacataggatgttttgttttccattcttgagttactatgcttagaataatagtcttcagttccatccacgttgcttcaaatgccattaatttgttcctttttatgactgagtaatattccatcatatatacatatgacaattttggagagaattgaggcaattcttttggaaagaattgatatattacatataggcatagatatagacattatatatatatatacatatcacaatttctttatctgctcattgattgatgggcatttgaggtggttccatatttttgcaacagcgaattgtgctgctataatcatgtgtgtgcaagtatctttttcatataatgacctcttttcttctgggtagatacctagtagtgggattgctggatcaaatggtagttctagttttagttctttaaggaatctctacactgtcatccatagtggttgtactagtttacattcccaccagcagtgtagaagtgtccccttttcactgcatccgtgccaacgtctattgtattttgattttttttgttatggccattcttgcaggagtaagatggtattgcattgtggatttgattttcatttccctgatcattagtgatgttgagcattttttcatatgtttgttggccatttgtatatcttcttttgagaattatctattcatgtccttagcccactttttgatgggattatttgtttttttcttgctaatttatttaagttcattgtagattatggatattagtcctttgttggacgtatagagtgtgaagattttctctcactctgtgggttgtctgtttactctgctgactgttacttttactgagcagaagctctttagtttaattaagtctcacctatttatctttgtttttgttgcatttgcttttgggttcttggtcatgaagtctttgcctaagccaatgtctagaagggttattcgatgtatcttctagaagttttatagtttcaggtcttagatttaagtccttgatcaatgttgagttgatttttgtataaggtgactgatgaggatccagtttcattctcctacatgtgacttgccaatcatcccagcgccatttgttgtgtagggtgtcctttccccactttatgtctttgtttgcttcaacaaaccatttattgaccacttactgtactgcatggattcaggaaacagagggtatagagatgaatcatagtccctaaccttgtgaaatttacaatctaatgaggaagacagactctgaacaaggagttacaagagaaatacacagaggagacaagtagtgtgtgcctactaagcataaagtacagatgctgtaaaaagacaaaattggccaaggtgaggtctctcctttgaaagaatagagttgggagggtagataagcgtgaataaaatggggatgaaataataaaaagtgtggttcaggcaaaattgatacgagtattttggagaagtcagattggactgagattattggaggtagctttaaggaggaggtgggattggtcaaggaggagcaacagaggagaccagtggatttcagctgagtgatcatccagaagtgaggaagagttagcctccacgattgggaaacagagggaaataaggagtttgtttgacccagccctagtgggtcttgaaagcttagtcaaaccatttgggttttctcttgtttccagggtagcaagtgagttctatgagacaaaagaattctggaaataatctgttggccagaggtataatgggaatatatatatatatttaatatattgatatacaaacaaatatatatttatattgatatataaaagatatatatatgcaccttttatatattgatatattttatctatctatctatctatctatctatctatctatctatctcttttaaaaagaaatacatggcccttcttgtgagaagaagaacatatatggcaggtgtgagactcaactgcagcacatctcctcatgtaaatctgcagaaatctttgagggaaaaagggaaagatattaatccagatgtgattaggaaccaggatgtaacatacaaactcattcatttattcttgtattcaagtatttagtacatagccttttctatgtgcccatattgcagctgctggtgctagttttataaacgcaaataccattcccattctcaggcttctttcctagtgtgaaggacagacgtaagtgttaccagcacagggagctcagggagcttgtaatgggtgacaaaactagtctagaaagccagagaggtgatatttaagcagagaacctgaaatccaggtaagaaagactagccagacgggagaaggaggaccagcatgtgcatgggtcgatgggggagcttctgaaagcccaggacatgaagctcaaattctttatcaagagaaaccttggtccctaaagggagaccaccatgagttcactagactttcaaagcaaatcacaagggtgacgaaatggtttgagcacagggctgagaactttgatttcttttcaattcacaaaattactaagctcatattttgagcagctacatccattttcccttcttcccatagtcttgccctgctatattgactaccattcagtctcagaattaatgtcatttccacaaagaagcccccaggagcacctagccctggttcccctaaattcctatggaaaggactcttggtatcactcagcactttcatgcttcccatggtctaccgggtgccacatgccacattaactcctcccctggactcatttccacaaccacccaagagggggaagttattacctgcagagtttacagtcctgcatttcaaatccaacaccactgcctactgtgtaacctggaggcaagtatgtttacttctctgagccttcttgtcgtcatttgtaaaacaagccttgcagaagtagcccccacccgtcagggtgcatgtgacggctaatggagatatgcaagtgcgcttagcactgtgtctgctcatccatgtctcaatatctctggatgagacatcaagactcagataagtaaaataaagcatccaaggtcacctcatgtgtaagtggaagatgctggatttgaatgaaaagttctgtgactccaaaatccacattctttccatcctgccataatgcctttattgacatccttttatcttctcaaatcacacatttaaggaatacagaccctacgtccagctctgcacaaatgttgtcccaattcccaacgatcatctgagatagacagtttcccttttatgcagtggcctgtagggcaaatctgatcttcccaaagctggtccttactcagcatttacagtgcaggaaaatctccactccacctggttgctcaggcagaagcctgggcatcctccttgatctcttccttctctcagccttctcccgtctctatccaactcaatcccaagacttcttgactctaaacagatctgttttaaatcttgttcaccttttagtccccacagctagccatgcctcatcatctctcacctggactgatctttttgcttccacccttaatccctctcaaagctccagccagaaagtagagtgatctttgcaattctagtgatgtcccctctacctcacgtgtgaaaccccccattgcttttgacagagcatctaaatcctgcaacatggacagctaagattatcgttggccatctctcagatcaaggattccagtcacaaaacttggtgttagcaacacaaagagtaaactcagggtcattccaattctggaatcttggcagattctgaggctgcatttgctagggcaagcactgcctgggaggatgtgaatatttggtaactgtgagagttctgaggttgacaacagagcacaggctttgtcagggccctctctggtcagaggcacatggatcaggaaaagcttctgccccgatcttgtcactttgtagctgtgtgacctttggcaaatcacttaacctctctgagcttcagttctgtttattatgcaaatacaaatgaggaagatggatgaaacaagctgtatgacttccagaatttaatgccaaaatgggtcattagatagaacccatgaaattatcaaaatttgacctttttaaagtttacctattaaaatacatggtaatatcatatgtttatacttctctaaaggaacagacatttgccagggctggcaaactttttctctaaagggccaaatagtaaatattttatgctttgatggttatttagtctctggggcatctattcaactctgcatgaaagcatccttagacaatacataaaaagaaaaagcaggaccatgttccagtgaaacttaatttacaaaaacaggaggaaagccaaatttggccagtgggctgtagtttgccaatgcctgctttaaacccatggattttctgttatcacaggaaggggaaatgattgggatgtgaagtttggagttttaatggagcttctgcaagtgcttagcaagcagcaaatatgagtttatttcctcccttccttgtatcttcttccaagaaaagcaacttagagacaataatatggggatattctgcaggctacggtgcattcatattgcactagatgtgttttaggggtggaggaagtttacagacaggaccacctatcattgatctctccccctcttagcccccactcttaatgacattttgaacagtgtagcaggatcctatatgccccactctctggaagctcctccctgtggctgggcatcatgaaaacttatcctgggaggaggtagggatggcatagctggggcaagtttccttacaccaccctgtgcacctcccttgtcaacctgaattgccttagcttatgctctgtcctcttctggtaacccggaaaagtcctctgagcctgataggaattcagatctgccttgtgtgaacagaacctcccgcacgcaagttctgagctgagaaaaaaaatgaatgcttccatcaaattaggccaagtaatatccatctactctagggggaaattatttaaatagcatcaaaatcaatttccatgccattaaatattctggtctgtgttttaattgagacgattacatattccccaaaaagagaagagctatttgaagaatcgtgtcttttctctcttcctctcactggaactgacaaggaaagcacctcagagagctgcaaaccgcctgttagcctgccttcgttcctatccatcttctttagagctaacctggtttattatttttctttaagaaataaaaatggagctctaagaggcacccagggcactgggaactctgagttcttcaaatagaataaaccaggtcattctctcttcttcttcttaagggcttgggtttgtggtcggtggcaagaggcagacatgcctttgatgtcctaggagcagatagggaggtgaggatcattcccaacctctgctgctcccaggccttcttcctattcagtaaatattttgggtgcatcttccatggtccaagaactcactgtggctccctggaggagctcccagtctgatggggggatgttcctgaaaacaagtcattataatgcaacatacaaggctctccacctgatcactgcctcgctgccatcatggacatgagctgtgtgcatcctgtcaagctagtcaaggccaccaaggttctgggtaggaccagctcacaaggacagtgcacacgggtgtgtgtggaatttatggtgagtcagagcaagaggctgcggaggctgtgctgcactcgattgctgagtcctcaatggcagagttgactgcttggcccacagagatgatctgtgactattaaatgaagcatttatgttgtgtgttaaaaaaatcaaaataaaaagcagctgggcacggtggcttacgcctgtaatcccagcactttgggaggccaaggcgggtggatcacgaggtcaggagatcgagaccatcctggctaacacagtgaaaccccgtctctactaaaaaaaaaaaaaaaaaatacaaaaatttagccgggcgtggtggtgggcgcctgtagtcccagctactcgggaggctgaggcaggagaatggcgtgaacccgggagacggagcttgcaatgagccgagatcgcaccactgcactcccgcctgggcaaaagagcgagactccgtctcaaaaataaataaataaataaataaataaataaataaataaataaatagcaacatattaggagcaagaataaaaaccaaggccccagtaagtgtccccatagctctcatcctggttgcaggtcattatctttgccatgctttattcaagtctgactttctttctagacttagggcagagaccaggtcagttctgtttctattgtgttcccaatacctataaagtggcaagcagagtagaggctcaatcagaattaaatgcataaagcaacaaatgaatgaatgaatgcaaggtgaaagcaatgaatgaatgaatgcaaagtgctgctggaatatgggggaagaagcacctatttctatcaaagggatgtaaagaaggctttgcaaagaaatgatgttagagctgagatgaataaaggctcatcttcaccagatggccaattagagggaaggtattttgagcagaggaaatcgtgtgtacagagtcaaaataatataattaaaccaagagctaacatttattatttactatgttctaggctctttacttgcatctgctcatttaattctcacaactaccatatgaggtggtgctctcatacccatttcacagatgaggagattgaggtcacgatggctaactctctaagctcacacttctaggaaatgacaaaaatgtgcctcagtggctttactaatcctgtgataccaagcttggctgtcactgccaggttttcctgcctgcccttccaaaacgtgggttttcaaaacacaggaaagtatccaggggtttgatatggctgtaaaatgagtgctggaaagtaggacatgaggctggtaatataaccaaggacctttttgtagagagctttgaatgctaggctaaagatcttgtggtcaatatttcccaaactggaattctgcaaaacactattttacaagatgtaaataagtgagctctgggtaaagagggagtaggggggaaattcattaagcaaattatttgggaaacatagcttcaaccaagctaaacacattttctgtttgctgcaggatttgtcagagcctctaccatgaaagtaggcattttaattgtgcaagagacagaaaaggcacttcgaacttaatttttgaggcgtatttctcaataacccacagaatagtgaatttgggcattgctagcatagatgatggagatccatggagggaatttaaggatttaaggtcagatgagaggggtcaccaggactgcagggaaggtgactgaaattaagaggcaggagttagagggtttgctgaattcaagaccctcccagtcaggatgtgctgaagaccaacaggaagaggaagtctggctgcatctggaccattggcatcaaagacaggtttctactcacagtgggtccagtggggaagaaactgaattcatacacatggcactattcaaacaaagccatgctgcctctctatagaacaatgggctggcttttcagggcaatttaatgactgtggcaaatagcccaggccatcaattaaataccaatccaatttccttccaatgcattctctgcctcaggagtttcctttgtaacgtggaacaaatctggctgatgaggtgggaagatggattggccaacatgcacaatgactttgtcctctgcctgggccagcttctcagatcttgtctctctttctgaaggagatcacccggtatgaacagaaaagtagatagaattagatcacaggacatttttaaagtgataagaggcatcttgtttagcctagcccctccacccctgctttacctaaggggaaactgaggctcagcaaggaggggcaacatgaccaaggtcacacaactgttaaattagcttcctaaactggtctcccagtttgagtctttctccagtccagcacactccctcttcagtagccagggggatctagcaccttaatctgatcatatgaccccttaagccaagaattccccggaggcatcccaatgaattcagaataaaatctgataagatggagcagagggcacataggccagggtctctccatctccgcacaactgacattcgggatgtttaattatttgttatgggaaaggtgcctgtcccgtgcattgtaggatgtttagcaataccctcggcttccatccactatataccagtagtaccactgccctagctgtgacaactaaaatttctcccgacattgccaaatgtcctctggaggaccaaattaccgtcagttgagaaccagtggcctatggaaaatttcagaaagcaagatgtgtctgaagaagggttagggaataaatactgcctggtttatttacccaacgtgagggcttttgcccagccctttagtctctctgagcctcaattcttttatctataaggtgagaaggataatttctcccctgcaaggtttttgctctaggatcaaacaggacaatggatgtgactgtgcacttgacatgaaaaggtgcttaaaagtcacatgattaactgtgatgctgttcaatgctgtgctggtataatggcatggttgggggatattatgggatgtaattgtctccatgtccagaactcctgaaggcagtggttcttaaatgttaataggcttgtgactcacctggagtccttggtaagtgtgcgaacaccttgctcccacctacatcagtgggtcagaatgaggcctagaaatctgccttttaaaaatcatccctggagattctgctgcaagtggtcttttacgcgtgtaggagaaggcttcctcagagcttgaactagcagtacccactgctctctggcagggggtcaggaacttaaatggatgcataaacctagagcaggagtgggagaaggtattgctaacaccaccccaggtcaagattggaaccctaacctcgttgtttgctgatctgagcatttattgcattttctgtgtccctctggaaatttgaggttaatcccaatcttcgacgcaccagctcccgtccttgcctttatttttcatttgctaattatgcagcgtgactgcctcccaaacatattttgctgctaacgtctcccagtctctgatcaaaaattgtggtaaaacattgtcttgtcatgaggctaataaagcgtgttatcctgcctgtcacagaagctgccttacagatgctgtttgctatctgccagggcctggcattaatctcccttccactcggctacaaggaatagagtctactgtgggaagatcaatattgtattatctcggccaccagtgttgttccagctatggccaatgagttgtcattctcgtgttacaagtcaagtgcacaaaggaaaaggaccagaaaaaagagggaagagaagccagcccagaaggggacaagaaagacagtatcagggaaaagaccccggagaaagactcagagaagcaaggacatgaaaagtggttaaggacacttgccccagccttggacagacccagggacactgctaagcctgccttcagaagcttcatgttgacaatttcattcttctgaacctcagttttcatatctataaaatggaccccccaaaaatagaacctggcacagaaggattgaataagatgatgcgtggtagaatgtttagcccagttaacgcacacagggagggctcagtgattattatggagatattattgctgttgttcttgttgtcatctttgtttcttcctgggtaacactagacaagtcacctttcctccctgggcctcaatttccccaactctaaaataagaattcctttgcatctatgaaacaaaaacaaaacaccaaacaggaggcttaacttgaaatagaattatcagagatttggggaacagagatgttggtgctgacaattgtgaggggtgtgtgtgtgtgtgtgtgtgtgtgtgtgtgtgtttcagagagtgaagcactcctggaggaagaaacagcatagatatgatggacaaaaattaagaggcaaatgtatggaataggagctatagacaccttcagtgctctgcagggagaggacccttagagatttacattttggattattgaagatttgagcaattttatctttataccccttctttatctcttcctcatcaagaggggatcaggtggaacagtggaggaggcattgcctcaagcttaaagcctgattgcctaaggctggctgtcaaggaaaacccctcgctggtgtctgctaggacactcatctttcctcctcctgcctggacaacctgctccccagcctcgagcttccaaccctcataagtgggcagccaccttgaaacttcattaaaggcaagcccagcccctgcattcatttcatgcttagttaaagaggaagctgtgagaagcaatccccattcaagggcgtaatgagatgtccactaatgatccagatacaaaaataaggatgaagcgtggccagtcgaccctcagaagatgacaatttgtcttagaataataatgtctgattgtcctctttgggtgcacatgtgtctgggtttttattcaaaccattcattcggtgcttagcatatcccttcattcccaagtccttgaaggataggaactatagaacagcaataaaatcgtaattattcgtagtatgtatataaacaacattaggtttctgttgctctgctggttacagcatcataggaaagcagctgtctagattcttcatcaaaatcagaacatttgcactaagtctttgttagtatctattaaatacaaaagtaccatatcctgcaaccagcattctgttgggaatattcctaacagaaatgaatatacacatacaccaaaaacatggaatggagttgatattgtttggatatgtgtcccctccaaatctcatgttgaaatgtgatccccagtgttggaggtggagcctggtggcaggtgttggatcatgggagcggatcccccctcatgatcataaatggcttggcgtctttcccttggtgatgaatgagttctcactcagtcagttcctgtgagatctggttgtttacaagtatctgggacctcccccttctctctcttgtttctgttcttgccgtgtgatgtgattgctcccgcttcatcttctgccgtgattaaaagctccctgatgcctccccagaagcccagcagatgctggcaccatgctttctgtacagcctgtggaaccgtgagccaattaaacctctttttttctaaactacccagccttgggcatttcttcatggcagtgcaagagcagactaacagagaaatgtctacagttgtactattcgtaataataactgtgaagcaactcatattgcccatcagcactaaaatggataaactgtgatgtagacagaagatgaataaattgtggtgttgtcctaaaatgaaatactacatagtgagaaacaaggaatgaactaccactgcatgcagcaacatagataaatcttgcaaatataatgttgactgaaagaagccggatacaaaagagaacacgttgcataattagccaatgaattctcagtagtcagaattggtccttggccatagaaggcaaaatacaggttacccttgaagagagcaaacctaaaaattcagaatgtgatggaaatgttttgcatatttatctggtagctatttatctaggtcctatttgaggaatttcatcaagctgtgttcttacaattggggggagttttctatgtccgagttacattcaataaaagtttatgaaaaacatgaaaagatatgcttaggaccatgtgactctaaataggttctgcatgacatccctcactttggatgttggaccccaaacacttggtttgtgtttgggccacaaaaaaaccgaatttttacccacggttatcaccactgggccaggctgcagctggtcatcttatgcccaggggaaaactcagactgcataggcaggggtgaaggataaactttgggatgtcccttgctcctggttccacagcctcagaaaggtgggggtgccttagagaggaaaaagcagggactctggagtattttatattcccttccatgttccttagcaaagcacctggcagccactgggtttgtagtgagtgtttgttgaatgactatatgagggtatggatgaatgaatgaattcatgagtgaattcattttattttgtgaaagttaaataatgtatttagaatgctcttaacatcacctaaaataaaatagagctagtagttaatggggctcatatcagacagacctgggtttgaatcccagacccatcaacctctctcagtgtgtttgtgggtatgtgtacttccatctctgagcctcattttccccatctgcaaaatgtagaaagcaacagtccccacatgacagagtagttctgaggattaaatgagacaatgcatgtaaaacacttagcacattgtaaggctgaaaaagtggtagccatggttgtcattatgaaagagttgctatcatcatgtgaatgaagttgtagctattgttcatgggtggggggaattggcatctttccttctccatctctctgcctctctcttcctccctttctctgtgtcacaagccccacgtgtgcttagccaaccttggcagagttgctgctgagtgaataaaagggcatctttcccccaccccaggacaatggcctagtgccaccgcatgcaggcatcatgcctgtgaagggggccaggtgggtgccagggcactgaggcgctctgtgtagcccctgccgggtggggagctgacaatggccactctgaggaccattaaatttgcctcctcctatgcttccccaagccccaaacccagcacctgcccactgggcaagcctgcaagtgaagggaggctctgtgcgccgcctcggcctcaggcccacacacatccgaggcattgttcttgttggctgcgagagctcgttaggctctgggcagaggctggctggactccaggaggcagacatcaagccccacaactcaaagaatggaggagcctggggcttggcattagatgatgccagtccactcctccgcatgcactggggctctgatgcccagtgagaacgttgactctggaggaagagggtagagatgatgtgttatgcatccctgtgtccccctagctcaaagtggtgctccatacaggattacaggatgactgggagctgggctgccgtggggtgagatggtgcaggatgggatagattggggtggggtaggatgggatagaatagaatagaatagactctggacattttcttcttttgttggagatccaaattcttcctcaagtggactgagaagtcagcaggtgtagacctggcgtggacagagtcacctgagagagcaggggcgataagcagacactatttctccctccaagtcctgcaattctcagccatggccccaaaagagaaattgtaccttaggatcacccatccatagaacacgagatctggaagggttattagagaactttctgtccagtgcttttcagattatgttcaagtcccagaactgccatctataatctatattgctttgagcaagtgactaaagtgatctaagcttcagtttcctcttttgtaaaatgtgggtaataacattatctacctcccagagatgttgagaggagcaaatgaaatgatccataagtttaagaccatggatataggaccttgaatataggaccatggatataggaccttggatataggaccttgcatatagaaccttggatataggaccttgaatgtaggaccttggatataggaccatgaatataggacctgacatgtaacaagcacttatcaccattggccttcatcatcaccaccatcatcatcaaagatgattcgagtaagggaaaaacttagggagctgctctcagactcctgcccccacttctgattaaatccatgtgctcctattttttacttattattagggttcagtggtcccctggactacttcagcttcaataattcactagaaggactcagaacttagaaaagccatcatacccagccataaccataaggtttattacagggagaggacacagactgaaatcagcaaagggaagaggtacatgaggcagagtcctagaaaccaggcacagcttccagctttcctctccgtgtggggccccatggacagcacttctgccagcaatggtgttgtggcgacacccacagagtattgcaaactagggaaactcacccgaccttcagtgcccagggttttatctggggttggtcacacaggcatgattgaccactcatgtggctaccgttagtctccagcctctccagaggtcaagctaataccaaggccaaggcccccaccatcaatcacaatgttagcatggagtatcttgctaacactggcattgcccaaggaccccaggtacacgaagactctaatcaagcaggatattccaaggacttagcggttacctctctggagccaagctcaagggccaaaccttttttcagactgtgcagggtgtggacaacccagacctgctgagttaatcctttactgcacagcagtatacagatggtccccaacttacgatggtttgacttttttttattttgaatttacaacgttgcaaaagagatacgtattcagtacttctaactttgaattttgattcaaaattctttatagcaatttcattataaaataggatttgtgttagatgattttgcctaactgtaggcctatgtaagtgttctgagtatgtttaaggtaggctaggctaagctaggatgttcagtaggttaggtgtattaaatgcattttcaacttaagatgttttcaatttacagtgggttagtcaggatgtaaccccatcataagtcaaagagcacctatattgtcattcctcttaaggttttatttgaaggaatgattccattatacagagggtaagttgaggcccagaaatgacaagggacttcccaaaggctgcagagtgagttaataaggctttctgactgtcctagcccagagctttctctgtcataccacaggcctcagtttgcccatctgtaaaatgacggtgctaggccagcacccccacctcctaggtgccttttggttctgcctttacagaagttattctcccacctttttctgcagtctagtcctcagttggagcatctggctgtcagctacctttggggccacgaagtgtcctccttcatccccaggactcctaccctgaggagtcactggggaccttttagctggagcagatcccctgctgatttgtttgtaataggtggtgctcactctggacacagccaggccaggattcagaggctggctggaggagagacatggagcaaatacagccccttccctcacctcactggggcataagtgtgtggtcaaccagcccggcttcaaatcctggccttgccacttaccagctgtgacacctctctctcagagccccagtttgctcaccattaaaacgaagttaacaatcacaaagtcactgctgtccctgttgtgtctaaagagagtacagttcccgcctcttaaatgagaccaattaagccttgcatttgtaaaactgctttcaacatctaaaacccaacccttgctttaccccagtgtttctttaaggttaaccagtcaaagatcactgtccaaactttacaaagcaggaaacttgaggttttgagagatggaatttgctcaaggtcacatggcaacttgggggcaaagccagtgctagaacccaggtctcctgatttcctggatcttttctacctccaagcacatccttgtaagtacctgggaaggtcaagctactctttattcttgtctgggaatctgagcaaacaggtggagagaaattgttaacttactcatgatggcttttaaactcacttggcaaactggattcatttccaagtattataattctctacataggtaattgaagtatagcatataggtaattgaatgcagatcgatttcccaccctgagcttcctctctgtgctgactggtgtgtctgtctccctccctcaatgactcactgattttttgtgtgtgtacacacataaatcacactgcattcctctcccccttgctggctacctgcaagaattcacaaagccgtaccatgagatgcgaaagcagtgggggttcatggggtgtgaggggaggtggttatgaaggagggaaggaagaggagtgtttaaatgctaatcagttggcattgatgtcagccacagttaatcagattgctaaagatacaagggtaagatcgtgcgcctgtgccagactctctgggctcattcacgaggaagatggatgcagggcccagccaacgctctaatgagatgtaactggacataaaagaatgttcaaggctttctgaacccaacatgaattacaaaggaggcccattcgtgggggagaagccagctcacagaagacgattatccgataattactcttgtagccgaaacactgagtctttttttttttttttaatatagcctctctctcagccaggctggagtacagtggtgggatcatgtctcactgcagcctctatctcctgggctcaagcaatcctcccaccttggtctcccaaagcactaggattacaggtgtgagccactgcacccagactgaaagaatcttttcttgcctgcacaagctttcccacttaacacctgctacaagtcccccaaaggcccctaggtttctgcagcagactcaggaggtatccagggtgtgagttcacgtgtgcagtttggtgtgttgtttagggtggcaaaaatccctgctccatctgtacgaccgtggcatatgccagaaaatgaagagaacagcaagaaattaatcagttgggcttctgtttgacctcctaatgctaaagcaaaccatgcgagttatgtggatgagttgccttcatgttctttgcttgtaagtcaaagcacgtttatctaggattaattttaccaaggattaacctttgtgataaccagtagcatacaccatctacaaatctacaatccgtcacttaaagagattgactttgtcatacacaccaagtcttgttctcagcactgcaggcacacttgtgattcattaaatagatgctgactgggggcctactatgtgtcagaaccatggccacagaatgggctctggggagacagtgatgaatagggtacacatgatctctgtcctcgagaaacttcctcctagtagggaagacaggaaagaagccaggtaattatgagtgtgtgattaatgctttggcttatttctttggtggagttaagaattaaggaaaggagagtaaatccaagtaacgataatagcctatgaaaatgctgggtatcttagaagagagggaaagagagaggcattgattgattgaactcaggagaactgaaataatttagttgccatgaggcaggcagtgagaaatgaggatggggaaatttgctgggacagatcaccaggaaccttccagggaaaggtaaggagtttgaagtttaccaggcagggaaggggcggtttagaacgatctctctggctgctgcggaggccagcaaggaggttgtggagtgagggccacgcaagaagcagggctttcctaacagttgctctgggaataataggatatctaaaaagaaatatctttctttaaaaatttaattttagattcagggggtccaggtgcaatgtgttacatgaatatattgcataacgatgaagtttgggcttctagtgtacccattaccaaaatagtaaacatggtgcctgataggtaagttttcaaccctcacccgtcttccaccctccccacctttggagtctccagtgtctactatttccatctttatgtccatgtgtgcccattgtttagcttccacttctaagtgagaacatgcagtatttggttttgtgtttctgagttagttcacttaggatatgcctccagctccattcatgttgctgcaaaggacatgatttcattcctaaaaatgtctttttaagagacagtttgctctcctggcttctcttgtggtgggacccaggttctttggtgtattgtaacaatgaaatgtgttccatcattaaaaggaatgaattttttaaaaaagaaaagaaggggaaagaaagaaggaaagaaggaaggaaggaagggagggaggaaggaaggaatgaaggagagaaagaaacagaaaaagaaaaggaaagaaagaagaaaagaaaagaaagagaaagaaagaaaaggaagaaagaaagaaggagaggaaggaaggagagaggaagggaagaagaagaaagaaagaaagaaaaagaaagaaagaggagagaggaagggagggagggagggaggaaggaaggaaggaaggaagggaaggaaggaaagaaggaaaaaatgaaaagtggagctcatccaacttcccccccaaccacgttgaatgactccccagtgcctcgacttcccatggaaagttaggcattccccttgggcatttcccatgctctgtctgtgactgcacaacaccactgcaagtaatcaccttaggcaagttttttgagtgttgagcagaacctaagggatgaccattggatggcttcctggtttaggcagacccagtattgagattttctttgtctctcctcccacggagggtgaactgcctgtgggagaatgtgatgggtttgcttccagcctcgttttcccacccagccaccgactctgagaggaagaggagggctggggatcttgggattttcctgtgccgtgacattggaggtgttgaatcacagagagtcaatctgtgaccccatcctccttctcttctttcctgcctttcctgtctcactgccaataaattcatctccagttagaggaagaacatggaatagagatctgtccatgttcatcctgaggaaaaaattgggcgaaaagaaaggaagttagaacaactgatctttgagaaggccaaggaccaggccgtagcagtttccatcaggatggggccagggcacttggtcttgtgtgagtaatgtctacaccccgcttcctgtcacccttgcacagctacgttcagaattatagaacttctggaaacgtcatcagctcctcagcatttgctaaacgcccccaaacatccctcctccccctggagaggtagaatacaagtgtcttttcttggggactccctgcaggagagaagctgatttccctgctccccacggaaatgtgagagcagttagaaaacctgagaaggctggggtttgttctctgccctcctctgaaattgaggtgacaaagggagttaattatttcgtttttaattattgctataaaaatagcatgcatgtggcaaaacaacccaactgtatacaatgatatacaataaaaaaaataaaaagtgattctctctttgagcccaaacctcatttctactctgctgaggtaaagcccattacctggttcaaatgttacacatgtgagggctgggatgcacacccgcctaccttgattgttcttgcttcacactgagttgtgttgacatacagctgtgccattctttttattatttttcaatttgttacatagtttttgaataagtaagtctccctataaatacatacgtacatttatacacatatatatatacatatatatgcatgtaaaaaaaggtctataatgaaaattctcctttccatctttattcctcatcattctacttccaatgccccacctcccctgtaaccaacatagttcatttcttgtgtattctttcaaagttcctttatgcacaggtaaacaaatgcaaatatatgtagccttgttttatctccctgtttttgcacgaaaggtagcatactctgcacatcattctgcaccttggtttttgttttctttttagaaggaagaagacttctttattgctagtaggactaagcagccaatttgtctatacagtctgaaaacattcctaaaactgcaccctacacctccacctctccccaccccacccttatgagcaaagagctatcatagttcaattctgagctgctcacctcccctgaatctatattgacatagggttgaacccaagggaaacctggtgttcagagaactcatttttcaaaatttatctatttttaattgactaataaaattgtatgtatttatcacatacaacatgatgttttgaaatatgcaggcatcgtggaatggctaagtcaagctaattaacacatgccctacttcacacatttattaattttggggtaagaacacttataatctaatctcttagccatttttaaggatataatacattgttattcactgtagtcatcatgtcatacaatagatcccttgaacttatctctcctatgctttggcttaaattattgtcccttctaagactcatgttggaatttaatccccagggtgacagtattgagaggtggtgactcaaaaaggctgttggataaggagggctctgccctcacaaatggattaactactcctgaattaatggattaatggattaatgggttatcatgggagtacaattagtggctttataagaagcaggagagagatatgagcatattagtatgctccgccctgcagccacgtaatgcactgcgtcactatgagaccctgtagatagtccccaccaggaggaaggcctgaattctcagcctccagaattgtaagaaataagtttcttttcttttctttctttctttcttttttttttttttttttgagacggagtctcactctgccgcccaggctggagtgcagtggcgccatctcggctcactgcaagctccgcctcccgggttcacgccattctcctgcctcaacctcccgagtagctgggaatacaggcgcccgccaccatggccggctactttttttaaattttttttagtagagacggggtttcaccgtgttagccaggatggtcttgatctcctgacctcgtggtccgcccacctcggccttccaaagtgctgggattacaggcgtgagccaccgcacctggccttcttttctttagaaattacccagttccgatgttctgtgataagcagtggaaaacaaactaagaaatcctaatttaaattatgtatcctttgaccaacatctccttaatccttacctacccctgcccacccctctggtaaacaccattctaccctctgcttctgtgagttcaaccttttggattccaccacatcttactttttaacattacggaatccttggtcatctctcctcttccgtgcatagatagcttcatcattctcttctctcagctgcatggcattccacctggatattctgtaattgatttaaccttattgatgtattcttgatttatcttctagccttttgctgctacaaatggggccgcattgcttaactcgtctgcatagcattttgcacatgggcaaacatctctctgtaggataaattcccagaagcagactcatgagtcaaagggaagatgtacaaataattctgaaagctcttgccgtgttacactctatgttattcaccagtgacttcatctcattcctttaaaccctgcagatattttactgtgttctacaatcacgtaactagtcccctatggatgggtatgtatgttgtttccagatttttgctactataaacaatgctttgtattgtgaacactttgcaacaccctagtacgtgtcaatgaccacaaaggtctctcagctttgggacatgaccaggcagcctgtttacctaaaaatctattgctgtttcagtgaagcctcttttgttctcaggccattgaacccagactgtcttcctagccctcatttaccatggatctccagtctgacctgttacataaactctggttgatgtggagcatgtctgcaaagcaccctagaataggctccctggatgctcttgagaaaaaagtgtggtgaggcaggtgaaaggttgggaccaaccgtaggcacagcttcaggtagaaagcggcatctagagaaagctcgagagtacctcaaaaatcatcaagggggctttttagaagcctaccgtgccagtatccagctgccccagattccattttagatggtctagttaaaatcttcagaaaagaaatgctgacttcactgctgaagagcagcagcactctcaaatagagttggtggcagggtaaataggttcagattattctgaaggtgattttttttctatgtcaatcaaaatttaaaatgtgtaaatcttttggctgagcaatgagcaatgcaatttctttttttttgagttggagtctctccctgtcgcccaggctggagtacagtggcgcgattttggctcactgcaacctccacctcccgggttcaagcgattcttctgcctcagcctcctgagtagctgggactactacaggtgtgccgccacacctggctaatttttgtatttttagtagagatggggtttcaccatattggccaggctggtcttcaactcctgacctcatgatctacccacctcagcctcccaaagtgctgggattacaggcgtgagccactgcatccggctgcaatacgacttctagtatgccctccttaagaaattatgtgaatgtaatccccaaagatgcgtattaattgcagtactaattggaggaaggtaggggaatggcaataatttgaatattaatcaataggagactggttcagtgaggtatatgtttatattttaatgtaatcatttaaaaagagtaaagtgactatgtgtgttctagtcgaaagcccacggcttctaagtacaaagttggtggtagaatactaatgtaatggaatactatacagcagtgaaaaatgaatccatcacagctgcacttatcaacatggatgaattctataaagtgttgatcaacaacaacaataaaaacagagaaaaaagcagttttcaggataattcctatggtatgacagcatttatataatatttttaaatgtgccatacaatgccatacattgttcacagatatttatatctgtaacaaataagtgcatacaataaataatagcagtaaaataagaacaagtgcacataataaacgagaatgctaaatgccacattcagggcagtagttcattccagggggtggagaaggagatggagaatattatgggggaggaaaggcaggggtttcaactatactaggagtattctattctttaagatgaaggtgcacatatgtgggtatttactgcgttagcctttaactctttttgattgactgaaatatttcaaaatgtgttactcagtaagttacagaacaatatatgccatgtgataactttgtaaatgttcagacagatagaaaatgacaactgtgttcatgatggctggcaggctgctgtgtgagctctgcattttactggcatgatttcattttactctctaaaactccaaaagacaaggctgatgaaaccccaccatacagatgagaacagtgagccccagaggaggggaatggctgtccagtgtcttaccggcagtaacagtgagctaagtccagaacacaaacagttctgactcccaatctcacactcctaggtgctattttgccttttaaagtgaaaatatgtaagtgtttttatatcaatacattttatttagagatgaaacaagacttggccgggtgcggtggctcatgcctataatcccagcactttgggaggccaaggcacatggatcacttgagttcagaagttcaaggccagcctggccaacatggtacaaccctgtctctactaaaaatataaaaaatattagccgggcatgttggctcatgcctgtaaccctaactattctggagattgaaatgggaggatcgctttaacccaggaggcggaggttgcagtgagctgagattgcaccgctgcactccagccttgatgacagatcaggactccaaaaaaaaaaaaaaaaaaaaaaaaaaaaccctaatgacggtttaaacaagattacaattaacactgataccctgtagaaagcaggattggtgaacagaacgtaggagagaagtgcttgtacttttgatttcttacctctcaggtgttctttaattttttgaataaactatttcacaggaaataattatttgaagatgtgggaaagaggaaaagtgcacaggaaacaaagtcagaaagtgtctaactctaccccagttttctctctatgatcttgaacaagtcacttcccccataggagtctttattttttttttcacctataaaatgggaaaaacaaaatgtcaactttacagtattgtttggagatcggaatgagatcctaagagggaatgaactctatggagtataaatcgccacttgaatatcagtattgttagcatgggcatacaggcagagggttgcaactgactgatagggaagacccctgctgcccccaaggccaccaccacctctgccttttgttccagaaggtcttctcaaagtgcaaatgggatcaatactatgaatctatccttccaagtggaccacagggggccggcagctgttgcctgggccagtgacgagcatgtaataagtgcagaatgaatgaatgaatgaacgataaatggataaatgaagtgatgatcaaatgtgcccgagacggaaactcggctcttgctaaatccaacttctttatttataaaatagacattaaactaagaccttctccaaccctcaaattcaatgatacaagcaacacaaagctgatcagttccaggaattgggaaggaagtctttctcagtcctgagggcagtgccagatcacctctgtgttgtgttcactgtgattaatccagtggtcttcaaccagaggcaatcttgccacccaggaaacatctggcagtgtttggaatcatttttggttgtcacaactgggcaggtgatgggagggtagggcatgcaggttgggggaggtttgctgctggcatctagtgggtagaagctagggatgctgctccgtttcctacaacgcatagagcagcttctgtcacccagcaaaaatgatccagcctagatgtcaaaggcataaaagtaactggcagtacagttggttctatgccttcaactatccagatgttcctggctttgtttttaattttgtgtgatgtgctctgctgtggtttttcaagcctcaaacagccttgttctttcactgctgctgatatgctgtgttgactctggacaaccgcttcccctctttgaacctcacactcctttactgggcagtttgtaaccgtgatctccaggagccttttgatctttaagatgtgatatttattttcagttttgtccccagtggggccaaacaatcaaggcaggttgggcgagtctttatagtggagtctgaagtataagaaataaccactggaatgggtattaatgaggattagaatagtgactaacagttttgcagtaccttttaccaaaagtacatccattgattcacctgtcagtcctgcgtcctaaaggtagttactgtaaatagtgccatgagggaataatgatcatcatctctaccaggaaactgcattccaaagaggctcaatgattccatctgtgaagtgcttctgtgattacaaccttgtgtgtgcattcctagacctctcaatcaccaggggctagagacagcatcttaaaatcagctcgttctgtaaatatttatttcatttaagaaagtcttttacgtacttattatacgtattttggaaaatgccaaaaagtaggaaggagaaaatacacccagaggccaccagggcctccatcttagtgccattcttcaagtcaaaacatgattctctgcattgcaatttgttttacttcgttgcttctagccattttcatacataccatagaattttatgtctcattcttttcactgaacattatagcagtagcatctcccagctctcgtttcttcactcacatcaccttgtacctgcatgatgatatgttacgctactgcttggaattccgtgcctctcccaggcattctgctgcggctggggatttaagatacaaaccttcagcttcagagcttgtgctttttttttttttttttttgagatggaatttttgctctgttgcccaggctggtgtgcagtggcacaatctcggctcactgccacctccaccttctgggtttgagtgattctcccgcctcagcttcccaagtagctgggattacaggcccctgccaccatgcctgactaatttttgtatttttagtagagacaggatttcacaatattggccaagctggtttccaactcctgacctcaagtgatctgcccacctcagcctcccaaagtgctgggattacaggtgtgatccaccatgcccggtcgagcttgtgctttttttttttttttcactttaataggatgttcccagtctaatctcccatctccccatcaaagttagaaaaatgggagagaaagagagatacgctgctgccccaacttggatggcagaacaaatgttcaattgccttctacgtggcatggctctgtcctttgggggaagagcaacatcagcgtgcatttaaggaaagctccatctcttctgtttgatctctgtagttgattatcagtgtgtgtgtgttttcctaactccttgagggcaggggccaaatcttagaatgttcactctcttgtgtcgggtgtcaaccataggagaaagtgaacacccaacactttgattgattgaccgcttttgagtagagcaccgactgtacgtgataaaggaagaatcagataaatgtgactatcatgatagaaaattttaaatgttctgaaaaaaaatgagttaatttaactcagcggtcatcggacaccaagaaaaacaaggctattggggcaagttataaagttgctggataagcagttttgtccccatgatgtaagtcttctctatctggacatcatcatggggatattctgattgctccagtttcctgctgaggccctgaagtacaattttcgctaattcccagtgggacttggttttgcatggcactaatctggccaacatcctggctaagaatgaggcctgtgggctgcctatgttgcagaccacagatgcatatcatctgtgttggacttggccttaagtttggagccagctggcaagatccaagcttgtgtatgattaaggaaaaggggatagtagggactgagagatgaatttatctggtggatacaaaactctccttgatggtcaggttttcagtgggaaagggctgactctgaacccagctgggtttccttcttagagtggtttatagctgctgcggttagcacccttgtaccctgggggacccagagagtaagaacagcagctgtgaagaggaagccagttggggaatctgttttcttgcatttccttctgttcttttgactgtatttgggtcttggaggactgggattgctaggggagatcacaagccttggaaagagtcaaagagtcaccatctgctgcacaaacccacactttgttttctgccaactgcatccttaggcacttggaagacaaaacagatgaggaacacatagtaagtcaggtgggttcacgtgttcccaaacttccctggcaactctgataataaaagtcaccagaggagtttttcaatcatcagcttcccaagacccacccctggagattcagatgtgatgggtctgaattctgtggagttggggttggagattagaaaaacactctagcccacccagcagagacaaacaaaatgagagggaaagggaagaggctgattcaagctgaggaggaggatgccaagtgacatcaataccccatatttcttaaaagagctagtagcatgatctttggggtcataaaaaccaagatttgaaacccagctttgctgtgtgacctcaaaaagtgatttaacatcccaaaacttcactttgatcattcataaaataggaacaataatttctgcctgatacggttgagaaggaattaaaaaggaggcaatggatgcaaagccctcttcattactcaacaaagcaatcacaattaaaacattataaatatcactgttattttggccaaggtgaattgatgtgctttttgtcacctccttgtgtgcagatgacacaacttgtttttccaatcttgctctctctctcctctctctcatccccacttataattaaggggtaatgtttgcaaaggagctggctggccagataacccaaaaaaaaacccccaacatccgccagtgttgggatttagcagtcaccttttccaatttagcagggttaacaaatggctctaagaataattgtcaattccctggtcatttcaaaaacccaacaatgtctgagctagaaaggcccttctttcatatgcagtctggctgcccatttgacacatagagaagatgcagagaagaggagacccatgcaaagtcatgctagtgaatagtggccaagatgggacaccacccagatccctcagctcctggttgtatccaagtactttgtgttgtaccacagctgggtcttggaagctgggtgtcctgacccctcccccctgctctttttgtccctatgccctcttttcactccacagtctacaaagatggtcaacatcaatcattttagaaaagcgacagtgagcataaaagccattgttttgaggcagatccacgtctggtctaatccaacaaggtagatagaatacctccattatacaaaagaggctgctgaacctcagcaaggttcaaggacttgcccagactcactcagctcataactgtaacaggcaggatttgaaccctaactctgaagcttcactactccccaccttggactaggaaatctgcctgatgcctgaatgaccttgacctgccctcatgccatccactcacgctgctcccagatacccattcctggcccagcatcactggcggcctggaaggaacactggctggtaatcaatgttacacaacaggaacatttgttgatgccagttgcaaactgttgcagtctatatagattaagccaccgccgccaactccatgaaagtaaatgagcctctccaacgactgctgaaataaatttaaatgacagcactggagggcctggagactgtagctgagtgagtgtctccctgcagaaaatcgacaaggacagctatcagtccgagggcctttgtccccgtgatgtaattcctctctatctagacatcttcacggggatgttctgattgctccagtttcctgccgaggggctgtgattgcaatgacaagagtaaaaaccatgacggcagctggcatttgctaagcactcactacgggtgaggcgctgtcctaagtgctttgcatacatcaactcgctgaatgatggcaaccccaggaaataggaaataatagccccatttgacagctgagggaactgaggcttggagagtgaagtcattaaccagcaattggcagaactgggtctttaaaaagcaaacaaagctggtttccagcaccattctgccagacagctgcctgggccagcccttctttaaaatgactattgggccgggcgcggtggctcacgcctgtaatcccagcactttgggaggccgaggcgggtggatcacgaggtcaggagatcgagaccatcctggctaacatggtgaaaccctgtctctactaaaaaatacaaaaaattagctgggcatggtggcacgcacctgtggtcccagctgctcaggaggctgaggcaggagaatggcgtgaacccgggaggcggagcttgcagtgagccgagatcgcgccactgcactccagcctgggcgacagagtgagactccgtctcaaaaaaataaataaaataaaataaaataaaatgactaaatggttttaccttccagacaaaaataaatcgcaaggatggggaccaaggtgggaggatcacttgatcccaggagtttgcaaccagccatagtgagatccgtctcaagaaaaaacaaaatgaattacaagaagttagcaaggtatacaaggccctccagggcctggcccctgcctccctaccttaccagctttatcccccgtactctccacttgtgctccaaaaccccttgcaattcttttgtgcccacctctgcccagcctccaagcctccatgggtcttcacacagtcctctgttctgaatctgcctcgtgactctgaatcctaaaacatttctgtgtctcccacaaggtcactcttacattccttcagtttaaaatgtacctcccccaaccctgcttttacactgttggtgggaatgtaaattaattcaaccattgtggaagatggtgctgagattcctcaaagatctggaaccagaaatagcatttgactcagcaatcccattactgggtcccattacatatatacccaaaggaatataaatcattctgttacaaagatacatgcatgcacatgttcattgctgcactattcacaatagcaaagacgtggaatcaacctaatgcccatcaatgatagactggataaagaaaatgtggtacatgtacaccatggaatactatgcagccataaagacaaacaaaatcatgtcctttgcagggacatagatggagctggaagacattatccctagcaaactaaggcaggaacagaaaaccaaacaccacatgttctcacttataagtgggagttgaacaatgagaacacatggacacagggaggggagtaacacacactggggcctgttgcggggtggagttgggggaggggagagcattaggaaaaataggtaatgcatgctgggcttaatacctagcgtgggttgataggtgcagcaaaccaccatggcacatgtttacctacataacaaacctgcacatcctgcacataggccccagaacttaaaattaaaatttaaatttaaaaaaactctcctcccccatcccccaagcccagccagagcacacagcttagaaaagagagtgtggcctggtgtccatccccactcatcctcttagctgcatgtctttgtacagggaacaatctgcccaactgtacatggcatgcctgtcctgcagacggggttagggcccgtcctctctgctctcttagcacacaagcttttctctttccaagcattcatcatatcaaatatgattgtgtctactttcccatcccccttcccagtacatatacaaccaggcagtgaggcccctgtgctttttgtttctatactcctaatgcttagctcagtcctggcatgatcaagcccaagtcttcaggaaaaggaaggaaggaaggaaggaaggaaggaaggaaggaaggaaggaaggaaggaaggaaggatggatggaaggaaagaaggaaggaaatgaaggaagaaaatgaaggaggaaggaagaaagaaaaaaatggaaggggaaaggaaggagggagggaggaaagaaagaaagaaaggaaggaaggaaggaaggaggaaggaaagaaggaaggagggagggtgggaggaaaagaaggaagaaaagagaaagagggagagagggaaggaggagaaaaaagaaaggaagggagggagggagaaaggagaagttggtttagaggccagccggacgagctttgggcaccgcccttaggagggccaccctcagagtctgacagcaggtgaaggtcctaaatctccccaaactaactggtgtcttttctcctcttccaagatgctcttcccgagggagatgctagccctttgggtccttacctcctgccctcaggagccccggagagaggcagtcctggcaaagagcaccctgaagagagagtggtaacagcgccccccagttcctcacagtcggcggaagtgctgggcgagctggtgctggatgggaccgcaccctctgcacatcacgacatcccagccctgtcaccgctgcttccagaggaggcccgccccaagcacgccttgccccccaagaagaaactgccttcgctcaagcaggtgaactctgccaggaagcagctgaggcccaaggccacctccgcagccactgtccaaagggcagggtcccagccagcgtcccagggcctagatctcctctcctcctccacggagaagcctggcccaccgggggacccggaccccatcgtggcctccgaggaggcatcagaagtgcccctttggctggaccgaaaggagagtgcggtccctacaacacccgcacccctgcaaatctcccccttcacttcgcagccctatgtggcccacacactcccccagaggccagaacccggggagcctgggcctgacatggcccaggaggccccccaggaggacaccagccccatggccctgatggacaaaggtgagaatgagctgactgggtcagcctcagaggagagccaggagaccactacctccaccattatcaccaccacggtcatcaccaccgagcaggcaccaggtatgcagcccccaactcctgaagccatcctgaaacagccatgaggcactcactatgttcagggcatgtgggtagaggaatctcaagaagccccggccccaccatcagttaccgtccattgagcactgactatgagcttcgccctgtggctcagaattaatagcctcatttcatttgtttgttgttttggggggttgttttagcaaaggggtcttgatctttcgcccaggctggagtgccatggcacgatcatagctcactgcagcctcaaactcctgtgctcaagtgatcctcttgcctcagcctcttgagtagctgggactacaagcatgcactatgatgtccagctaatttttttgttttttgtagaaagggggtcttgcttattgtccaggctggggaactcctgggctcaagcaatcctcccacctcagcctcccaaagcactgggattacaggcatgagccaggacactcagccaacatccccattttaaagatgagacaactgaaaccctgagacccccaagcaacctgccaaaggtcacacagctaatgagcaagattcaaaaccttttcatcttggaacggaattcttcatttaacctgcttcaaagccactagccttttcaaagcacatttgcttttagcattacatgtattttctagacttgataaaatgctcttctgtgttccagtcttctctaccatctttaaaatgggagaaggacccccaattgtcaagcatacatggattttggacaagtgcaatgtggccacccttcaaagcacgtgagctctgggtccaaatcctgcttgctgtttgagctcggcccctctctgagcttttgtttacttccctctaaactggggatgaaatattatcagtccctatgagaataagtggggtcacccctgttgactagctaaaatggtgcctagcaggatatagtaagtgatcattctgtgtcaattattgctatttttattatcatgtcaattctggagctgaggaattaacagcagaaggacagatgggaacagcaaaatgcaggttcccctaaagcccccattccaccccacagcccatggttgagcttacatccaagttgtctttggtgtcctaattaaagtccttccttccagctctctgcagtgtgagcttctccaatcctgaggggtacattgactccagcgactacccactgctgcccctcaacaactttctggagtgcacatacaacgtgacagtctacactggctatggggtggagctccaggtaaccccaggagagtacctcacagaggctgcctcgtctagcaggaagtctcaggaggattgtctgagtcaggcttactgttatgctaactagtttggttctgtctttgcccaaccaggccaactttagctgggttttggcgaatgagtaggagttcttaactcaatgctttgctaaaatagcttgtggggatagagggaacatgctgacaaattctgaggtatttcccagaaggaaaatcccttgatactctgcttatctcacacacacatacacacacgcatgcacgtgcataaacacacacacacacacacacacacacacacacacacggaagctccacctgattcatttgattctttcttgcttgcttgcttccttatttctctttctctttctttcttgcttgcttgcttgcttcctgctttcttgcttctttctctttctctttctttctttctttcttgcttgcttgcttgcttcctgctttcttgcttctttctctttctctttctttctttctttctttctttcttgcttgcttgcttgctttccttcattttctggttattaggacattttattcttaaacttttgcccatacagtaagaaaggaaaagcagggtggcataatgctcaaacatctgggttttaagtcctacctcttccagttaaaactgcgtgactttgaacaaggaacttcacctctctgagcctcagtttcccgatcaataaaataggaataatgttactgctttgtaaagtttgggggagcagtaaatatgacaatgcagagatcatttggccacagcccagcagagagagagggaggagagagagagaaatcatttggtcagagcccagcagaaatcgcgaccatgcagtgcatgttatccattatcttcagtatgctaatcaccctgaatgtgttcctttttctcatgggaaataaagagccatcaaaagtttctgagctggggcaggtgtatgaccttaccttaggaaggttttttgtttttgtttttgttttacttgtataagagagacaaaaggtaagcccctcagcagtagaacctgtagtctttgcagtccccagagctttgcacaagtgtgtggcacattgtaggtccttaataattgttcatggaattaaaataaactggagaaaacctgcagtccagattattatagtgcttaagaaccctttcctccatgtcatgaagagtattggacccagtatgtgtccagtactgtgtggagccttttaccaggcacagtagagttcattcattgagcaattagaatgcaccaggcaaagctgttgacacaggagaatatgttgatgtaaaaaactgatgcaatgcctgccctaaaagagaaatacgtaggatgccatttagtagggactctaattggtgttttagaggttgttgtagaatcgcagcaaaggaacaggcaaactccttggcaatcagggaaggtctcatagaggagggcaattttaatggggctttggtgaatgagtaggagttcatcaaagagaaaagaggataagatatagggcctgaaggaagaagagcttgtgggtaaggcctgccctgtttagaggagaggcagagaaactaaagttccaagccctactcataaaagcgtaagtcttcaaattaggcattgagacctgactaaattctcccttacacacacacgcgcacataccatttgttcagcctccctgcgtacaactaaagtatctcgcttctttcttctcaaatcccacagagtgtaaatggcaaagcaagtgtctgattctttgagataggggttgattgtcctgcagttgtagccaccactggggagaataagagaatgggccagagagtgccctagaaatgaggcccccacccctcacttaccaatttatgcagaaaatggaagaatatattcaatcttttttaaatattttctgagcacttaatatgtgccaggtactattctaggcactggaaacattgaacagcatggagaaatccctaaccttgcagagtatacattctggtagaatgcttctcccggctccctggagattggatctcaagcacaagctgatccaactgctgcctccactcaccagctccaggataatctatcccacccactagcatccagggcctgtgccaaaggcccctcttacaggacacagcaatgggggcctcacattgcaagtcccttgcaatgcctctgccttgcagtttggtttcactctatccccttggcttttggggaaattagggggaccttgatattcccagggctcctgtgggctcggcatggggcccaggggtcccgttgaccaggggctagcagtacctgggccacttttcactgacttctttgcaaccttagaaggctctgtctcaaacacaactcagagttcctctctgtctgcttctgcctgttcccaggtgaagagtgtgaacctgtccgatggggaactgctctccatccgcggggtggacggccctaccctgaccgtcctggccaaccagacactcctggtggaggggcaggtaatccgaagccccaccaacaccatctccgtctacttccggaccttccaggacgacggccttgggaccttccagcttcactaccagggtagggtcaggccaaggctgatgaaacataggcgtttgcctcagtttccctctggagaaaaggattttaaaactttttgtgccagggacctctctgacagtttggtaaaacctacaaaccccttctcagaataatgtttttaaaagtataaaataaaatatatacaattttaaagaaaacggtattactgagctgcagttatcaaaatactgttataatctatgatgccttaatctatgtgctttttattaattcattaaacaatgtcttctagtagttcttataattgctgacatttcaaagtactaaggagcataagaaataggttgagatatccattatgatatgaaaaatatctgtggtttctcttggtgtcaaagtcacaggttctactacaatgtttcagtttgttgccaggaaaatagcacagctaaggtagaggttaatgaaaataagcaagcagctttccttcattcaagttcacaggccctgaattcaatatatagatccactgtgcgtccacagactcctgataaagagccttaacagggtacttctctcttttcttcttcctctactggttttcctttttgtctgttcctgtcttctctgttttgctctctgttcattcctctcttctcttacttcctttctccttccttctcttctcctccctctttgcttgcttgttttatttcttcatttcctcctctctttctcttcctttccaccctctattttccctcccttctctctctctctcctttcctagtcccccttttcttcccctctcctccaccccgatttcctcctatgcagctcccatgacctcaggtctcctttgcctcacccaggaactttcccttggatacttaccaactgctgaaacatctgaatggaaagtggattcgtgaaccatgcaaccagatattgagagccatcatgtgttatatcaaattgtccagacatttgaaaacaacaacaactcattttcaacttttctctcacctgtttctgaaacaggtggatgactgcaaaggggagtgtccacttcatcacaacttttcattgtgggatactgccctttgctgttgttgtgaatttaaaagcaacaacaaaaaagaatgtgaatcatgaacttgaatgtattcctcctcatcagtactgagaataaagatattctgtgctgcaggagaggtcagaccatggtctagggtgaagaagctaggatgaatttgacatcctcttatgaaaactgaggaattcagtatgtccccatgcacccttttactacccccatctactgactgcgaaggaggctctttctctgtattatctcatttaatccccaccaccacctgtaaggtggaggcactgagtccttgtctcaaggtgacatcgttttgtaaactcacattagttttctttctaaagcccaagctcctgtctcgcaggccagtagttctcgagctttcatatccttgggcaattcccaaagacctggttcaagcatctgcatttttaacaagcactcaagatgtgcacgcaggtgggactaaacttcctgggtggtcttgcccctcccagtcccagagagaaggccaatctgtctctacatagatagagataggctcaaaggaggtatggaaactcatttttcatcccaaacctgctgtctctgtttaggcagggtggcgatttttaagtcccaagaaagtgctaacctggcagtttcagcctgatatgatcaaagagagtcacaaaaataccattctccagagctctggagtccccaggggcctcatcttctctccccagcacaaactggctcccaggatgtgggtcaggttcttgatctgccactccaagtgatgactgagtctgcctctgcatttcttcccagccttcatgctgagctgcaactttccccgccggcctgactctggggatgtcacggtgatggacctgcactcaggtggggtggcccactttcactgccacctgggctatgagctccagggcgctaagatgctgacatgcatcaatgcctccaagccgcactggagcagccaggagcccatctgctcaggtatgctccagcctcagccggaccaaacctgatggtccaactaagaggggaaagaccaacctgtaggacaccgagagtgacctcagggaatggctttcagcccaggggaagaaactgctccaaatatggatgactattgttatttatgtttttattggagtaaaatacacataatatgaaatttaccattggagacattttagtatgttcacgctattgtgcaaccatcaccactacctagctccaaaacatctttaacaccccaaatggaaacactgtacagaaagcagtcactccccatccctccctcctccccacactcgctggcaaccatccggctgcattctgtctctgtggatttatctattgtggatattttatgtaaatggaatcatataatatgtgactttcatgtctgacttctttcacttagcgcttggcactgtgttttcaaagttcgtgtatgttgtagcatgtatcagtacttcatttctttttacagctgaataatattccattgtatggatgtcccacattttgttgacctgtttattcgttagtagacatttgagttgtttctacttttcagctattatgaacaatgctgctgtgaacatttgtatgccagttttttgtgtggatatggctttcatttctcttagatatatactcaagagtggaattgctgggtcatagggtcattgtatgtataactttttgaggaaccatcaaacgattttccacagcagctgcaccattttactttcccctcagcaatgtgacagtaccagtgtctccacatccttgcccacatatgttcttttccatgttgttgtttttattgtagccatccttatgggtatgaaggtatctcatggttttagtttccatttccctgatgattaatgatgtcaagcatcttttcatgtatgtgttggccatttgtagatcttctttggggagatgtctagtcaggtcctttgcccatttttttttaattatactttaagttttagggtacatgtgcacaacgtgcaggtttgttacatatgtatacatgtgccatgttggtgtgctgcacccattaactcatcatttaacattaggtatatctcctgatgctatccctcccccctctccccaccccacaacaggccccggtgtgtgatgttccccttcctgtgtccatgtgttctcattgttcaattcccacctatgagtgagaacatgcggtgtttggttttttgtccttgcgacagtttgctgagaatgatggtttccagcttcatccatatccctacaaaggacatgaactcatcattttttatggctgcatagtattccatggtgtatatgtgccacattttcttaaaccagtctatcattgttggacatttggcttggttccaagtctttgctattgtgaatagtgctgcagtaaacatacgtgtgcatgtgtctttatagcagcatgatttataatcctttgggtatatacccagtaatgggattgctgggtcaaatggtatttctagttctagatccctgaggaatcgccacactgacttccacaatggttgaactagtttacagtcccaccaacagtgtaaaagtgttcttatttccattttttaatcaggttgtttgtctttttgttattgagttgtaagcaatcattatatattctgatcactagacccttatcagataagtggtttgcaaatattttctcccatttcatgggttgtcttttcacttactgacagtgttatttgatgcacaaagcttttacatttggcaaaattaaatatttttttcttttctttcttgtgctctgagtgtaactactgccatttttcaagccaagccaatatgtgttgcacaccgtgccagaggctgcatttaatcctcacagcaatgccataggatgggagccattatccccattttgcagatgaggctcatgtaggtgaagtcacttactcaaagcctccatgtagaaattgttggaggtagcctgctgacacagtctggtgccctctagtaaaaagaagtgggctttctgagccagcagacagaatctgagacttcgaggacagaaggaattttaagcacctgttgggcgttgtttgtcattcagagcctttcctatctaggtactcattcgacaaacatccgccgagcgcccactgtgtggtaggcattgcacctgttgctagagctattgcagggaccctgacccagttcctgctctcacagagtttccagtcaaggtgaggctgtagtatgtaaatgagtaaacaaggatgcaaacatgctggtaacagattgtgttaaggaccaggaaagaaattcacatggtggaatgatgcagagtgaggatggagaggacatcagttattgtgagaggcgttgcaatgcagaaaaggtatacaggaagaagctgtgatagaggacctcacctgggaggaggacagtgatgagcgaagggtcagggaaggattacctgataacactccaagatttggaagttgagtaggaaatagactgagggtggaaaatgggggggagaagggggaaacattccaggcagatgcactagcacatgctaaggttcagaggtcagaaggaactcgatgagtttgagaaagcaaataaataaataagatcaatctgactaaactgcagagaaaatatcaggacaggaggctggggcagtggtcagaaactgtattgctcaaggtcatgagaagacaggtggactaggtaggagatatctggaaaaatttaagcataagggtgatcattctgacttctatttggcaaaaatgattgaggatggtcagagtggatccatggaaatcaaggtggacaatatctactatttcacttgaactcagggagataagattaccactttcataggcaaagagaatgaggcttagagagatgaagtaacatacttgaagtggcgaacttagtccagatcccttctctcctgagctcctccccttacagcttccttactcaaagtgtggtcctcggactagcaaaattattagaaatgcataatcctgagccccatgcaaaaccaaatgaatcaaaattttcactttaacatggcccttgggtgactcatatgcacattacacctggagaagcactggtttgtaacgcactgtccctgcaccagtgggcacagccttggccatcttcagctatcaagagagcaaaacccttttagaattctcaaaagtcctgatggtggttgagagagtataggttgccctgccacctactatgtgccaggctatgagccatgtgtgaagagaatattggaactaatgagacataattcctgccctccagttattcatagccaagtggagctcaaaaaggaaatgagagctaatgataaattctgagattcaattgttacagtattgttcccccaaggcccttcagaatttttctttcttttttttaaacaaagataaaattccaaaccatagggcagttggtcttcacgcctctctcacattaatttttatctatgtgtgaaatcagggaggaattaagcttccatttgtgctaagaaagatggatggggagccacggctggcaaattgaagccaaacagagccatcagttggcttaatcaggcaaagaagggaagcagagaagccgcaaacgatcagcagcttgggaggacagatggccagagccccccaccagggacagtgtcctccatttctcagctcctgagccacagggcaatagagctggctatgttttgagtgcccactctgtgccagggatggcatgaagctccccatgcccatcgtttcattgatttctcactactgtcctataaggagggtggacttatcaccattttacagtgggtaaacatgtgacttgtcttagatccacagcagatgactggcaaggtttcaacctagggctggcttatttcacagaacaatctctcctctaggacagaagggcagcctggagagagaaatgaacctagctttctgtctgtggtcctgaaagaagtatggagcttcttggcaatgtctttgctgtaggtcacaacacagtctggagcagagataagagttatccaccgttctctgctactgcaagccccattcagtcatactgtcattcaacaaacatttaatgggtacctgctatgtatcaagctttgagctgatattagagatacaaaaaggaaaaaatatttattctttcattcaacaaacattttataaagcaactactatatgccatatacctttctggattagcaggttatcataaataagacagacagtggagtagtgacttcgataagagatactggagtgaggcagcctgagcttgagtctcaactgctccacttattatgtgtatgtccttgaggaagtggcgtaatacctttgaacttcttttttcctcttttgcaaaattaatcgtggttattcagtaaatatttactgagcacattctacataccaggagctcttctggttgctggtagtgtgactgaaagcaaacaaacaaaaagtagtcctagcttttgtggaacctacaaaccccttagccatctgtgagatggttccaaataacctgtcccacttttgcttcctctcctatatctctgaaaatgaagggggaaccaagcgtcctgtgcttgggaaggaaatatttttcaagctcctttgatcctcataaaagatagaaatggctcccaagacttgaaaccctggtcatggtgtagggctttactcaatcgtggccctgggctattcttcacatcccttcctcctggactgactgccacgctctgtgagaagcatctgctacccaccatctctcctcagaaaattcaaaactggctgagtgctgtggctgatgcctctaatccttacattttgggaggccaaggcaggtggatcacgaggtcaggagttcgagaccagcctggccaagatggtgaaaccccatctctactaaaaatacaaaaattagctgggcgcggtggtgggcacctgtaatcccagctactcaggaggctgaggcaggagaatcacttgaacctgggaggcagaggttgcagtgagctgagatcgtgccattgcactctagcctgggtgacagagcaagagtttgtctcaaaaaaaaaaaaagaaagaagaaagaaagaaagaaagaaagaaagaaagaaagaaagaaagaaagaaagaaagaaagaaaaagaaaggaaagaaaattcaaaactgttctctcatatagtacgtgagaaaacaatttcctaagaaccaaatatctcctaagaattagagtaaaaataagaataccttctcgcttgagaactggaaagtgttctttccagtgcacaaatcactttttaatatttttcattagatttttatgataaaagtaatagatgattctggtaagaaatttttcaagaaatagtgaagtgtaagaaataggaacaaatcacttttatattcatggtctcaattgattcttgaaaatagcttattaaaataggtatggcacactattttctaacttgctttttttttcacttaaaaaatagtgagcatcttcctatatgctgaagtattctttgagaacatggtatttagtttctgaatgggtggagtgtatttacagttatgcatcacttaacaatggggatatgttctaggaaatgcatctttagatgatgtcatcattgcgtgaacatcatagagtgtatgtacacgagccttgatggtatagcctactacatacccaggctatatggtacagcctattgcttctccgctacaaacctgtacagcatgttactgtgctgaacacattgtaacacaaaggtatttgtttatctaaacatagaaaagatacaataaaaatataatattaaaatcttatgggaccactgccatatatacactctgttgtaaattgaaacactgttatgtggcacatgatgtatttcactaaacatctgtgagtggacattcatcttggtgttttttttatttttcattcctagaaacaagatagccatgaatatcctcattcctaactcttggtgcaaatctctaaatcttttcttattataattatccagaaccgcatttggcggatcaaagtgtttgagcacgttttctaggcttttcactaaattgccctcccgaaaggtcataacagtttgcattctaaccagtcatgatgaaagtgagcatttcccatcacccttaccatctccagattttattgctgctttttatcttggccgattaggtggatgaaagtagaatacagcttagatttgcatttcatttgttattagtgaggctgaatttttagtgcttactgagtactagaaatatatttcttcttttgtgaactgcctgtttatatccttcttgattgccattttgtaattaaaagtcagggcacagccagcaccacagaactgtcgttaaattgcagtcattccctaccatgaaatacacatgttgatggttccaattgtagggtgaaatctcctgtcaaacaggattccctcccaggagaagtcccttccaagctttctctccctgcccggtttcctcccgctccaggtctctgatgtttcatcctgggcaaggggcaggggtggggatcaggggagaatgaaacactcacttccttctctctctctctctctttctctctgtctctctcctctctctctccctctctgctctctcccattgcccacccacccctttctggatcagctccttgtggaggggcagtgcacaatgccaccatcggccgcgtcctctccccaagttaccctgaaaacacaaatgggagccaattctgcatctggacgattgaagctccagagggccagaagctgcacctgcactttgagaggctgttgctgcatgacaaggacaggtaaagctctgaaggtccacacccaaccccgtttcttcccagaatattagaacatggcttgaggacttggagtcttgaaatggctgaagctttgaccctcggaattcaagaaaagaagagctggggtggatggcaaagatcttagacaccatcagcttcaatctcttccttttacagataaggaaaccagggtatgcagaaggaaatggacctgccccagctcaatcagcaggctaggggaagaggcaaaaagggaactgccctattctttctcttgcacacccctttttgcagttgaacaaaaagagagtatgtattgatcatctgctcagtacccagccatatattaggctccatggagaacatgaaagaagtagaaaatattagtttctgacatgataggaaattgagatggaaaaactagacgtatgcacatgaaagaatgaaggagaagttaccaggcaatatctaagcaagagtgtgtctgtagactcttaataatatgcatagaatccagaatatgcatagaatccagaattataaaactttaatattctgcagtattattctagaatatttggggatcttattctagaaattatggaatcttattctagaatgttctgaaatattctggtatcttattctgggatattctggcgtcttattctagaatattatggggtcttgttctagaatattctggattattctgagatcttattctaagatagtctagaaaactaggactttagctgctttgacttgctgtcttgagttgggtttccttggaatcagacatggtgataaagatgtgagaggaagtagttcactggggagctgatcctagtaagcactaggaggcacatgggaaagtgagattgtgaataccagctgcgttaataagcgggtgactgctgggaaaaccgggattctgtccactggaaacctctgggcaatgtgttgagcatacctcagagtggtcctgttggaagggtgagggagctagggtacttatgcaccagctcccattcatcactggatgagagatgtgatgaggagcactaactatccccaacatcagctgccaccctttgagctggttgagttgactgattctcagagacttgtggtcagaagccagcagaaaatgtgggagcagttgactgctgaggggtaggagagggtagggcactggcagtgtttactgcacttccagaatgcccccaccttagaattttggagtccaagaaactttgatctaagaattctaatgttttggcttctttgatggatcaaacctagactatgaggtctttagtttggaaagacttaaaaaaaaaaaaaagacaactgaataattttcccatacctcttgagtccacttccctctaggcagttcagctttatccagaacaactctatatcgataaattgctgctgtaaagtgtaaggtatcaagcaggggctcccgaacgtggctttttagcagcaccagaataataacctggggaattctttaaaaatcagattccctatcctttcttctggagactctgaaaatctgggcatgggaacccttggtgaaggaccatttccaaatcttaaacctcagatctgcctcttctgaggggtgcttgagatgagccaggcttaagtttatactagacaacaagaattagcagagacaaaagaatgcatcaaaatgagtattttcttattttctgcaagttgtttaagtcctgacaaatgggccccccactggcactggtcactagtagtttctctggggtcctgcaaagatctgcatgagctgacacttaccaggaaaaaaccagctttcaagtgtatcagtaggaagagaagtttgtagagttcatcaaggttaaaggtcaacacacacacaaaaatgatgaagacactactctctgggccaagaagaaaagagaaatcaattatgtctgtcccatgtactttattgagggggaaatggctaaaataccacaatatgtcagttgcaagaactcagagctagataagactctacataagaaatgggactttgacctaaagtcaaaatggaaggagattggataatggatccaaaaatacagagggaggggtattccaagcatggagaattggaggatgagcacaaagatggaggggaaagaattagcaaatttgttggggggctgcagcagaagctctcatgagaacaggaggaaagagatctgggaagctagattggggttatatcctgaaggattttgaatgccaggctacttttataggcaatagagagcctataaaagtctttttagtcgaggagggacatgaataaagattttaagatgattttcctcaaaatgaaccctttctaaactccagtctcataatatgcccccaaaaaagtgagttctctggtcaaacatgtttgggagacactgcgcccaccctatccttgccttgaaaggtcgtaatatgtactagctaacaaaggcactgataagtcctgcagggaaaaaaaagtttaatttttatttaattcagcattttgcaaatccatttgaccatagactattaagaatttgagagaaaatgtattactattgcagacattctagaaaatatggttagaaaattgttggttttaaaagattaatagactacagagattttgagatcttgaagctttcctccagagcaaccctctttgccaaaggcttctgttctttgaaagaggtgtcccaacacacagcccctaagatataacagagtcatcaggaatcagaagactatgtagatgccccttcccactcctggaatgccccctggactctaccacagcccccatccttgcctcagccatactggacacatggcaaaataaacaaactgtggctgcaacatttatacatcttagtgacattagaaattcatctgggcagcataaaataaactatttttatgagtcagtaaaaacctcaaaggcttaaaaatgtgtgtttatgactccataaaagaagcttatctaatttgtatatggttttcttcaccatttttgcataatttctttaaaaaaccaaggctagcaagaagtcaacttcaaatagctttaataacaataaaaataaatacccaacattttgtttaacacattttatttttcagggcactttttattttgcaatattctcaaagcccacctgtaagatgggtcagaacgacgttatggttgggtctctcctttcacagttgaggacactgaggctgaaaggtgttttaagacttaatgtaaatccagatggggaattgagaaatgggaattatgactcttgacttcccacacagtgctcttagaaaatggggatcagagacagagcctggtgggagtcaaatgcttaataaacaaaacttacctaccgtgtcctgttaactattttttttttaagaccgagtcttgctctgtcacccaagctggagtgcagtggctcgatctcggctcactgcaatctctggcttccaggttcaagcaattctcctgcctcagcctccagagtagcagggactataggcacgcgccaccatatctgtctgatttttgtatttttagtagagacggggtttcaccatgttggccaggctactatctaactcctgacctcaggtgatccacccaccttggcctcccaaactgctgagattatagacttgagccaccatgccccacactctgatataggtgcaattgtacccattttacagatgagaaaacagaggctcagagaagtgaagtgttcttgtgcaaagtcacacagctgagaagtgacagagtcaggactcacacccaggtctgcctgactttacaaaagccaccatttaggcaatgagattagtccattatttccaacttctcagttaataataatagtcaacatcaattcattagttcgtcgtttggtttattacatcatatacattactctccctacaacctcagaataaatccataaggaagccaggacaggcatttagtcccattgtacagaagaggaaacaggttcgataaggtgatgcttgtctgagcacataagaggtaaagtcaggactgggcgtggtggctcacgcctgtaatcccagcactttgggaggccaaggcgggtggatcacctgaggtcaggagttcgagaccagcctggccaacatggtgaaaccccatctctactaaaagtacaaaaatgtgctgggcatggtgggacacacctgtaatctcagctactcgggaggctgaggcaggagaatcacttgaacctgggaggcggaggttgcagtgagccaagatcgcaccattgaactccaggctgggcaacaagagtgaaactctgtcaaaaaaaaagaggcagagttaggtttgggatccggtaatgaggctccagaggcagtcgtagcacatcccttcctctgccatgtcagtgacccaggaagatctgtcagtgtccctcctctctgctcccactgccaggatgacggttcacagcgggcagaccaacaagtcagctcttctctacgactcccttcaaaccgagagtgtcccttttgagggcctgctgagcgaaggcaacaccatccgcatcgagttcacgtccgaccaggcccgggcggcctccaccttcaacatccgatttgaaggtgagggtccctgggagcttccctttctcttgtggggctgggggtagcctgggagcagggaaagcatggggagatagaaatctgggctgcgaaggatgtgggaaatcccatggccatgtggatcctttggtttccaaagacaggctcttggtttcattaataataacaatgcctatcattaactgtgcacttactacgtgctcagtgccttctgtgcactgtctgattggatttcagcttctgcatcatgtttgatcctcatcacactgaaacattagaactgttattctatctgatttttggtgaggaaactgaggtttaagacacttgggtgaccggcccaagaccaccagtgaacaagggtggagttaagatttctgtccatcctgtgctggggagccctgaagctctgctccactccacctagtagacctcttagaatttagccacttcttcctccaagaagaatttagcaagagcctctcctgctgagaccctgactcttgaagaaggggttcgctgggcatttcatgtacgctgggggactttctgttctggctttgccaagaaaagctggcttttatcatagacagccctacagtttccagtggcaaaaagtcagggctctgaagttacgggccatgggaaggatccatataggatgtggaaaggcattaaaacacaacaactccacagggtggagaagacagagattcttactcctattttagatttttttaaatgaggtcccaaggagtcaactgggtggccccagggttctcaacacgtcagctggaaccaggacacgtaatttggtacctgttttctttggggcttttctaaacagcacaggggacccatcttctgaaatatagcaccgtggggtagtccctgcatcatctgaactgctgcctctctttcccttcctcagcgtttgagaaaggccactgctatgagccctacatccagaatgggaacttcactacatccgacccgacctataacattgggactatagtggagttcacctgcgaccccggccactccctggagcagggcccggccatcatcgaatgcatcaatgtgcgggacccatactggaatgacacagagcccctgtgcagaggtgagcggatccacaacgctcttcccacggcaccccagggatctccaccctttggatgagaagaccaaggccccagcttagaggcctgtccccagttttcataccaactttaggattagaaccctttccagggttcactgtcctttggttcagggttgctgctggtcttgagaaaattacaaaatgggtgaattttagaaggtgcaccttcttccaggcataggtcccacagtgcacagcttagtgagctgaatactgcatggatttcagctcctaaatactccctctgctacgcatgcttgtgcagtgcacaacccacgcaataacctcattaataagaacaataatagttcttaattggtgtgtaataattatgctaccagcactttgctaagagtgtgtgtgcattatctgatttcaacctcaccatagccttataaagtagattgtatcggccccatttgtaggtgagaaactaatgctgtgaagtgacctgcctaagaacacacaaggggaattggcagggacaggaatggaactcatgtctctttgttctcagagcactgtgctctgagccccactggacagtgttgtagaaccctcatctacacaggctgcagtggactgtcctgccagtttccccatattctttttgttgttgagacagagactcgctcggctcactgcagcctccgcttcccgggttcaagcgattctcctgtctcagcctcctgagtagctgggactacaggcgtgtgccaccacagccggctaattttgtatttttagtagaaacggggtttcaccatatcagccaggctggtctcgaactcctgacctcaagtgatccacccaccttggcctcccaaagtgctggcattacaggcatgagccatcgcacctggcccgtttccccatattcaaggctgctgagccaccctgagcctgggtctcctgctggcatgtggagtaatgaaaggtgccctcactcctggcagccaccgcctcaatggcagttggtgtgaaatcacagccttgccatggtgagggattgatccctatattaaatgtgccgatttaacagagcggaatttattggtgctttggcctctgccatgttgagacctttccaaagtggtaaacacagagtagaatttaaagggcacctgccgcagccacatctctgcttccagttcagggccgggacctgtcatagcaacattatctaaattatcgagcagctaccatgtgccagacactgtgcagcatgtttgacattcatgagcttaagcctcaaaataacccaatgaggttggcagtggtattgcccccattttgtagagaaagggagctgaggctctgggaaattacatacctcctcctacagcctgttagcagcagaggcaagattgggaccccgggaccacctaacttgagtgggcggtctcttagccactactcaccccgcaaaagagcagaggctgttgaggagtcattctgaccactgagctctgtccttggtcttgaaagagcaatagcacctcttagcccaacttttaccaaccctcaggtgcaaggtaggcagctggccagctctcatttaatcattacacacacacacacacacacacacacacacacgcacacacacacacgtgctggctgcccgaggtgaagacacctgtccacagtacacagagattcacggctgtctgacttcatagcccacatggttagccgctatgccacattgacttctttacaaataaagtccgtcttcttgcctgtctgtcttttacagccatgtgtggtggggagctctctgctgtggctggggtggtattgtccccaaactggcccgagccctacgtggaaggtgaagattgtatctggaagatccacgtgggagaagagaaacggatcttcttagatatccagttgtgagtgtttaaaatgggtggccctctaatttggcaaaatttgggagattgagaaagaaattgctcctgctttattctttcaaccaatattaactaagcatctactatgtgccgggactatgcagagaacaggcattcccatagtgagaccaagaacagcatcacaaatacacacacacacacacacacacacagagagagagagagaggagagagagagagagtccctatctttgggaaattcagcctaggaaacaaatatgaaatgaggacatacacaaataattgcatactctaacttcaatatgtgatgtaaggagaggttaatggtgctatgagattctttaactggaatttgatataaaaaggaaggtcagagaagtcttccccgaggatctgatactaaagctcagaactaaaagatgagttggagtgatgcatcccaaatgaacagaatgtgcaaaggccctgtggcaagcatctcattttcaaaggaccaaatggccagtgtggccagcaagaagggggcactgtaacacccatttactggactacagttgtttattttcctgtttgtctccctcaactagaccagaaggtcctctcctctggggctgggtctgactaccctctgtttccacagtctaacgcagagtctgatacacagtagatgctcaggaaatgattgctgaatgaaaaaaaatgtttttaatgaacggacttacttagctgtgcggctgggtttcctgtattcacagggggtaaccattagattctccatccagaatgttccccgctagctccccaagagggtgacacttgcagggaagcagctactctgggccagatgcaaaagtgactgctctaagcatttctatcttaggtaattctcacagagaaccccccctgggaggtcattaaccccactgtctgagaaggcagcagaggtgcagggaggccacccagaaagccagcgagcagcggggctgaaattcaggcttctgtggcttctcagtcatgctctttccactgccccatgtgagatgggggtgagaagtggacaaagacagacggtggtgcctggagaaagcagaatacagggttcctgacagacccaggtggcagacgggagggtggttgggggcggagagagtgctgaaacccagcagcctggggaagcagcactcacagttctctggctctacagaggaaccttgcaagagaaagagaaattattttcaaattattagtgaccggcttttgaggctgttccttagacacagcaagtgtccttagtctgggtgcggtggctcatgcctacaaccccaacacttcgggaggttgaggcaggaggattgcttgagaccaggagtttgagaccagtcccaacaacatagaggcatcctgtctcttcaaaaaaataaaaattagctggatgtggtggcacacgcctgtggtaccagctacttgggaggctgagatgggaggatctcttgagcctgggaaattgaggctgcagtgagccatgatcatgccactgcactccagcctgggtgacagagtaagaccttgtctcaaaaaaaaaagaagtgtccccagaggctgtcccagaacctccttctccagtggagtcagagacttacacagcttgaatagctgccccttgtggacttggggccaggccaatctaagaaagaattccacctccttcccatgtgactttgggctgggctcacctgttctcgcctctctctggacctcaatttttctctcctgtaatgggggtcttggaacatcagtgctttgtggctgctggaggcagattttacgcgttcctagcccattgcctcactcctcaataaagctcatcctcatctgggcacggtagctcacacctgtaatctcaacactttgggaggctgaggtaggagaatcacttggggccaggagttcgagaccagcctaggcaacatagtgagaccccatctttacaaacaattaaaaaaactagccaggcatggtggcacctgtagtcccagctacttgggaggctcaggtgggacaattacttgagccctggagttccaggctgcagtgagccatgattgcaccactacttcagcctgggcaacagagtaagactctgtctcaaaaaaaaataaaaattcaaattgaattaaatagacctcatcctcttccccccattcctttctctctgacttctagagtctggaataagatgcttattcattcattccaaccgaactgtttgagtgtctactatcaaccaagcacaattttatgtgctggaaaggttctaatggttgttccttcagtggtaaaattcatattggaaagaatggaatggattgtctctcttaactctagggaaaaaattattgtgtacctaccgtgtgccagcagtaggcttagcactgaagatacagttgtgagaaaaacagggcagtcctcaccctgcatgcctagcaggtgaggcaggtaagaaagtaaatgcagtgtgaaaggagcagtgacaggcaggtgagggcacctgagtgaaatcaggagggcttccaggaggaagtagcttctataatagcatgaaagagaaggtaggcaggtgacgaggggaaaagaagaatgtcctggccaggcatggtggctcaggcttgtaatcccagcactttgggaggctgaggtgggtggatcatttgaggtcaggagttcaagaccagcccagccaacatggtgaaacaccgcctctactaaaaatacaaaaattagccaggcgtggtggtgggtgcctgtaatctcagctatttgggaggctgaggcaagagaatcacctgaacccgggaggtggagattgcagtaagccaagatcatgcctctacacttaagcctgggtgacagagtgagactctgaaaaaagaaagaaagaaaagaaagagagagagagaaagaagaaggaaagaaagaaagaaagaaagagaaagaaagaagaaagaaagaaagaaagaaaaagaaagaaagaaaagaaagaaaggaagaaagaaggagggagggagggaggacaggacaggaaaggaagaagaatgtcctacctacatgatgagaacatctgcaaaacatctacaaagcctggaaatgaaagagtgtgacccacttaatgacataaagtttaatgtggctggagcaaagcatggcaggtgggtagagactacagagggaatggatcaaagggaagctctggggtcttcttagctgaagcttcacatagaaaactttattctaaggctgcatcctttaggaagccttctgtgtcgcccccttgtccttgtccataaaaataaatttatggttccagcttatgaattccttcccccagaagttaccaggaaaactacctgtcttcagccaagagaaggtacgacctactcctgagttcttggcttctctggcagaagatcccacccagccccaggccccatgaagtcatctataatcccctctcttctgcttggcttgcctcttctggcctcacagggagcctcccagatgggtggttttgcttaaataagacgggcccacatctccctttggtgccagaggtctagaggaggaaacaagaaaatgggaatctttactttcatcatctctaggcatcaaatattcaattaaccttcagcctgacaccagattgggttttatttctaccactaagcatgcatgcaatggagcagccgatccgggaacctcatgcaattaaagcttccccaaagccaagccactggcattagcatcaggaagggagcccttgcagcgggggcaggctttctctcttctgaacattttcacaatcgtagattgagcattgaccaggagagagggccctcagtttccttcctccctgccctgatactccatgccctcagcagccctggacccagcacctagcatctctgggcctcagattcctcctctgcaagatgatgggctaccttgaatcaagggtagttgcaaatccaaaatcatgaagggccaggcaacacaaataccggaattagagctgttgtgagattatatggaggggaggggtctgcgatgaattaggaagtacataccctatctaaaatcatttaaattcaatttccattttattttattttattttattttattttattttttgtgatagagtctcactgtcacccaggctggagtgcagtggtgccatctcagctcactgcaacctccgattcctgggttcaagcgattctcctgcctcagcctcatgagtagttgggattgcaggcgtgtgccaccacacccagctaatttttgtatttttaatagagatggggtttcaccatgttggccaggctagtctcaaactcttgacctcaagtgatctgcctgcctcagcctcccaaagtggtgggattacaggtgtgagccactgccccgggccataatttcaatttttaaaaatagcatcccctcctccaaaaaaaaaaaagtgcctactggctgaatccaaactgaggaccaccagtttgcaacccttgcaaatgattaaggtgattgagggtttaagctcccttctcattgcagcaatgaagaaattcatgtttttaagcacttactatttgtaaggtctttactaacattaatttttacttcatataagttaaaaataaattgtattatttgttctttggattaatcccatgaagtagttgcaactattacatttaattatatcctcttgcttcctcaccacttcacttggatgtctaagaggcatctcaaatgaaatgtattcaaagacaaactcctgattctccctccctatatctacttatagggagatatttatttatctatttatctattatacttattttacccccatctttctcatatgtgtaaggtatgatctattccatcagttgcttgggggaaagaatcaaacaacgacaaaacagaaaccttggcgttattctggcccagtggagtgctggctttcttaacaagttggcggcacagtgggccacaccctgatttgtagcatctgtcaatttccacggtgtaaatactcccaccatgacccattttaatataccaacataatgacaacaggctctccaaatgcctggaccattagctcttacaagcccgtatgagcctgcccccagcccagcacactcactgtgaactggacctttctctttctcccacaccctgtagccaaatcctcaggaaattccattgcttctactcaaaagtcaaagtcttcccagagtccaagcagttctgacacctccactgccacctgcagggtccacgccaccactgcgtcttcccagggttattgcaacggcctttgagatatccttgttcccacttctgccccctctttttaaccaacactcagtgatcctgttacaaccgaagtcatagcacccatgctctgctcaaagttctgcaatagctccctgttttatttggacttaaagccagtattcttacaaaaggccctatgggatctagctctggttacatctccagcatcgctttattcctctcttctcctttctgtatggtacatttgaccatattagccttcttgccattccacacgcatacctcagggcctttgcactgctgtctcccctgccattgggatgctctgccccaaatatctgcagagcttgctccccatctctccatcctctgactttgcttcacttccatagcccttgccaccacctaacacactacgcattgtggtgtatcttgaagtatttcaactcccacacctccacctggaatgtcacctccaggagaagagcaggagtttattttttgtcttattcactgccgtaaccctaatatatagaccagtgcatggcccatagtaggtgcttaataaataaaaggcaaggaagtaaatgtagcttgtcaggatcatacagacatgaggcttcaaagcgagaatttgaacccaaatttatgttcagctggctatgatgcacgtggagggaaaaaagagggtcagaaaaatatggaaagaccttctggggacatggcctccattttttagtaagtacaggtttattacatgacagggaacctggttgataagaaataacatttggctaaaaattatcaggtaaagtattaaataatagaagtaggaggtctccccaagagaatattttatagggttatagtttcaaaggatgtgtcatcatggaccttagaatcagaatatctagcgggagggggacttcaaggtcccccaatccagtgatgctgagatatgctggcagagttcagggccaagtgccgtggggcttggggagcctgtatcattctcccgggtgttctgagcactggacactaagccaagcagaaagtgatgacggaaccacagacaggctcagaatggggccaataagggggggcatcgccctccccaaggcagctgtcacgacttgcgttaggacaagcagccagtgtcatcccggggccttaggatttgcagtgacatcaaaatcaattcagtcccagttttaatcatcatggacatgtgaggactgtcatttttgtcactgagcaagtttaaatcgattccacatatatttattgagcatccactatgtagcaggcattgaggctgggccctggcagtgagcaagacagatgcagccccgcccccggggagccatgttgtaggctgatacagcaccagcaagaggaaatacagcactctgggggcccagagcgagggaaggtgagcctggctgagaatgtgagggagaagctttcctgagaacagtaaagtctaagtcagtttttctcaaccagggtctatcttgccccaggggacacttgccaatgtttggaggcatttctagttgggacaatgggagggtgcgggggagagcacccccagcatctagtggggacaggccagggatgctgctatgcatcctacaatgcacaggacagtccccaccacaaagaatgagctgacccaaaatatcaacggtgttgaagcagagaaaccctgatctatgctaagacctgaaagacagagagaagatgggcagagatggaggggaacagtgttccagccaaaaggaacagcatgtgctaaggtccagaggcaggaaagcacagctcccttcttaattgtccatgatatttaatatttgctgagcacttaggacatcccaagcagttacatcctagacatcttcacgacaagcacatgccttgggttctgttattatctccattttccagatgagtaaactgaggctcggggtggtgggagagtgcctgtgatcgcacagctagaagctggcggagcttggactttaaccccacttgccatgtctccaggaccctgtgtgtctggagttcaagggtgcgtccatgaagtaggacagcctggcggtgaatgcgactcagcagcgccttgaaggccacattagggagtctgggcttccccaaattgggcagcaggaaaagggtttaagcacttaaagagattaaagctttgcagaagggagctgagtcctctggtcaccagcccgaggctcacgccgacaagcttggcacacacttggcagagtggcatctggacttggcacctcctccctcccacagagggagtgaaaatagcatctcaacagccagggttacgtgaggcccaagagctgctgggtttaatttatcttgcttggttttccactgacagttttagtaaaccaatttgggtttgatagtaaaaataattccatcctccgggcccctcagccctcctaagtgtttgcaattgttatttttcacatcgacgatggggagggagtgtgcactgcagaccgagctgggtaggtggcccatagtaggcgcatgacttagctgtctgctgagtcatgaatgaggacgtaagccacatttcccaggcgagaggggatctctctccctcttcgtctactgggcagtctgttgataccgtggccatggcggttctaattagttaccatttattaaaaacctactatgtgctaggcaggccctgagctgcatcgtttaggtccgtgagcaataataaatgtgaacattattatgcagagataataattacataaatgagagctaatgtgggtagagataattacagaagggtaattacccaaattagagataatgtatgccaagcacattgcatggtatctggcacatagttggtgcttcataaatggagactactattatcaggaatcctcagataaggcagatattatcattaccactttatgggttgggtatgacagcacagagaggttacgtggtttcctcaggtcacacagctagtaaagacggagcacacaccgtagcctccacttccactgacttgaacagctttcggggcaccagctgtgtgtctcggcaatgtagcagcgacacgggaaggctcccaggcctgtagggactcaaagttcaggaagggacacatagccataaacagacagcctggcaaaatgtaagcaaagtcctgtggcttggagggtgagttgaggaggtagaggggaactagatttatctccgtgaattatggaaatatccctgagaaggtgacatccagaaggaatcttgaagagtgccagttgcccggagttaatgggagaaaagtgtcgtgagcaaaggattcaagcagtgatgacagtgaccattaggcatgaaatgaatgctctgaatcacagcatcaattacaaccatctgccccacattgttggtgttggaggaaagaaggaggttgcaccaacttgggatgagtcaggagccctcaggctaaaccttcttcacaccccaaatgcctccctaacccaccacgtatccctcccagctccatcagaaatctgcctcttcctctaaaaacacaactgaacagaaacttttaaaccctaagggccttttcatattgctctcctctcactctctctcattcattctctctccacaccccttccccaactctcaaaataaattacggaaaggagaataagggaactaacattggtgaaggcatcgtagaatagaagatccgagaggggccccaagtgggcaggtaacttagcaagtatcacacagcaagagaggaccagaaagacaacttgcttgtggccacaagagctcagcacgggggccacaaccttgaagatgccttgcagccaaggagacataaaagcgcctagagtcaaaaagaggtgcatgtaagtgcatcctgatgttcaccagctctgtggcctcaggcagattattgaaggtgctggtgcctgcacccacaatgggatattttgttcactttatccccagtgtctggcacaaagaaagtgcttgataaatatctgttgaatgaaagagacggtaaggctgggcacagtggctcatgcgtgtaatcccagcacttttggaagccaagatgggaggatcgcttgagcccaggagttcaagaccagcctgggcaacaaagcaagaccccgtctctacaaataatttaaaaattagccaggcatggtggcttgcagctgtggtcccagctacttgagaggctgaggtgggagaatcacctgagctcaggtgttgagaccagcttgggcaacatagtgagaccctgtttctaaaaagagagagacagagaaggtgggtgtgtaaattaattaaataatgtaaaaattaaaataacagataacataaggtttctgacacaagataggcagataaccatagctaacactacttttacccctactatatcccagactttatgctaaatactggcacacattatctcattgatgatgatgatgatgatgatgataaagaccaacagctgacattcattgagtacttacaatgtgccagtctttacatgctttttttacctatagtaactcatttcactctccaatgcaatatcagtaccctatgcaatatctacatcacgtcagtgtgactactcctttgtacagatgaagaaactgaggctgagagagatgaaactgcttgcccaaggtcacacaattaggatgtggccaagtcaggacttgaacccaggtctctaagaccaaagccagtttttaaccacacacacacacacacacacacacacacacacacacaaacacacacacacacacaaacggtagggaagtgctccacatgagagaaattccgagctccatcttacagaagaagaaactgaggctcaaagtgtttcctgctccccgtttcctggacatctactgcgaacatacatccatctctgcagggaaaaagtctcaatcaggctccagcgtgccttcctttgctcctctgcagagttcccaacattgctccctgtttatgagccccagcacagttctctaaccaggaaataaaagggcctaataacaaacccaggtaaccatatgattgatagctgcagaacagtcctcttcagctgctgccaacctgttctgtgctaagttaattccaagccctaaaaattaagtgccttgtccagaggcacttcagttcttcaaacagagatatagctgctttggactgtaagaattctacctgagagccaggaaaggaggagagagattcaggagttgaggacaacgttagccctgggagaatagatttccagatatcagcaaaaatcacaggagaaatggccacgacaaaaataaaactggctgaactcagatcttctggcccattagcaagaggagacaggatttccctggagccaaaagttcgaaggaattagagaaggagcagaaaatttcatagagcccaaattccattatgttgcaaatgaggaaactgaggcccagagatgggaagagattgccccaagaccactctatcagtcagctattgctgtataacaaaccaccccaaattcactggcataaaacagcaggcatgtatttctgttcacgagtctagagatcagcgttgtgcttctggtcttagctgggctcgcaggtgggtctatgggcagccactggccttcttcatgtatttggggatgggttggctgtcgtggtctaggtgggcatagactgggattgacatagacacgcatctctgctccatgtgcctctcatcctccaattgctagcttgggcttgttcccatggtgattggccagagtttcaagaaaggaagaagatgcattcaaggcctcttgagcccacactaggaagtggcacagccgcacgtctgccatatcctatggcaagctacaaagcaagggccaacccagaggtatggtgtggatacagagaggggccaagctttgggatcatttttgccctcaagctaccatgaccatagaagagtggagattagaactcaggtctcctggtcccagcccaaagctccaaatgatattactgtgtacaatgatcctatgagatctgagcatcattatccccattttacagacgaggaaaccgaggctcagagagctgaaggaacttgtgtaaaatctcacagctaggaagaataagagacaagatttgcacctagggcttggtgcctggcatatagaagactcagaaaatgtttctttccctacatgatgctttcagcatgtgggagacactctggaaagatcttgaattccttcagggacaggaaaaagccttcacctacagtaagaagtcttgggttctagtctcaattctttcactgagtggctgtgtgaccttggataaagtcaccccacttctctggacctcggtttctttcatctttcaaatgaaaataacaatggtacccatctcttcgagttctgagatgatgaaatcataccatgtgcagaagcacttggcaagggcttagtacattacacacactcaacaatttaattggcagctgtgatgacgattaatcccttccatggcccatggtcctgtgtacaaactgagctcctttgcacgatcacacacaccacacacacacacacacacacacacacattgatccctctgagcttgcagtttgagtgttacagtaggaatgaagagaatccatacacaggtcctacccaggtatcccacctgactgattagcttcctctcccccacgatttgcaggggattgtggtggtaacttggaaacacaagcaccagggttaggtcctccaccaacacatgcccatgttctgctccttggccacgccacgctcttctcgccttggtgactgcaagagcctacttgggaggggacctgctgtctgtctgagctggacattgccttgtcggtgcacccctacaagctcaaggcattcgaatgcaattagacctgacatcttagggagacacgactgcttgttttacgagtccctgacatgcgctgtcctcctgaacttactattcgacaagtgtttattgagcgcataccatgtggctagagttgcatccaattatcagaggtctggagatgacaatcatcactcacatggattactgtggtgccaaaatactcacgtgcccttacctttgtgccaagctctgttctgagcacgttacctcttagttaattctcaaagcaacctaggagagtcacacgatttgttctccatgtaatagatgaggacagtgatcctcctccgaggggtgaaatggcttgccacttagacccaggagtgccagcctcacacccctcatcacccctcaaccctgcttcacagagtagaatcgacttcatcctgaaggcagccagcctcccttgagagctgagcaggcaagcagtgtagtcagacctgctgtttagacagcacccctgggaggaaggcagaggtgggccgaggtggcaggaagccaggcaggaggcagaggggcagcagcattggcttggcatggtcctgtgatggccgaggcctggggaagcccctgcaaacccctctggggccttccggggagaagctgggacaagccctccaggtttcaaagttcgtttttcttggaggagttcccacgccaggcggggacggcccctgtgtggagtttcctgggggtgttctggccgctcggattggccacgccagggctttcgccaggggaggccttcgagaatatgtgcacgatgcggacgcagaatggcaggaagcggcgaccccagccactgccagcttctgctgggagaagctctgtcaactcttcctccagcaatgcagagccccggcccaccgccctctgcacacgtgcgtgtctgtgtgtgtgtggcagtatataccacacaccacacacacaccacacacgctatacacaccacacaccctcacacacaccacacacacacaccaccccacacataccacacacacatgacactacacacaccacacacacccccacacacacaccacacacatgccacacatgccacaccacatgacactacacacaccatacacacaccacatacacaccacacacacacacgcacaaaccacacatatgacactacacacaccacacaccatacacacacacccctcacacacaccacatgacactacacacaccacacacgccacacaccccacgacactacacacacacaccacacaccatacacacaccccacacacacaccacatgacacgacacatgccacacatgccacacacaccacatgacactaaacacacaccacacgcaccacatgacacaccacgcccacaccacatgacactacacacaccacacacacccacacacaccacacgcacatgcgccacacactacacaaacacacatactgccacatacacatccgacctcaccagctgatcaagcttccctcaaggtgagctctcgcaccctgacttagatgtcccggaatgtagaaggccctgggttccactccgtgttttataaacctggggaagcttacatccagaaaaaggaagcaatgtgggcagtgccacagaggaaattcatggaagggccacagatgccatctggggtcacccctaagtctggaaaactcaggcctcagcagcctatttctaaagccttgtattccccagatcaaccccttccttgctattgagtggggaaatggggaaagtgtgtgggtccaaccttctccacagagggaagcatgcagtggcttggtcatggccattgttaatggacttttttacaatttgtggattctgcgatttgcatctggggaaactgagacccgggttgggaagcctcttgtccagtcacaggtcagaaaggtggcagcataagtgccctttactgaggtctcgtcacaccaggatttgttgccacgccgcccttgcccctcagcagggtgcctagttccttataaatagtttttgtaatagaggaaaaatgctcttgtagtggaattcctggcattaattgttatttacagctgtcaacaatattatccccattttacaggtgggaacactgaggctcagagaggctaatctgcttcaaggtcctgcagctagaatttgaacctgttctcttaatgctgcctcttgtgctggaggtgaaacaccagggtagttaaggacagccgtctttgtaggcaaagcagccggggagctgttgggttttcctggtcatggtgctaggtgtaaaacgttatcggtgaccttgccagagcctcgcccactgccttcggaaatggctcagtccagagatgtggaaatgagaaactgcttgagctgcccgtggggcaggcccagggggacggcaggccgagagcaggaatctctttcctactctttttctctttgggaataagagggaaattgagaaaagggagaaaggaggaggagatggagaaaaggaagaaaagaagaaaggccatggaaactgggagcctctctgaagtcagggctgggtctcattcaggctgcaaactccaggtctgtggctctcagtcctggctgcccaggagaaccccctgggaatgggagttttaagtgacactaattcccagtctccacccccagggtttctgatggcctgatttgtctggagtacaacctgggatcaggagtttttaaacctccgcggggattctgaggtgcggccaggattgagaaccacggggcagtgggttcacagcctggagtggacaagcgttttggtgaatatttttggagagaaacagagaggaagagagggtggaaggaaaggaagagagaaggaacaaagaagagactaaggaaacaggctgggcacggtggctcaaacctgtaatcccagcactctgggaggccaaggcaggtggatcatctgaggtcaagagttcaagaccaacctggtcaacatggtgaaacccggtctctactaaaactgcaaaaattagctgggcttggtggtgggtgcctgtagttccagctactctggaggctaaggcaggagaatagcttgaacccaggaggcggaggttgcagtgagccaagatcatgccattgcactccagcctggatgacagagtgaaacaccatctttaaaaaaaaagaaaaagaaaactcatcatttttgtgtgttttaaggtgtcctattagggagccaaagatactggttttctgtgtcctccctggagctgacatggtttcttggcctgtctgccattttatcaaattaaattgaaagcaaatttaattgggtttcactgggccaaaggcccctcgacaattctgtgttgctgagaggtgcctggcaaggttgtgctgcatctgaaatgagcacagaggccttaggacctgggtctttggggctcagtttactcctctatgggattcataatgttttttctctgaccacctgactgtgtgggtgaggggatcagatgagaaaatagatacaaaacaactttaaacatgtcccttctaaggccttcaaaaaaaactataaatattttatcaaagttttattgcatacaacggaatttacaggttttgattcttgtttttcctttctttagatcctatgatttatttcatcactatctctactgttccataaagatcttgcctgaagggcaagatagtgttttcttaggaaagtcacttaattcctctgagcctcagtttcctcatctggaaaatggacataaatttgccgtcattccttcatttaagtgaactttatttcacctgtgccaagccctgggtgggctccagggattggggtgaagacatgtgccttcagggagccgacacaggcagatgaaggttgctggtctgttgctcaggctttgtcttccaacgacgtctgtttggattccggctctgctatataaccagctgcttgagcttaagcgtgtttcctcacctctgggcacctcagttggcttatctgtgaaatgggtgtgaagagtcgtacttacagggttagtccgaggataagatgaaatggtgcatgtaaagtgccttgaaaagccacttgaaaaccttagctagttattacatagctgtaaatgcagggtggacagagggatcctgaggaattagcaaggtgttttctagcagagaagagaggagagggctttccaggtagagagactagcatgagctaaggcatgaaagatggaggctttaagggtctaggagctgcaaggggcttggtgtactggatgtttgagacagcaagagatgggctgagacccagctgtggacttcctgggaggtcaggctgagaaactggactttagtctgtgggctaatttttgcggtttccacagtccaattctattaccagctacttctttttgtgttaccgtttttgttttcccgaaactgcgtgtaaattggcttgcctttttcacttggcttactccagccaaaataatgtccatgaaattagaagtttaatgtgcaaaccatatatttatatatttttctaatttgcatttaaagaaatgcataaacattagacatttcaaagtatgtttgcctacctaaaattgtcctgtgaatgaggctcgaaaaagccttttaaaggcaagatttctaagccaagggtcaaatgtttgtttagaaaggaataaggaaaagaaaggtggcttgctcatcatgtctttctatgccctctccggaatattgactctagctcaatagttaccaacctcacctaccacctgctccccacatccaggctcctgattggttggggtaaaaagggcacctgctggggaagtcagcccattccatgcttaggcatacactgccctctgcaggtgagcagcaggattacataaccagagatgggttcgctggtctgtgtcagattctaatttgcattctatcctcacctcttccactctctagaccccagtgaaagcaatgagggtcccttaggctgtttttatcctttttgaagaggtactacattcatacgattcaaaattcaaaagtacaaaaaggtctactgtgaaaattgagtttcccatccttccccagcaaacagccccctctctggctctcctccctagaggcaattactttcttatgtatcttacatatccttccccagatctttctaaatatttcaaaaaccataacagaaagcttttatctatcaaaattaagccacccagactaagtaactagattaacactgattttattgcaaactctgttatacctgatcgataataaccatgaacaaaacacaaagaacattcgttaccaagaaatgtaaaatgttagggagacaaaatctttttaaaacaagaagtctgggccaggcgtggtggctcaagcctgtatcccagaactttgggaggccaaggcaggtggatcacctgaggtcaggagtttgagaacagcccagccaacatggtgaaatgctgtctccactaaaaacacaaaaattagccaggcatggtggcacgtgcctgtaatcccagttacttgggaggctgaggcaggagaatggcttaaacccggggagggtggaggttgcaacgagctgagatcgtgccactgcactccagcccgggcaacagagcaagactgtgtctcaaaaaagaatttaatttaatttttaaaaaacgatgtctgtaatacaaaaatcacagctatataggaggaatagcttctagtgttctataacactgtagggtgacgatagttaacaataatttgttgttcattttcaaacagctggaagagaggattttcaatgttttttttttttttttttttgagacagggtctcgctctgttgcccaggctggagtgcagtggcgcgatctcggctcactgcaacctccttctctcaggttcaagcaattctcctacctcagcctcccgagtagctgggactacaagtgcatgccaccatgcccagcttatttttgtactttttgtagagatgggatttcaccatattggccaagctggtcttgaactcctgacctcaggttattcactcacctcggcctcccaaagtgctgggattaaaggtgtgagccactgcacccagtccagattttttttttttagacagcatctcactgtgtcacccatgctggagtacagtggtgcaatcaaagcttactgcagcctcaacctccagtgctcaagtgatcttcccacctcagcctcctgagtagctgggaccacaggcatgtgccaccgtgcccggctaatgtttttattttttatagagatgggggtttcactatattgcccaggcaggtcttgaactcctgaactcaagtgatcctccagccttggcctcccaaaatgctgggattacaagcatgaaccatcatgcccagctgttctgaatatttaatttgtgtttttttattcatgttttctgacacaagactcaatcggaacacacttcttgaaaacgtgtgtatgtggctttcatgggctgttgtataaaatggtggttcagatctcaagctttggcatcaaaagacgtaggtttgaatcttgaccttcctggttgagcctcagtttccttatctgtataatggagcaagtcttactttgtgaggttgtttgaatgcttgatacttggcggacagcactgttgttattcaaaagctaaatgtgggtcctgtgaaatgctttcccattcaaaagctatccaatgggaccagtgtttccactgccctgagaaagggaggatttaaagaagcagccagaagtggtaacactaaatggcatgtccacaaatggctgctcaggcccttgaaggggctgcagaatgtgcccagagcagggtcaaggtggggaaggagaggaggctagacaagctggacaagccagcgggttggctttggagtggcctctcaggcatgcagggtgtcaggtggcattggacttgactctagtgacctacatatccaagaaggatcaaggcatggccaacaagaagccctagaggcaggcggggcagaaatcccttgaggcagcctccctctgataccaaagttttcaacttaaccctggggagcatgctgaaagcagccagggcactggctgagaggagtccccttcccaaggttggagcagggaagagtccagtcggggttagggtcctaggtaggaattggggtcaaagccacagtctactctgtgcaagatctgagcccgaaacctggccctatgccctgagctggcactgattcacccgagacacacactcagcatggtgctgagcactagggatacagccagcagtgagtgagacatgggagggcctcagggagctcctgatctgcagcagatgagcatccccagaccaatggggccccaagtaatgactgagctccataaggagggtgagcacaagggctgcaggccagaccaggaggggatgctgggggctctgtgcaatagtgaatcatggaaggctgaaactaaggggtgggtaggagtttcccaggtggagaattcagagcacagggaagggaatgtgaaaagtcccagaggtcaccaagagcatcgtgctttggaaagactgatgagcaatgcagtctggttggaggtaaaacaatggcttggaagagagagagtcagaaatgaggcggcagggacggggcaggcggcaatgcaaaagatagacctatagagccttgagactagggttaaaagttggcactctatcctaagatgtttcttttttttaattgaggtgaaattcatacaacatacaattagtcattttaacatatacaatatatatatctacatatgtgatacatttacaatattgtgcaaccaacacttgtatctagtgccaaaacatttccatcaccccaaaaacaaattccataccgattaagcaattgttccgcattcttctcctcaccccctaacccttgataaccacccatctgccttctttctctgtggatttccctattctggatattccttataaatggagtgattcaacaggtggcttttcgtggctggcttctttcactgcatgtcatgtttccgaggttcacctgtgctgcggcgtgggccagtgctgcattcctttttatggctgaataataactccgctgcacaaatagaccgtattttgcttattcattgatctgttgagggagcagatctgatttaccttctggaaagattcatctggctgctaaggggaggagtatcagggccaggtgaggatgaagtcaggaaaccaccgaggtgctgtccaactgcccaagagaaaggtgatgatggtctgaggatagcctgcgacagtgaccaagaagaaagaggtggatgtagagggggagatgggagctgagatcttctgccaggagctcacactttgtgcctgtggaaagcctttcactctggcacctgagaagggccagagtgggcagggtctggtcttgggaagctttgtggtcctacaggatcctcccagaagggatcctgccactcccagtcacagtcagaccaagcctgcctgcctgccagcatctctccatctccccttcatcctggagtcaaactgccatcccgttttcctagcgcctccttggatcgtatctagctgacatctcaattcagacctcagcggaaaaccacactctgccctgtggctctccctgcagtgaactcaacacattttcatctcggttgcttacaaaggtccgattccagggatgctagatgcacttggtaaatacatggatgagcaagtgaaaatgtaagctcctctttgcattgaggggaaaaaactaaattgccaaactctgtgtacataattggaaccagtctgtcaaaaaagattcagaagaatgaggcagagagtaacttgattatttctcccagtgacccttcaggcacatcctatattatttttttcctctgggtgaaagctgcgttttcataggtcttctggtcacaataagtgcagtccagtctgaaaatcttataaccctaagtatcattcattttgaaacttcatccctccctcaactgtgctcctctggctgggaattttgcaaagggcatgggaggtaagggaataggagactctaacttggctacactgttatgttatagaatatatagaatgctgattttttttctgtctttaataggatattaaatgtgtgaaagtctcctgagcacagctgctcttaactttcccttttgctggggttctatcaccctttcagtaggaagccacttttaaggagacctatagttggcttctgcctgcaaggttcacaactagacccaggaaacatagatcatatccctactgtcatcagtgatgggatgctcactgtcaatatctgcttttattctccttgctctgaccagaggcaggcaggcatccccagtctgattttatcatttcttttggtgagcatcaaatccagctactgttatccaagccacaaaagaaagacacctgccaagtcaccaagagttcccttgaagccctcctcactaggcttaatgtgagggtgatacacattcgaccctccctcctatgatgccccacagtgaccactcccctcaaggcagtccttcctgccagcctcctcaatggccagtgccttcttttccttctcttatataagctagaggtgggaagaagggctcagactggaatagctgcatcgatgttagtagatgatgccattggtactctgtctaagccgtgcaatacttgccaccatgtgcccataatgacttcctactgcaaggcccttcccacttctccagcatttctctgatgccatgtggtcacatgggcaagccagaagttctagggactcaacacatccaggagcatccctcagtcaataaaggatggaaactggaggataaataccccagctccttctccctatggatgtgttctgcaccatctctaaaattcctgcaggactgaacccaaaatgcacagtgaaacctgctcatcaatcccctcttcgttgagtccttcccttcttcttgtctcatttccccaccagtgctgcctaggatggcctcccagacaagccagacttcaaaaggcatttgtatgtttgcttgatctctgcatctggagaatccaaatgcaatcaacagccaagtatctctctttggaaagtggaaatccactgcacctattgtcttgttcttagcttagggagacactgctaaaatttcagaacaacagaagaaattgcatttaatggtctgttgcacaccgtttacaatgtgcatttatataagtcatggtttctcgagtttagccctgttgacattttggactagatacttttttgggttgaggggctgtcttgtgcactgtagtatgtttaacagcatccctggcctccactcacccatggtacccacctagttaggaaaaatatgtttccagacattgccaaatgtcacctgtgaggaaaactgcccctagttgaaaaccactgacataaatcatctgatgtcatttggcataaacagaaatccaaagaaggatgatggtggtgatgatgatgatgacgatagtgatgatggtgatggtaacgatgatgatgccaaaaatgaaagtggaatataacaacataacattcaaatgacatcaccgagcttgcccaggtgctaatgctgaagctggaatttgaatccagaccttctgcctgcctcacctcatccccagagctcatgacatagacgaggaatattaaggctgattcacagacaagaaatttcagaaaaatcacatgccttccatgaaagtgacaaagctgagaatcaaaccaaagctttctgatttccaagccagtgtgctcttccctgcacattgctccatcctattttatggagaacaaagagttgccgtatggttttaaaatgaaagctattttcacccttgaagatgctgctactgcgttttggccatttaagtgaaagaataaagccaagatgtgcattgtctgtaaactactgttaccagcggatcagctgtgaagtcggcttaaggaatatatctgccatctaccatgtttcacactagtctaatccggcactttcatgaacaattgatgttttcatggtacgtagagctaaagaggccctcccctactacaggtccaaagctgacatcagtcccactatttttgctgtcaagtagactctctgggaggctctttcataccttagcatttattgagcacctactgtgtgcaagaacaagtggcaactccagaatttcaatacagcaggggtttaggggcttcaatctggttaaaaactgtcaggggggtaggaggagtctggggattttgtcttgaagacatgtgtgcaaagcaagcaggtagcttttatttgaagatgttttgggagtagcataggggaaactggtgaaaattatggcggcaatcaaaatcttcctaagccaccccttggagcaactttacatgaggaactacgagaggtatggtggaaggtattggggtgaataaaatacaatccctgccctcccagaagcaaactttcaatacctttctttgtgtttctgttgttttgttctgaccacctgaaacaccaacatgggtagttgccacctcacctcccaactcccggactagcagcaaacaccactgttggccattggatgaagctatcagcagggagggccactgtcagtctgcatcagtttcaggaactctgctcagggccatttcccagaacacctctcctctggcattgaattgctcagtcatacagttcccgtataaaacccttcagtgtctccccgtctcctgcaagatgatgtccaaaagttgaagcttggctctttaagcccttcatgatctaatccctgcagaactctgcaggcttctatgcctatccccataccccaggcacactgaccactggaaaaattctttcaggaaccatggtcttactcctttcttccctctgccttctccccatcattcattgttttcttttgttttgttttgttttgtgagatgagttcttgctctattgcccaggctggagtacagtggcacaatcatagctcactgtagcctcaaacttctgggctcaagcaatcctcctgcctcagcctcctgagaagctaggactacagaggtgcaccaccacaccaaaaaaaaaaaattttttttgagacagggtctcgcttctttgcccaggctggagtgcagtggcacaatctcagctcacttcaacctccacctcccaggttcaagcaattctcctgcctcagcctcccgagtagctggaactacaggcatctgccaccacgcccagctaatttctttttttagtagagacggggtttcaccatgttggccagaatggtttcgatttcttgacctcgtgatcctcctgcctcggcctcccaaagtgctgggattataggcgtgagccaccacgcccggactttttttttttctttttttttttttttttgtagagacagggtctctctttgttgcccagaatggtcttgaactcctggcctcaagcaatcctcccacctcagcctccaaaagtgctgggattacaggtgtaagccactgcacctggactccctactctgtgtttatctgcctcgaggtctcctactctttcttgaggtttcagagcaagaagcatcacctactgcaggaatgcttccatgatgcccctaatctgagtttgtccttactttctctgtccttactttggttataactcctgccacaatccctggcttacaaatctaaatagatcactactctgtgacccttctgagctcagcacagtgcctggctcatagtagatgctcaaaaaaacaaacaaaaaagaacattaaggagaaggagacaagaaaaggagaaagacatgagagagaaagaagacagagagagggaaagaagaaaggaaagaaagaaatgtgagtttgtatctgtccatgattgatgaagccaaaggtgaattatctggcattctttcaattagagatcaattttatctagcatgtctgagatggcacatgtttctgtggtatagtgaagtgatttctggattattaactatccactgtggtttaattatttagtgtcaaggtactttcttgcattggagtctttgaaaatgtgtcatcctttaacagtatgaatggtgacaggtttgagcatatctcataagtaaggtgcctccatcccacctctgccctaccccttaaacataatggatcattcagttgactctgaggaatttgccccgtgataaatggaaagatcatttcaccttatataaaaatgcaagttgtaattagcaagctgtcagcatgttctgcactgaagaagaatgaaagatgcaggtcatagccccagcctgtagcctggtgcctaacacagagatgtcacctaagaaatggttgccaataatgggagttttgaaggtgattcttcttacaatgcagcatttgactttgcaatgagtcccatgcagccaagaccattgcatcaatgtgtcttcaaaaacccaactgacggccgggcacagtgactcacgcctgtaatcctagcacattgggaggccgaggtgggcagattgcctgagctcaggatttggagaccagcctgggcaacacggtgaaaccccatctctactaaatacaaaaaaaattagccagacatagcagcatgcacctgtagtcccagctactcgggaggctgagacaggagaattgcttgaacctggaaggcagagattgcagcgagctgagagtgccactgcactctagcctgggtgacagagtgagactctgtctcaaaaaaaaaatgacttacaaatctttgtgtcacatttgcagtctatgtcaatcttaccctcagcttggggttaagacacatagcctggagcctgacacatacacacttaacaaattttgtattgcctgaaaaagttaatcaagggtttattgaatgcccattctctatttcacatgactctccctcttctctgccctccaagcctgaatctgagcaacagtgacatcttgaccatctacgatggcgacgaggtcatgccccacatcttggggcagtaccttgggaacagtggcccccagaaactgtactcctccacgccagacttaaccatccagttccattcggaccctgctggcctcatctttggaaagggccagggatttatcatgaactacataggtaggtgtctcatctggtcaatttattttttctttgtgtttagatacaggttaaggtggtttcctctaggttatttggcagttttgtactacagcgatttttcattgtattgtattgaaatgtactcatttcatttttaaaagcctgggctctctagtcatgaggaccagggtttgagccctagcacggtcatcgatgtctgtgtggctttgggaaagttactgaacctctctgagccttctttttgtcatctgtaagatgggcatagtgatacctattccacaaggttgatatcaggatgtagtagacaatgcctcataacttatgtttcatgtgtggtcagctgagaacctgttgtccccatgtttcatttgtggtcagctgagatcttacatcaacatacttcctaatttcttcccaatttgtgcaacttctcaaacatcgtcttcaccttcttgcccgaactgaagctcagctctcctctaaggcctcttcttttcctgtagcctcgttgaacaaggacagccttcctttcgcacttcttgtactttaggagctatagatgcaaaagatgtctttcctcatcctcaatgtggcctccaaaccatgtctctcctgctcctcctaaaacaaacaaaacaaaaaaaaaacctgctatcaaattcaagctaagctcacacactcctatgacccctcgtgtgctttcatccaatcacactcttcccttctcattccccaccctgtaactctccctcattcattactagctctacgacccaccccttttcaacctttaaaccctggagggtcccaggctccatcctggactgtatcctctcttccagctagactcacgccctccatgccttcattagttcccatggatttaaacagtaccaatatccgttgaccggttcatacttacaaccttgaccttaaactccaaatccatctatccaactccctgccaactcctcccttgcctccatccagtagacatctcagatttaacatggccaaacagaatgatttcttttcctacccaccaccaccactacccaacagcatcccctgctatctgccaatcctaggaaatgagacaacaactctcctggtttctcaggctgcttcctccttccttgcccccatatccaatccatcctctcaactccacttttcaatatgtctcaaatccaaacacatgtccccgtctttctacggccaccactctagtccgaactaccaacattcccagatgtcagaggactgggacaccatgaagtcccactgattccagtcccagaagagacttgcactaacagaggaactggtccagccctgtcgtgttccagcagaagaaaccctggacaagcaaggatgaagggttgctcatcggggcagagccgagctccaatccatgcttcctcatccctagctccaaagcttcctccacccccaatattttgggcagcagcggagaacctgggagacacagagggtaattaagacctaacatcctttgacatctagaagaatgggtgagtggttgcaccccaagaatttcaatgggcaggattcggccagtgattaggaaacgtgcttgcacttcccaggaattagactggcatcttgatttccaggatggagcagagaaaaggagaattcatcctacccagccctctgccaccaccactaccacaaaagaccctgtggttggagcaagattccatgtctttggttctttctccccgttcacttaaagaattgtccatctcggccgggcgcagtggctcatgcctgtaatcctagcactttgggaggctgaggcgggcagattacgaggtcaggagatcgagaccatcctggctaacacagtgaaaccccgtctctactaaaaatacaaaaaaaaaaacattagctgggtgtggtggcaggcacctgtagtcccagctactcgggaggctgaggcaggagaattgcttgagcccaggaagcagaggttgcagtgagccaagattgcgccactgactccagcctgggtgatagagcgagactccgtctcaaagaaaaaagaaaaaagaaaagaattgtccatctctaactaggttggtgcagaagtaattatgatttttggagttttaatttgcaaaaactgcaattacttctgcgccaacctaataatatgaattgtcctctctgtaccagcacttgcacctaaaaacaagctacccccttgaccatgggctgtttcaagaagcctcatgcgtgccaaagtacattcctggcatttttatttccagatggtgaacatttttcatccctgcctgctacatgtccacctctcagagaggctaacacgagtattgatcttcttttttatgtttcccaggggccttttacctttgattgtgctgctaaatattttcagagtgttattgctacaatttcttgtgggttccccgctcttttctgggcagtgccctgggcttcaggggataactcatgttggctgtccaggcaatgtaccctccagactcagctgcctttggaggaagtctctggtctcctggctcctgtctctctccttagacgtcctctccctctccactgaaagatgaggtcatggtttttgctcatttatctcccctagcgcccaagtcagtattccaaacctgcattcagcttgatggccaaaaaaaaaaaaaaaaaactgactgactctatccaaggctggtcaaggttaaccagaaagtctggccagtgttcagtttggcaatatcttgaagaagaagtgtttttgttcattgaagttgaaactttttgtgatttgtgtgacaacttacagttggcaagcactttaacatatattattttatttcacatcttcaaatgcattatctccatttccagaggatttggttcataaaaaatcccttgacacctcctatatgctaggctctgcacaccaggatatagagatgaatagaatattctccctacccttaagacattagtggaaatgcgaaaggcagtcccattaatagacaataccaggatcacaagctgatgctgtgggagaggcagaaaaaggattgcagagaatgtttttcagggatacacagcttggctagtttgggtaacaaaaaagagagaacagttcctgattgttattcctgttaaagaaacacacagttaatttcacaagaatggcaaatagaccgttctagctaattgcgataccactcagttgcttactacttatgttgaagaccatgttgaaaagaactccaaggaggtcatgcctaaagtctatggcaaagaatgccatgattgattagtgatgcctgccatgggcatgagaagggtatttgttattctggctctagattttaccatacatgggagttacacagatgtaactcccattcaatggatgcatcagatagtaggtcaggggttcctgtggtcactagggaattctgaagatcctatattgacctaaatgcctaagcccagctctggaaggtggccaaagtttatctgctatgattgcaattagagccttccacaggaagactctgggcctacgtggttctagaatgtgaattctactcccagaattcacctttgaacagagagatgcaaagacccattcactgtttcctgttctttgcccactgtctatggccaaaggcatgggatggaagggaataagaaacagagataagtaagcagtgctttttgagaagacgttggttatttgtcgtgtgtttattcctccaagtctaggataataactaagctccatattgtaagtcaactccaatcaaatgacagtggctccctggagtgctgttttgaggactgggaggtttcctcttgattcaaacaaatagatggctgtgcttgattagagatgtctgccatgagcatgaaatggtagatggtggtgtgcattcagtgcatttgtgcatttcttttgtgcaaaaattgaaccttggtgctaatcttgtccatgagaccgaaaccatgacttcagatccctacatttctagagtctaataagatgctcataatatctcagtcaaacaaacaaacgaatccatctaactcatcttagtgttcacacaacatcgtcatatcctgcatgttatttaactttcacattgccttttggaatagacaatgtaataattcttgactccactctgcaaatgagaacaatgaggcttagagcagttaattggcatgactggaatcacaccatttatttaaaaaagaaagaagagtagaaaagaagtcttccaactcctaggacagttttctaattcttagtaaagttaacaagggcccatgggaacagaccattccagagcctccacttagggtgcttggtaaaaaaatacatgttcctgagtcagggtttctggggtacaagccctggaatctgaagaacaggaaggttatagggtggttttctaattattagcaaagttaacaagggcccatggggacggaccattctagaaacctctacttagggtgcttggtaaaaatgcatgttcctgaatcagggtccctggggtacaggccctgggatctgaagaacaggaaggttaagtgacttagccaaggccacccagttagtaaacagtggggacaagatttaagccaagcttctacatcgtggcagcaactgagaaattacaaatgcagtgggtgccaccaaggagacaggaggtcccacgggagcgtgcagccatggtggcccatattgaagtcagacaagcaaacctttctccgtctcaaagcatttggctcaaggcagaccacatttctggtgtctgctcccatttctcccctttcatccatagtctgagcatctgcagctgtgtcccaaatccagggcttggctgatttttcagaggcctaaaaatagaggctcctgtccccccaccaagcaattctcgaagctatttttttacccttcttcttgcagacacccatgagatctcctttccccaaataaaatcatgatgaaatcccgggaaaagccattgcttagttctcagaatgactttcctgcagacagcggaggtgctctcctttccccagaagcacataagaactgcaaattaattatacaacataattagcttgctcctccaaatctgtgcagtgggcactttgaagcaagaatagtaatagtttgccatgcattgctaccttagtaacaagagtttgtaggagaaaaacagaacaattacagagaaagacacagtaataagctgtgggtagcattttctggagtatggttcattttcactaatgatatgcaattggatttgaagaatataccaacagtttatttttatttatttctgttcaaattgttttttttttcttttcttttgagacagggtctctctctgtcaccgagcctggagtgcagtgaagccttcatggctcgctgcagtctcgaactcccagactcaagcaatcctcccacctcagcctcctgagcagctgggactacaaacacgtgccatcatacctggctcatttttttggttttattattgtttttgtagagatggggaggtctccctacattgtccaagctgatctccaactcctgggctcaagcaatcctcctaccttggcttcccaaagtgctgagattataggcatgagccactgtgcccaccttctttttattttgatagctaattatttctcttaatgcatattaaaaatgcatatattacttattcaccaaactcatggatttacagatattcttaggatgaagctgagcatattagtcacctattgctgtgtcatagattataccccaaattagcagtaaacatttatcatcttgcagtttctctgggttaaaaattcaggagcagcatgagttggatggctttgtcttggggtctctcatgaggctctggtcaggatgccagccagagctgcagtcacctgaaggcttgataagcactggatgatgaacttccaaatggctcacacatgtggctggcaagtcaatgccaactgttgacaggaggcctcagtttctcttcccatgggtctctctggagggctgcttgagcatcctcacaatatggcagctgcttcctctgaagcaagtgattcaatagagagcaagaagagaaactcaatgttgttatgacctaacctcggaagccacccagggccacttttgcaacctcctattcagtgttggtagggactacacaagagtgtaaattctgctgggcacagtggctcatgcctgcaatctcaacactttgggaggcccaggcggtaggattgcttgagcctaagacttcaagactggcccaggcaacatacaagagctcatctctacagaaaaaaaaaaaaaattagccaggccatggtggtacatgactgtggtcccagctacttgagaggctgaagtgggaggatcacttgagcccaggagtttgaggctgtggagagctatgatcatactcttgcactccagcctgagcaacagagaccctgcctgtaaaaataatgatgatgatgatgatgatgatgatgataagaataataataataaatgaaaagcaaaagtaaaataaaaaacaaaaatacaaaaatttttaaaagagtgtaaaccctcggaggtgagagtcatccagtgacatctggtaagcagcggccacagtgagacaggtgccgttgtaattattccctcatgaaaggtcaaggaacctgagctgcagagtcaaaaagtgattgtccccccgtcacaccgttaataagtggcagagataggattctgtctgactcgaaatcctaaactggttttatcaaaccaagagaatgttcagtgagttcaggggcccacagagagaggtaaccataaagcttcactatagacgagctcttgccagttaagcgattttggaagcgtgttgctcatttctagaggcttttttttctcttcgctcatccctctagccgtcataaaaggaggccccgacaacaagactgcttcccccatctaagactgacgtttctcttttaaagaggtatcaaggaatgactcctgctcggatttacccgagatccagaatggctggaaaaccacttctcacacggagttggtgcggggagccagaatcacctaccagtgtgaccccggctatgacatcgtggggagtgacaccctcacctgccagtgggacctcagctggagcagcgaccccccattttgtgagaaaagtaagagtggtcttgtttccttcctctaggtccctgggtggcaaatcccttctagggatctttttttggtgggtgcagtggagctgtttaatgtagaatctggactccccctccaccaccaattcacgagcattgctcacaaatgtcattttatagctgtcagtggaattacagactcaggtgccttcagaaacctggaccataatgtaaacgagtgagataagctgggtgtgagacattagggagtggtgtgaactccagtgaatgggagcgtatgtagcctggtgaaaaagaacatttggctgggtgtagtggctcatgcctgtaatcctagtgctttgggaggctgaggtgggaggatcacttgagcccatgagtttgatagcagcctgggcaatacagtgagaccctatctctaaaaaataataataagcataaaaattagctgggtgtggtgggacacacctgtagtcctagctactcaggaggctgagacagaaggattgctggaacgcaggtgtttgagctatgattatgcctctgccctttagcctgggtgacagagcaaaaccctgttgagaggggtggctgggagagagagaaggaaggaaggaaggaaggaaggaaggaaggaaggaaggaaggaagggaggaaagaaagaaagaaagaaagagaaagaaagaaagaaagaaagagaaaaagaaagaaagaaagaaagaaagaaagaaagaaaaagaaagaaagaaagaaagaaagaaagaaagaaagaaagaaagaaagaaagaaagaaggcaagggagggaagggagggaagggagggaagggaagaagggaggaagggagggggagggaaggggagggaaggggagggaaggggagggaaggggagggaaggggagagaagagagggaaggggggagggaaggggagagaagggagggaggggagggtgagggaaggggagtgaaggggagggaggggagggaaggaatgaaagaggggagggagggaaggaaggaagggagggagggaaggaaaaagagagaagggagaggagaggagaggaagggagggaaaaatcattattatttaaccattttaagggattggaatgaacatgaactagttccctatagaagtcttcttacctgcctcattttttgccaagaaaaggcccaaagtgggcaaataaatttgaattgggccccttctatgtgggactgtttgcatttccatgctgggtctctcacttatcctccatccaagacagtggagacccaccaatcacctctgttgttctctcttctgatgaaatgaggtcagaaaaaccccttggcacaatggtctccccatagaagtcactggatttcattaacctttcattggttaatctcctgtcttgacattgaaagacatatatagccatatcttaaaattacattggtaacgatgcttacttatagtacccaggcagtagtaaaatgatagaatagaaagtgaaaatctttgatgatgttactctttggaaacaacgctgctgttaaacatttattctatattgcttcaattgtgtgtgtgtgtacatgcacatcatacatacattacatgtcacacatagacatctatatatgtgtcatctgtcatatgtcaatcatagctcactgcaacctcaaggttttgggctcaagcagtcctcccaccacagccccccaaaatgctggggttacagatgtgaacaaccacacccagctaatttttaaaaattttttgtagagacaggggtcttgctatgttgcccaggctggtctcaaactcctggcctcagcctcccagagagctgggattacaggcatgagccaccgcacccagcagatccattcttacaaacttcctgcatctgcttttttttcagctcagaaatgtggatatcttttcatatcatacatgttgtccagtttattctcttttaattggtttattgttttccttttatctatattgattttttaatgtgaaaagtaatgaaagtttattttactacattccagcactacagagaaagcagtgaaggctccccctcactttgttctctttagcagttgctcagaatttcatgggatggctattccatgatatttaactctttccctgttaaactatttgcaatgtttcctttttaaaaaaatcgcaaataataatgcaatatgcaaccttatacataggtctttggaccctgatgcaaattatttgggcaaattcatatatatgtgtgtgtgtgtgtatatatatatatacacatatatatatatatatatttatatgtatttttttgaggcaaggtctcactctgttgcccaggctggagtgcagtggtgccataatggctcactgcagccttgacctgccaggcttaagcgatcctctcacctcagcctcctgagtagctggaaaaacaggtgtaccccaccatgccccattaatttttgtattttttgtagggaccggatcttgctgtgttgcccaggctggtctcaaactcctgagctcaagcgattcatccacctctgtcttccctttcaagtcctaggattacaggcatgagctaccgtgccccacctctttgggcaaattcttaaaagaggaattaaattcaaggctattttctcctggcctattctccagccacctatcaacaaaagatacattatcttccaaaaaggaaaagaactgagttaggaaactttttttttttttttttttgagatggagtctcgctctgtcgcccaggctggagtgcagtggtgcgatctcggctcacttcaagctccgcttcccgggttcacgccattctcctgcttcagcctcccgagtagctgggagtacaggcgcccaccaccaggccaggctaattttttgtgtttttagtagagacggggtttcaccatgttagccaggatggtctcgatctcctgacctcgtgatccacccgcctcggcctcccaaattgctgggactacaggcgtgagccaccgcacccggccaagttaggaaactttctagatcattctgtaattctcagcaaacccatggtcatccagaggtctgacgtcctcttggtctggtttcatcccgtgtagttatgtactgcaccgaccccggagaggtggatcactcgacccgcttaatttcggatcctgtgctgctggtggggaccaccatccaatacacctgcaaccccggttttgtgcttgaagggagttctcttctgacctgctacagccgtgaaacagggactcccatctggacgtctcgcctgccccactgcgtttgtgagtcctgtttaatgaattgggcccccagtaggtagaagcagattcactttctcttgttcatgatggaaggctgggctgctaggaggccttctgcttttcgacaggggcttttattatcattactatgacaaaacagtacctaacactgattgggagcacacatactataacatttacagtaaatttatcacgcgttgctctaagtcttctaccaaatttcactctttcttcctcaagtagccctgggagcatagtatactttgtttttttgtttgtttgtttgtttgtttgtttgtttgttggttggttggttggttttagatggaattccactatgtcacccaggctggagtgcagtggcaccatcttggctcactgcaatctccgcctcctgggttcaagcgattctcatgcctcagcctcccgagtagctgggattacaggcgcgtgccaccatgcctggctaatttttatatttttagtaaagatggggtttcaccatgttggccaggctggtcttgaactcttgatctcaaatgatccacccgcctcggcctcccaaagtgctgggattacaggcatgagccaccaccctggcttcactgatttcattttaagaagaggatactgtgctaggtgtggtggctcacacctgtaatcccagcactgtgggaggtcaaggcaggcaaaccactcgagcccaagagtttgagaccagtctgggcaacatggcgaaaccctgtctctaccaaaaaaatacagaaattagccaggcatggtggtgtacacctattatcccagctgctcaggaggctgaggtgggaggattgcttgagcccaagaggtcaaggctgcagtgagctgtgattatgtcactgtaccctagcttgggtggcacagcgagaccctgcctcaaaaaaaaaaaaaaaagaatactacttcaaggctctctagggattctgatatacaaacaatgttcacagtcattgcataaggaaagcatgaagttacacggaaggagcagagccttacacagtattttgggggttagaaactctcagctgcactaatattttaaattagtgtgttatgaacaactccattaggaatacagccagttcaaactccagaagccacagtgaggtcttgatagtgttgaagaaccaagaatttaactctggggggaaaaaaagaaaagaaaaaatagaattcctgtgagttgattataaattcccctacatctgatgtgagtaacactgtgtacaatttatagacttggccacctcctatagtggctatgttttgtgacttctcacaagtacctaaaacaggcttcacaaattttgatgaccacactaacaagcaactctacgatttagacgagcaaactgcagaaaggcaaccagaaagcaggaaagtccttgtccgttttcattggataggctgatacttactgagcacttactgtaggccaggtgtcattctaagaatggcgcatgcattaactctttgattcctggcaggaaaacaaaaatggagatgtctgttgcctgtcgttgaagacagagtatggccaaattcacactcacaagagaccttcctctctgctctattcatgagccagccaaagccaagttcccgtgtgctagttcataaattcagcttccccagcccacagaagggctttactctacagatcccaaaagaatgaagagttttaggcccaaagcgcttgcttcatagatttcccttaacatctgatccttttcttgtgagagaaaaatttccatttctgtgttcttattttctcttctcaaaaagggacactttattattctgtttccacaagtaacagggattcttggaccacacagccctgtgtctccatctgtctttttagtcagagtcccagaatttcagagctgaagggaatctgagagataaaatacaactgcaggatgacttagagataaaatgcaactgcccccattgtacagataataacaatagttacttattgaatgtaaaagacacattgctaagcacactatacatatctgtaaacatgtgtttttgtgtatgtgtgtgtatatatagtgtgtgtacatatgtgcatatatatgcatatacacatatactaaggaaactgatattcagagggaagtacaaataacaagaatcattgctcattgaatgtgtaagacacatttctagacactatatatatgtgaatctatgcatatgtgtgtatttatacacacatactaaacctagccccttaaccacaaccacacttggtccccaagccccagaaccttgggccaaatccacattggttggttcctgttataggttgaatctatccccaaaagatatgttaaagtcctaacccacagtatctgtaactgcgaccttgattggacatagcgtcttcgccatcctaacccatggtatctgtaattgtgaccttgattagaacttcaaagttctaacccacagtatctgtaactgtgaccttgattggacctagcgtctttgacatcctaacccatggtatctgtaattgtgatcttgattagaacttcaaagttctaacccacagtatctgtaaccgtgaccttgattggacacagtgtcttcaacatcctaacccatggtatctgtaactgtgaccttgattagaacttcaaagttctaacccacagtatctgtaaccatgaccttgattggacacagtgtcttcgacatcctaacccacagtatctgtaactgtgaccttgattggacagagtgtcttcgacatcctaacccatggtatctgtaactgtgaccttgattggacgtagcgtctttgacatcctaacccatggtatctgtaactgtgaccttgattagaacttcaaagttctaacccacagtatctgtaactgtggatttgattggaaatagaatctttgcagatgtggtcaagttaagctgaggtcgcactggattaagatgggtgttgatccaatgactggtgtctttgtaagaagagggaaatctggacacagatggggacacagatacagagaaggccacagggtgacagagggagagattagagtgatgcagctgcaagccagggagcacgaaggaaggaccccccccaaccgcccacagcattcagagggagtgtggccctgctgacaccttgattttggacttccagcctcccagccaagaagtttctgctgtcctaagcctcccggtttgtggtcctttgtcaagggcagccctaggacgtcagtgtcattcccatttccttctagtgactgcaagagcgatcagaagcagccactttagtaactccagctgcagagacccagagatgaaaagcttaaaataaaagcttctattaaaatactgaaaggtggaggcatcatttttttaaaaaagaaaaagcacttcaccaatgagacccagtctctaaagaccctctgagctgcggcagctgctgctggatttccaagacgcaagcctccctccctcccttcgggaatgcttttccctgaaatctcagcattggatctgcagtgctgagtagagacggcttcccttacacccatgctaatgagttcacgagccacgcggggtgtcaggagacacgcggtactcccaaaagcctgaagaagagccctgcgtgtggtggcagcgacgtgacaagcgggtgaggctgatgggagataacgcaggaggcgagagatggtccgattctggcagcgcggctcctgagtaagagggaggatgcagtctaggttctgaaggcatttttaaggttgaggttgtcagacataaaacagctttgaaacgttttgtcgactgaacaaagggaacagcacccatttgatgggccccttcagtaggctgaccttttccccaacactaacactcttcaccctcacggaaatcgcacaggtgaatgcctgtccacttaaaagcaggcaaagaaggactggagagggtgagtagctttcctgaggtcacacaacagaaaggaagaacagaattctaactcaagcctgactaaacccaaaagcatcttcccaacctcatcactctgcagttcagcttttgggcaaacctctggtgcttaagagtggacaaagatccaccaagaagttaatgaagcagacagaaaactgcataagcccctgggcccagtggtgaggtggctcacgcctgtaatcccaacacttgtgggaggctgaggcaggaggatcacttgcggtcaggagttccagaccagtgtggccaacatggtgaaacccccgtctctactaaaaatacaaaaattagccagacttgatggtgagcacctgcaatctgagctactcaggaggccgaggcaggaaaatcacttgagctcaggtggcggaggttgcagtgagcagagatcacgccactgcactccagcctgggcaacagagggagaccctgtctcaacaacatagaaacagaaaagaaaagaaaagaaaactgtataagctctggttgtctacagcctcttgcccagtcacttgcccaaagccatagtttggtcccctgggactgaaagccatatctttttaatcctagtccatttaccccagggcactttaagaacagacaggtcaggcagagataaagggaagagtctgggtgtcaaagtcagacacaccctccagctctgctgagtgaccttgggcaagtaacttgccctctctgggcctcagagcccccatctgtgaaagaaaataataccctttaccaagaaggattgttgggagcaactcactcagtcattcagcttactcagttgttcaggcctcctatatgcaggcacacgctaggacagaggttcccaaactttctcaactcatgacacccttggtgtctcaggaattttttcacagatttcctaggccaaaataccatttccatttattaaataccagttccatttattaaacagttaggtacaaacaactgaatgagtagttatctcttcacagcatagtagccatttgaaaaagtaatgcacatacattaaaagaaaaacggttttttttattattaaataatgacaattgctggctgggcgtgatggcttacacctgtaatcctagcactttgggaggctgaggcgggcagattacctgaggtcaggggttcgagaccagcctggccaacatagtgaaaccccgtctctactaaaaatacaaaaattagctgggtgtggtggcacgtgcctgtaatcccagctacctgggaggctgaggcgggagaatcgctggaacccgggaggcggaggttgcagtgagctgagatcatgccactgcactccaggctgggagacagagcaagattctgtctcaaataataataataataataataataataataataataataataataataatgacaattgctgctacgaggatgtgtatacccgttgggctgtgcaaatcttcttaaacgttaggatcagatgggacttcgccaccctaatttcctgttccacattgattttgtcacagttagcacgagcaccacaaaaaaatccagctttgcaatgatgagtcatcaccaaaacaaaggtgacgtgatctaatgttgaaacggtgaactatcttgagctggtagttcacaagggtccaacacatcattgtgtttcctcagaacttttttttttttttgagacggagtctggctctgttgcccaggccgatgtgcagtggcgcaatcttagcccactgcaagctccacctcccgggttcacgccattctcctgcctcaggctccagagtagctgggactacaggtgcccgccaccacgcctggctaattttttgtatttttagtagagatggggtttcaccgtgttagccaggatggtctcctgaccttgtgatccacccgccttgacctctcaaagtgctgggattacagccatgcgccactgtgcccggccctcagaactttttttaaaaatcccacagcaccccctgtgagttcctggtggcatcctgggtcaccttggtgaaagtttgggaaccctggcactagcccctggaaaaacagtaaggtataaacagatatgacccacattctcatggagcctggggcctatttggaaaggagggtggagagacaggtctatgaaggaaatcacaatgaatcgtcagcaccacctcctccaggaagtcctccctgatttcctaggccgggttgtgtttctgtcctcagaattcccatggaacctacagtgacatctgtcaccacagctgctgcagtttattgaaatgatctgtttatatgtttgtagaatcacattccctagagtaagaaagagaaagaattttaaaatatatatatagaataaacacataactcacctgctaggattgtctccagttgatccttgaatcccccaagcccaggaggctcgacaaatgatgttactattactgtcgttgatattgttagcaaaatgaatgtggtctttatcacacctctgctttgttgcaacttcccctctttgataaggacgtggtggatgactcctgaggtaaccatcccaaagacataaaccacaccaccaaaactaaaaagaatctgacaaatccggcaagggttttatgagtggctctccaggagccacttagcttgcttaagagacagcgattccccgggaggccctggttctcacagccctgagcccagaacacctgggatacgagacacagggatttcccagcctggacagagcccacaggtgctgtggccagactgtggccaccgtaggagcttccactgttgagccgtctcctgtggccacatcttggccagcatgtccagtgttagctgagttcccgtcctcatttagaaatctctgtctctgggaaagcggtctctcacagaaatccatgataaccctaggggatttgggtaaaagaagggcctttgttatagcagaaccattaaatggacagcactaaaaaccagcacgtccaggtttgtaccccagccctgcctcttacaagcaccatgactttatacaagccagctttctcaccaaaaagattgaaaaacgaacatgccaatcataaatataaaggcttttaatgaatggtgtgcttggcacatagcaagtcgtcagttaacattggctgctaatcaccactctgtttcaaagctccactgcttgtagggcatattgcaaaccatttgtaactattactaggggacttgatttcgagctttttgttcaaatgtgctccagaaatgtacattttcttctattgttaaagagaggggaaaatagaaaaagaaaacagaaacgagagtgggttcgtgagtagatctataaggccatcggtccaattcatttgcattcctgggagagaacggctggagttacaccagttgcaacccgaattgtttaaaacattcgaccagtggttttcaaccagaggcgattttgctttccaggggacatgtgtaaatacaatttctagagaaattatgagttgtcacaacttgtcagggaagaggggtgctaccggcttctagcaggtcagggcccaggatgctgctcaatatcctccagtgcccaggacagcccccaccacaaagaattatccattccaaatgtaaaacctgtctaagttgagaaaacctgccttagatgatcttatttcaaagtgtgactacatgtcactgcctagccatgtctcggctaaggtccagactgtttatgggcagaaaaaaatggagtatggagacataagcaactcactcaaggtggtgcagcagacacaggcctccagtttcaaattcaagttcctattcctttgactcttctgccatcttctaggtgctgaagatacacacaaatgccttccaagagctggttcctgctggggaaaaattccatatgacattgttttcaaactcttactgaggactgggtcaaaattgaatcaggctgacttgaaagctagagaatcctcagctcaaattgcagctcagccacttcctgcttgaggggacttttcaccagtgagttccacctgagcctcagttttctcatctgtaaaatggctgcatggtgcagtggttaagaccggacttggaccacctggatttgaatcttatttataccactaactagcttgtgacctttaacacgttacccaaccgttctgcgctgcattctccttggatacaaaatggagatgatgaccaggcatgatggctcatgcctgtaatctcaacactttgaaagaacgagacaggaggatcacttgaggtcaggagttcaggaccagcctgggtaacctcagggtcctcaggaccctgtcttcataaaaaatttttaaattagccaggcatgatggtgcacgccagtggtcccagcgactcgggaggctaaggtgggaggatctcttgaaagggaggtcaaggctgaagtgagctgtgttcacgccactgcactccagcctgggtgacagaatgagaccctgtctcaaaaataaaaataaaataaagtaggaataaagatataatatctgtgtcttagggttgttgtgataactaaatgagttcatagatataaaacactcagaatggaatctggctcagagaatgccctcagtaaatattgtaaatgttggctgttttggtcatgattgttattaccttcaaggactttgcagaaggattagaaataatatatgcaaatcatctaatacagaatggttgtgcaaatactttggaaattaattaaatgatgagttaatatgttaaccatgccaggacaccaaaccagtggttctgagcccttgccaaactttaaaatctcctggagagttttaaaaagaatactctgggtgactaattaaattaaaataccataggggcggagccagggcacaggataacccaaggccattctagcacttagcctgggggtcctgctcctaggtcggctgtcaatatcctcctttacacccaggtctaacgatttatcctttatgcaccttccatctccccagggcgaggacagtgtttagcacaggtttggtatcaggaaatacttctggaatacatacaggactgaattagtgttcagttacatgaaggcagggaccatgttcgccttgctcatcattgtatgcccggcgcatacaatgcctggcacacagaaggtgtccagtgaatatttgttgtattaattcatctgttaatttatgaaagaaaatttccgaggaaaggttcatgggggaattcttttgtgtcgccactgccacctgctggtcatttttctgcactgcaggtaatacagtagggatttgtgttctctgaagggagccaccaacgtcatcaagaaaaagcctccccgaccagggggcgggaaagtgaggcttctcctgtgcgctttccccagcacagctgagaccacactgggctgtaatgacccggtaactgttctctgttccccattcgactgagttttgggagaacagaaaacgtgattctctaattcactgcttcatacccagctcctagcacagggatggaacattggaggaacagagtctacgggctgaaaaaaaaacaaaaaacaaaaacaaaaacaaaaaaaacacggagagtgtattctggactctgggagttcaaaagctataaagtgttgtgcaccgggctgcacttcccgaggagtaggagtattagatacactacggggatacccacgcggctttaaacagtgtccagatgaactttttgtgagtcgtttggcttaagaaaattagaaaaattaaaactgacatgtgaaacctctgattataagactattattatttagagtgaggctaaattatactgtgcaatctaaatagaaaaacaagtcaatagaaatttttaaaaatatattacataggccaggtgtggtggctcatgcctgtaatcccagcactttgggaggctgaggcggatggatcacttgaggtcaggagttcgagaccagcctggccaaaatggtggaaccccgtctctactaaaaatacaaaaacaaaaaaaatcagctaggcttggtggcgcatgcctgtggtcccagctactcgggaggctgaggcaggaaaatcgcttgaacccaggaggctgaggttgcagtgagctgagatcacaccactgcactccatcttgagtgacagagtgagactctgtctcaaaaaaaaaaaaaaatatatatatatatatatgtattaagtgaacaacagtacaattggtatgaaaatatgacaagagttttaaaagccataaaaataatcagtgtatattgggtgctcactatatgctgcccatctcatgtgcgtgagcttgttttattctcataacaacaccttgagacagcccattttaaagatgaggaaactgaggctcagagaggtcagttgtgctcacagacatacaactaggatgtgcatcctgagcccttggacacttgaacccaagcgctcctgctctgcaatttgcctttaaatgaaatgatgtgaggtctttcaagaaatatttactgggcacctaccctgtaccaggttgccaaggatgcagcagtgagctcagctgggttgaggaccaaagacttcctcaggatattttcagaggaatcattagaatatgattggcactgggttctgttcattataccatctatgcttattgtaaagtaatgcagacccaccctgcattaaaaaaaaatacatcaaagcacaggctttaaaaataaaaataaaattctcccttcctacagtccatccccaaggcacgctctgcagggtgaatgattccttgccagccctcttaggtctcatccataaacacataatagagtgctgccttggagggagccccatgattgacttaagcaaggctttgtgatttgattctgggctcaaacacagaagcgttggctgcatatccatcctgctctggaatgccagggggcaaacttcaagtatacagatgaccttcaattagtggaaggattagccttggccaagtgtcagctgaaccacttactgcctcatctctgggagtcttgtggaaagggagctacattcaaaatctctgcctctctcgctcaactattccaacagccccttcccttggctactttaggggtcttctgcagccacccagggtcttctgagtttctctcttctatggcacctgccatttttaattaaattgtccatttacacatttgcttggccccttagagcatgcagaccatgagctctagaggacaggaatgatgtctgattcacctcctcaccgcattgctggacgcattgctgggcatgaagtaagcactcaagatatattttctgaataaatgcatgggtgcccgccagagctatctatggtgtcatccaagatgcaactccagctgcacagtgacctgggaagtctcttcccacaggctgacttctgggctagatttcaagggtgggaaggaaacagttcataactcccagggaagactgctattgaagtataaaggaaaacccttcaacctcaagagtgaagccagattcctacccgtccacccactggaggagatcaaagtcccgattcttcatgtatggtgattactgtgactaaaacatactcatcaattgattcattcatcttttcattggaaaagtgatacatttaaatgcctacaaggccaggcaagtaccacgtgaaagacaatagggagtggcagagactggggctaaagtaaagaatattcctggtctaacagggaaagccattactcaactccagccagtcattgccatgtaacaatgtgaacccagtattgcccaatcttctaatgtttcagaagaatccagaaatctaaattattatttgaaatctcctaatctgtgaaagcttggtaactattgtttcagttgacattactcaagctgagtagagcccaaatgtaagtcatgttcacagagaaaagggttctagctgggacctatactgtactgtgtgccttgaaccacaagtgccgtaggaccagggattatatctgttttattcacctctgtgtcctcagtactatttatgttgttggcacataataattgctcaataaacattatctgagtaaataaaggaatgcttcctgtgaaccaggcattgtactgggtatgagcatatatgagtttaaagcctgggaaagaagtgccagaaaagattctgaagttatgatgatgataagacagagttccaaggacagaattcatgcctttggggagcaatctgggtcttgaaggcatgcttgagattcatcgtgcaaaatgagacgcttcaaacaacacgtttattatctgacagtttctgtgggtcagaaatctgggcatagcttaacatgtacacccatgttcatagcagtattgttcagagtagccaaaaggggaagcgacacaagtgtccatcgatggatgaacgaaaaacaaagtgtgacacctgcctacgatggaatattagccttgaaaaggaagaaaatttttgacacatcttgcaacctagatgaaccttgaggacattatgctaagagaaagaagccagtcacagaaggcaaatactatctgattccacttacatgcgataactagagctgtgaacttcatagagacagaaagtagaatggtggatcccaggggctagggtaagttgtttaacgcatatagagtttaagatttgcaagatgaaaagagttctggacataagttgcccaacaatgtaaaagtacactaacctactggactgtacacttaaaatggttaagatggttagttttatgttatgtagattttactacaatttaaaattttttaaataataaagtttagaatgttttaggatttgtagtcctgtgtgtgaagcaatttgctggctgtccattccatccaggtgctgaaaaaggactagatctcacatgcggcctggaatgggttaaacctgcaggttcaactctccagtaaatactgtgatcctaacaccttgggaggctgtggcaggagaattgcttgagcccaggagtttgagaccagcttgggatgcatggcaagaccctgtctctactttaaaaaaaaaaaaaaaaaaaaagccgagtgtggcgggacacgcctatagtcccagctactcagaaggcttaagcaggggaattgcttgaccctgggaggttaaggctgcagtgagccgtgctgcaccactgcactccagcctgggtgtcttaggctaccgggtactttgtgtctgcagctgaagagagcagtcaccagatggcagtatgggcttatttgtaatagttgaggccttttgttgccaggctcccaggccctgagcttcaggcttgctctgataggctcatctccaatgagggaaacagataactaattcagtacagtacagtgcatgcagtgctggagaaactaagaagactgacgactcaattcacggtaggaggcatcaaggaaggcttcctggagaaggagaaatgaagattgagtattgaaagacaagacgtagtcataatggatgcgcaggttaggtgtcaggtgaaaagcaagaagaagatttcataattaaacaccaccaccgtccatcatttactaagtacgtatgacatgccaaaaacaaaacatcttaagcatttccttacttacctattttagtcctccaaattcctaggagatagatattactttgatcgtcgttatgctaatgaggaaactaaggatcagaaaggttatgccacttgctggcgatcacacagctaacaagtaacagaactcatattttaaccttgattcctcagccaacttcattctaccttgcctgtatgtaatctgtgcccagaggtggaagacagaaagaacagtttgagaaatagaaaacagtctgatgcaaggtggggatgcagagagaggatgctggagaggctgaccaaagctagatcacacgggttctgagcaggactccccaaagatttgcatcatctcatcagagctccttctggcttgcatttcagcggaggagtccctggcatgtgacaacccagggctgcctgaaaatggataccaaatcctgtacaagcgactctacctgccaggagagtccctcaccttcatgtgctacgaaggctttgagctcatgggtgaagtgaccatccgctgcatcctgggacagccatcccactggaacgggcccctgcccgtgtgtaaaggtaaagaaacctactcaccacacagggtccacggggcctggagatgtcaggctcctggctcacaggagttctgaacttgctctaaaaaattggactaggagttcgagaccagccgaggcaacatagtgagacccccatctctaccaaaaaaaaaaaaattagtcaggcatggcggcacacacctgtagtcccagctactcgggaggctgagatgggaggatcacctgagcctaggaggtcaaggttgcagtgagccttgatcatgccactgcactccagcccggacagaacgagactctatctcaaaaaaattaaattaaattttaaaataatagagctgagctgctgtacttcattaaatctaagatgtcaccatgactttatgcaccactaaaaaagaaaaaaacatgctgccaattatactatgacacaatgtcttctcctggcttagcatttttatttttacttactaaaggagcttttgaccaggcacagtagctcacgcctgtaatcccaacactttgggaggctgatgcaggcatatcacttgaggtcaggagttcaagaccagcctgaccaacatggtgaaaccccatctctacttaaaatacaaaaaaattagctgggcgtagcggtgcatgcctgaagtcccagctactcgggaggctgaggcaagagaatcacttgaatccaggaggcagaggttgcagtgagccgaggtggctccactgcactccagcctgggtgacacagcgagattctatctaaaaaatgaaaacataaaggtctttaagctttttatcatatatcacaattatgaaaatgttcaaatgaaaatataagcagcccaggtgcagtggctcacacctgtaatcctagcattttgggaagctgaggtgggaggattgcttgagccggggagtttgagaccagcctgggtaacatggtgaaactgtctctacaaaaacaaaataatgataataatacaaaaattaacctgatgtggtgacgtgtgcctgtagtcccagctacttgggaggctaaggtgggaggatcacttgatcccaggagacagaggttgcaatgagctatgatcatgctactgcactccagcctgggtgacagagtgagactctgtctcaaacaaacaaacaaacaaacaaacaaaatacaagcaaaataaactggttccagtgtatttaaaacttccccaccttcaaagtctggcacttttgattttctaaattattactaaatttttttgtagagacagggtcttgctatgttggccaggctggcctagaactcctgacctcaagcgatcctccctcctctgcctctgagtagctgggattgcaggtatgagccaccacacccagctgtagaatcattttttactccaagtcttcaacatcctatttttccactcaatatcgctcctgttgaatgtcattgtgtactaaaatatatatacatttacatacatacatagctcctgtcccattaaagcatcagggatgcagaattctgtaggaacgtccataacgaactaaagtctttgatacaaggggcttgcagttacattgaggcagggctgggacgagtctgaggcaaaagaggtgcctgaggtgaaaaatgtaaggaggtgaccaagcgtcccgtagaacagccttaaaaaaagagtctccgtacacttctcgccctagacagctctcgccttgccctagtcccggccctgtgatccagcctggtttttgttgatttgtttgtttgtttttgtttgtttgtttgtttggagacagggtcttactctgttgcacaggctggaatgcagtggcgtgatcattactcactgcagcctcaaccacctgggctcaagctatcctcctacctcagcctcgcgagtggctgggaccacaagtgcacgccaccacgcccagctaaatttttttatttttgtagagatgggggtctcgctatgttgcccaggctggtctctactcctggcctcaaacgatcctcccacctcggcctcccaaagtgctgggattaccgcatctgacctctgcctgcttttgacccctgcttagagaaccctgcttaattatttcccacctcttgcactgcctcctcacaaccagttagttcccatgggttaggagtgttcctccactgcctacagggtgatctcccagggcgttacctggcgttctgcaaaccctaatactcttaacgcccccagtttgtgcacacggggaatcgtgagcgccacctggtggcagctattattacacattattgctttaagcctcgcccccacctcccagatggtgaagtgagaaaattgcatcttagaatccattgaacactcatcactaaaattaagttgtaacacactaagtaaaatttggattcgtttatctggacttttgaagtgcacaatcagtaatagtaacggaaatatgttcagtgttttaggccagtggatcttaacctttattgctttagtgcccctttgagaatcaggcaaaaggctcgaatttgccctccagaaggaacagaagcatgaagttttatgtctctacttgggaacccctaacttcagtggatccccaaatgccttattcatgaaccccagctctgaggcttaaaactactttcccagttagtttgtccactccgaggtatatttccaaaagaagtgaaacaggtatttaagcaaaccctgtctaagaatgtttataggagcactattcacaatagccacgagatggaaacaacccaaatgcccaccaactgatgaatggataaacaaaagtgtggcagaaaaaagggaatattattcagccattaaaaggaacgaaatactgacacataccacaacatggatgaacctcaaagccgttatgctgagtgaaggaagccagacacaaaaggtcacatgttttagggttctgtttctaggaaacatctagaataggtaaatccatagagacagaaagcagagtcgtggttgtctagggactgcttactgagtatggggcttgttttggagatgaagaacatgttttggaactaggcagaggtcatggttgcgcaccattgtgaatatgctgaatgccactgaattgtaacactttgaaatggttaattttatgttatgtgaattttatctacctaaaaaaaaaaacaattcccctgaatcacctctgttaagtcttatgaccactgtctaagataggtgagccatcttacctgttttacagatgtggaaggagaagctcagagaagttaagtgattttcccaaagccacacagctagtacaagacaaagctaggacttgaacccgcatctcatgactgtaaatttcccgccttcagggctactaagaaagacccccaaccagccagtcaccgcagcatggaaacctaggtgtgttcacacattcccgaatctaacccagatctcccaaagcaaaatcattgagaggcgggcctggaataagccttttaacaagctctcaaatgcactttgaatgtgagaaccatttaaggccgtgatttccaaacataaacggagtcctgagccctttccacggagattctgattcactgggtctaaagcaggacccagggaccagtttaactaaccacacaggtgaattgtatcatcagccaagtatgggaaacactagcatgagggttgcaatttaatcttaccaggtatcaagcaggggctcatcacgtgaatgacaatgacttatataagcagttcttttgtttttttttttgagacagattctcgctctgtcccccaggctggagtgcagtggctggatctcggctcactgcaagctccgcctcccgcattcacgccatttctcctgcctcggcctcccgagtagctgggactacaggcgcccgccaccacacccggctaattttttgtatttttagtagagacgggttttcaccgtgttagccaggatggtctcgatctcctgacctcgtgattcgcccacctctgcctcccaaagtgctgggattacaggcggagtcactgcgcccggccgtaagcagttcctaataagagaacaaggggtccttttgaagagcagcgaacagtaagaaatccacaattagcattcaagacagctgccttccctcattcccccataattttgactaagtccagcccagtgtttgaatttattttatttgtgtatttttaatagagacggagttttgtcattttgcccaagctggtcttgaactcctgggctcaagggatctgtccacctcagcctcccaaagtgctgggattacaggcgtgagccatcatacccgacctgaatttatttttgatagcacaggaaacctgctttgcagagcttaagtattgggaagttcctgagtaaagattgcctgtaaaccctctaactgtcacatggacattaatagaaattaatttgacattgttgatgagttttctgcagggaagaaaaattagcaggatttgttttttaagaaaccttggccggcgcggtggctcacgcctgtaatcccagcactttgggaggccaaggcaggtggatcacgaggtcaggagttcgagaccatcctggctaacacggtgaaacctcgtctctactaaaaatacaaaaaaaatttagccgggtgtggtggcgggcgcctgtagtcccagctactcaggaggctgaggcaggacaatggcgtgaacgtgggaggcggagcttgcggtgagctgagatcgagccactgcactccagcctgggtgacagaacgacactccatctcaaaaaaaagaaagaaaaaaaaccctaaataagaaaaccatgaaaagggccactttggcctggacaacgtgtttgtatctgccacggtagctttttaaattcttcttggattaattgcaaaggtatctcatggaacaagtagaagaaatcagagcttcaaatggaaggagcagttttcctctctcctccatccctttctttcttctccagaagccagtgctaatcacctgaatttccagtgtcacacctttccctagtcttatacacatagacatatttggaaagagagagggatgtttgtttttgttttacagaaaaaaaaaaagaaaagaaaaaaaggctgggtgtggtggcttacacctgtaatcccagcactttgagaggccgaggtgggaagatcacttgagcccaggagttcgagaccagcctaggcaaaatagtgggacctcatttctacaaaaaatcaaaaaattagcggggcatggtgacacactcctgtagtcccaactacttgggaagctgaggcaggagcactgcttgagcccaggaggttgaggctgcagtgagccatgattgcaccattgcactccagcctgggaaacagagcaagaccctgtatcacaaaaaaaaaaaaaaaaaaagggagggaggttcatatcatgctgtattctgtgttttacttattacaaaagtagtgccatgttattttttttatttgccacccgtcattccacactttgcttgttccccagtgcattcagcccttcctctgttgatggagacatcagttctcttccagttttttgtttgttttgttttgccaaaaaaaatcttgcccatgaatccttggatgctggcacttttcatcctgcaggacagattcctcaaagcaggattgatggtgtgggcaaagatctatggatatcgagttgtcctggatgtcaccaaatcgtttcccacaattggagcaatccacgctcaccaacaatgtgtaatatgtccatttctccacctcctcgccagcactgtatgttttcaatttttttttaatgctgccaaactgaaaagaaaataaaactaccatcagaatatacacaaatgtagctgggcatggtggtgtgcacctgtaatcccagctacttggaggctgaagtaggagaatcgcttgaaaccgggaggccgaggttgcagtgggctgagattgcaccactgcactccagtctaggtgacagagcaagactctgtcttaaaaaataataataatatacacaaatgacaaaaaaaggaaaaaaaaaacacgaaaagataaaaagaggctccattttgcaggtgatccctgaaacctctcttttctatgggctagtatctctagaagccccacaaggtcaatcagctcactgccttctcccacaactgtgatggaattgctagcaagaaaggctctcaggagacccctgcacctttcttccctctccatttccactcctgagatccgtcccaccaccaactctgtaaggaaatgagaaatcacttcctcctcagaaaaaaactgggatgcatgacattgtggtatgcaggaggggaagcaactcagtgccaatgtgaggccacctgactgggacttggggaccccgggctccagtccagttctgctgtggaccacctgtgtgaccttgagtgagcccccctccctctctgaccttggtttccctttttgtgaaataactgggggagtccagatcagagtttctgaagaggagccagtgagcccactggatgcatcagaactgctgaggcattggtgagacctgcagaggtccaccgctgagaataccgctctgacaagtcccaggaatggcccaggaatctgcatttaacatgccctgtggggttcatgagcacagggctccaaggaacacatgattcaatgcctcctcccagttctaagattccatggacattcacgcactctcactcaaccacggtgcaactcacatcttggggcaggaccatctgcttcaatctttccattttcttgatgccaaagctgcagagaagtgtgcacttagttagccagctagcttttcagctggttttgtcatcatggtgtgatgatggcgtaaaccagagagtgactttaaccaaggcatggattagggtgtcttgggattggggacatcagtatagctaagcctttggtggccactccctcctatcccctaatgctgcaattttttcatcaaagtccttcatgctggggttttgcattcctgtaataaacatccatccttgttggtatatttttgtgcttagctaccatgatgactgatgacaaagatggggtgccagtccccatgatgttgaacctccggagaagttttacaaaaaacataaatgattaaaaatagtttcacatgggatacaaagcctcatcaatataaaaggaataaaaatgaaattagagaggtttacatagatagtcttcaaaacaggaaaacagttccacctctggctggattttgtatgaaggtctggggcctcgcaattcattcgtgctttgccccacatgaaaatgatgaaaagaccctaaccacataattgagagcagaaaccagagagcttgagcagcccagactgaaatcctgcctccatcactgagaagctgtgtgatgtcagagaagtcacttcacttctctgaacctctgtttgctcatctgtaaaatggggatgataatagcattgacctaacaagattgttatgaggattaactgagcaaatgtatgtagagttcttggcacaattttggacacgcggtgagtgttcagtaattattcactatcactgttgttgatcttgggtcttatctatctcatcttctcttggtaacttaggaagtgaatagtccaggcacgttcactgattatagtggcccaagataagtaaaaacataccactaacttcaccaaagcatggcatgggcttttgcatcaaattttttggcctcatttcatgcaaacgaagtgaattcactttacattgaccaatgcttcctgatttctctttcagttaatcaagacagttttgaacatgctttagaaggtgagttccagaacgaaaaaaaaaaaagttcaataaatcaaactaatagcacaaaacaagggcaggtctttgaatatctttatttagacacttaaaaaataaataaattctaccttcagactgccaaagataatcttaaaataatattgtaggggaaaaaaaattatgggatttgcaagtcaggaccctaacaataacctgaaagggatttgacagctgttctgtacatggtaacagcaatgagataaggaaagctcagagcccataagcctgagaaaggcataaccctattgtaaaacttttcatgatgccattctagaaggggaactaaatctagtgacatgtcaccttccatgctgagagtcctcctggtttccagagggaagagtttgccctggaagcattcaatggtccatttttccctgagtcttttttcccctcagcatacccaccccttctcccatctctccttacttcagctctccttttattagaaattcccaaatgagacttattaatgaggagcagatgttaaaatctatccaggattttatttcagttttgttttcattttgtggttccttccctttccaacccctcccgtgtgtaaaatgtccagcgttctatgtcaccgctattgaatttggtacaaaaccactcaccgggactgtgatgtaaaatatatactgtaatatattactgcatgtatatatatgtaaatacaaatgcagtatattatagcatatatatttaaaaatatatactgtaatatattgtttcttttttttttttaatgtttttaccaaatcaagcagtttttattattcctggagccatctttagctttctgacaataatgagttcacttagaatctggggctatgtaaattacatttcactagtggctgttccttgtaacagacaacacttgaatccaagcaggtggaactagggctcatatataaatgaaggagcatgaattatacactccacttggaaaacagagggcacttcgtgttagtctccattcagagtatcctttttctgccttttgccaaccagtgaaccatgagaacgtctcaaagggctggggttgctcggagcttatgagagccattgtaacgttttgtgctcatgcatttattctgggtattaggattgatttttcagaccccataaagtggtggttaatgggttatagattggtgtacagccaagctctattagatgtgaccgtggagaatggcagaggaaacctggaggccaagtttctagaaggaatgtaggatccccctttaagctatgctgggaaagcagccctctgccccaggcgcctgcagcagctgttatagttcttgcaattgccacagtgggaggttgagagagcagccgggaaatgtgcaggagtagcctctgggaatcaaaacgggccttcatatttggggtgtcattggggtgtgcaggacagagagctgtcagtccccaatgctcagagcccactcgtggactggagagtagaactcaaaaggtctaggacgggcccgtcagtctgcatgcaacaagctcaccagtccacaggtgagcaccaggtctgagaatcccttagaaaccttgcggctgaccaccagcaccgttcaactcaacgacatacacaaacccagattcgcccaccactcctgcatctggggtccagacccattcctgtttctcttctccactccatggaatgtccagcaaatctgctttcccagttactgaatttgggattttctccaagtcttcctgtgaattggactttaatcagattttaactgtagctcccaaaaaatgggaatggtacgatcaggtttcaaacagtgtaattctctatagctcctatggccaacccaccaaaggatgagtctgggaccccttgcaaaggaccaccaccatttcctctagtctttggagatggctctgcaaggtctaaggccctcccagagccttagaccttggaaagccgtctccaaaggggtggagaactgggcagttgggcactcactgggagtcagctacctgggaaatgaggacctcactggctcctgtgttcagtagcagaagcggcagcagagacgtcgctggaaggggggaacatggccctggctatcttcatcccggtcctcatcatctccttactgctgggaggagcctacatttacatcacaaggtagggagctgatgggggagatgactgccaagcacccagccaccagtactcagagggactgggcggttcacctctctgagcctcagggtctccacctggagctcgggcatagtggcatttgtgttattgcagagatgcccagattcagcccaactctgtgggataaatatttacattgggcaattatgaagcctccaagcaagtaagacaaatactattcctgccctcaaggaggttatggtttagtggggcacacagacataacatattgccaggcatgttgatttgttccttccatcactcactcattcactcatttattcaacaaatatgtactgacaatctgttgtatatcagacattgtcccaggtgttgagggtctagaaacttgcatttgatgcagaaggaagatattaaaccatgcaccagaatagccactcattcattcacattcacagttgttgagcacttactaggtgccaggcagttttctcggttccagaaacatcatttgtggaaaaaaaaaaatagaaggaaatatttgccctcctggggttcaggttctaacaaggaaagatagacaataagcaaagtatgtaagaaaatatgtagtgttagaaactgataagtgcaggaagagaaggctgggagggggcaagaattctggaagagaagtggtggttgacttttaaatagtgtagctagaggaggccccactgagaaatgacatttgagcaaggacttgaaagtgatcatgagaaacctatgcagtccaggcgtggtggctcacacctgtaatcccaagactttgggaggccaacgcaggtgaatcacttgaggtcaggagttcgagactagcctggccaacgtggtggaaccccgtctctactaaaaaaataaaaaataaaattagcctgggcatggtggtgggtgcctgtaatcccagctacttgggaagctgaggcaggagaatcacttgaacctgggaggaggaggttgcagtgagccaagatcatgacactgcactccagcctgggcaacaaagcaagactccatttcaaaaacaaaagaaacctatgcaaatatgtgaaaaaggagggtttcatgcagggaaacagcatgtgcaaaggtcctgaggcaggaacgtgactaaaatagatcatccctgcccttatggagcccacagtctactgggggcagggtagagtaaatacacaaataaattataacacactaagataaacacaatgaaggaaataggtaggtgtggtgagtaacagagaaatcacctttaaatagatggtcaggggccaggcatggtggttcatccctataatcccagcactttgggaggccaaggctggaggatcgcgtgagcccaggagtttgagaccagcttgggcaatgggcaatatagtgagagctcgcctcttaaaaaataaaaaaaataaaacacttaaaaagttagccaagtgtggtggtgcacgcaggtaggagaatcacttgagcccaggaggcagaggttgcagtgagctgagatggcaccactgcactacaacccgggtgacagagcaagaccctgtctctaaataaataaataggtggtcaaggaaggctgatctaaggcaatatggcatacagtaggtgctcaataaatgctcatccttgttcttgtttccctttgcattcaagagggacttgaatgaccttccaggagaaaacaaattaagctccgccccctccctagtaaggagagatcacaaggctttggttctcgctgcctgggttgcaagttgagagcaattatgatttctgctttcacctcactaggattctcgcctgcaaaaggctgtttgcacacatcctcgtcgtcattcacagaggtgccgctgctcaggaagtggcaccaactgttcccgttcaatattgtaatgtttctcctagctggggagaagtaacttctctctcctttctttcccccagatgtcgctactattccaacctccgcctgcctctgatgtactcccacccctacagccagatcaccgtggaaaccgagtttgacaaccccatttacgagacaggggtgagttggtctctctcgtctcttcccaattccctccctctttgctctgaattcaccaacaataagacaaaacatttcatttcctattgctcacaagaggcacagccagtggtcctgtcttatccccaccaagagccctaaagagataaatgctgggagaacccagctctctttgcaggtgattggtgctgaggacgagcctaggaggctgattactgtcagcagaacacccacagaaaaaagaggctgcacccaagacccacagagagcagaccaacggtggcctggtggcaacgtgctgcattcccacacatcccactgggctccaccctttattcaatggcagtgtgaaacatccctacacatttgagtatcaggtcctattttaggtgctaggaacatagtcatgaaccccaatagacacagattccaccattaatgagcctaccgtcttgtgaattattattatcaataataatacatgccatctgctgggcactttaaatgcataatctccttgaatccttgcagctctctgcaataggttccacagttatctctaattgattgatgaggacattgaggtccagagagaggaaagaataatttggccaaagtggcacacagccaggatgcacagcctgaagccaggatgcaaattcaacctgacactcttaatcatgatgctatcttgcttccctcgaacctctgacaatccaatgtgcccatgaatattttgattacaacaaataatactttttaaggactatgaaaaaattgaacagggcactaggagaatgtataatggggacacttagagggagttggggaaggcatcattgagaaagtgagagtaaagctgagacatgggaagtgggtagagcttggacaatgggctgaagaagatgccagacagaagggagagcatgtgcaaaggtccagggcacatgcgaggaagcaaaaggctggttatgagtttgcaaaaccaccatccttcaagttcactgtgtaatgatgtgcagccatctcccaacgtttggggggaataaacctgacttgtttcttatcctgctaaccttccttcacctccacttctctgatctcctgtgttagttatccactgatgtgtaacaatattactgcaaacttaggggcctaaattaacaacatacatttattatctcatagtttctataagtcaggaagccaggcacagcttagcctgaccccctgctttatggctcacaggctacaaacaaggcagcaactgggctgcagtctcatctgaggctcaaccagggaaggatccacttccaaactcacatggttgttgacagcattcagttccttgcaggttgttagaatgagggcctcaatttcttgcgggctgtcttctaggggccacccgcagtttcttccatgtgggcctctctatagagcagctcatgacatggcagctggcttcttcagagccagcaacagagagagagtcatcttgcaagacagaagtcacaatcctgtgtcatgcaaacatggaagtgacatcctagcacctgtgtattctcctagttagaatcaagtcacaggctttacccacccttaaaaggaggggaccccacaaaggcatgagccccagaaggtggggatcatggggaccaccttggggcctgcccaccaaaatcccatgtaccatgaagcatagatgtgattgcatatctgtgttggctgaatgggagctggagactttcattaaagcatgtgacagtgtcaacttccagggctgagccttcttctatctccttgctccttgtccctggagcttggaatacattactcacactccataaatattgaagaaatcaaactaccccccatgttgtagtcgtttcacatggcaatggtagatcagggcatatgttattttgcattctatgtagcttgctttgaaatcatgggaaaaggtcagactgaaataaaggagaattttagagactagacatgaatgaatacttattagtagagtgtatcagtgacctagaactatagtaatgctgagtaacaaagatctctgaactcaatggcttaatgcaacaagcattcatttgctcatcagtctgtgggacagcgttttaggcttatttcagctggatggtaatcctggcattggctggttgatggatgggtgactcagctctgctctgtgtgtccttcattttcctgaagagactaaagcctaccagggcatgccctgttcttggtgatgacagatagacaggatgtgagcagaaacacacaagcatgtttcaagcagctgttgtacgccatttccttataacccattggcaaaagcaaatcagggtcagagtgggagggcactgaaaagtcacgaccaagggcatggacatacagaggtgcaaagaactgcatccccctatgtatatcactctaccacacaagcgtttgacaaatccgtgcttctctctcttgcaggaaaccagagagtatgaggtttctatctaaagagagctacacttgagaaggggacttgtgaactcaaccacaatctcctcgagacattcatccagagaccatgtggcacttgattgaaaccccagaatgtcgactgtcttttgtttagactctttatcaaaggtttactgttttcttccctgtatttattatatttaaaagtgaaataggtgtgggtttggatgtttcgcggcctcagccaaattcatgttacagcctcaattctgaaggcaggtggaagacttgcaaaatggcaaaccgcggcagcaaaaacacaaaacagcagatggagtttctcccatcagcaatgccatgctaaggctgcattgaattgcatgcatctttgggaaccatgcccatgatgttttcagtacaaatctaagtcccaagattaggttggaaagggtatttcttgttggcttagtttgggttggaatttagcatgggtacttaaacccatttggagagctgtgctcctaaacaaattctgtgtcctctcttcccattttgccagcttctgaaaggtttttccacagcccctccctctcacggttcttctgaaggtagcaaaggtgttatataaacattgtcttttaccactctggcctcgctggacagtgacaaaacaagaaaacgttttctttctagaaaggtgataaacgaccaaaggcaatttttcagagacaaatgagagatttgagagttccaatgaagaattgggtgagggggatcattgggtaagggaattgggttaaaatgttcttttctttgacactctttcaatgatgaaagagcgtgtaatttatgctacaagtgccagaatcgatcaccatgttcagcaagccactctcaagctgtggtaataaacacacaggcttgggaggcaccagcggccccactcatacagtgacaaggatttgtgatgggaaaaaggaggtgccatgtttggaaatgcaggggtgagctctggtttctcctggggttctggaatatctcagccctcaaaatagaggagactcaagtgcactgattctctaaaaggtgtcatcttcagaatatacttgccatcaagtatttcagggggcgggagggtcccatgagaagaaactatttttctattctccaaagctgtctggatgttggagggtggtgtgaatgctgactgaggaggtgcagagaacaggggcaggggattttaaatcacagcagaccatccagtggaatcctgtatcatctgatctgaacatcaatgaagacagagagaggaatttcattcagaaaggattccatagccccacatctagtcacacgggcattcctcttattttatcagggtctgttttcccccaacccagtgaaaccggtgagtgtgtaactcttgggaagattcttttctaaatacaggtataaagagaaggtggagggtgcgggtgcatggaagaaatactatgtgtgaagcagattcaccttcctgggaccggtgacatggtggtgacagtcaatggcttggacagacagacgggcacagtggcatttggaaccctctttggtgccctcccattctctctggaattgtttcaagtctgctggttttcaaacaagaaaagacctttctggccatagggagaatagcagggagtctatgttttggtggttacattggaaacatcttaagcaagatagggaaagttgattttaggcacacatgtaccctccttgacagcaggaactcagacttcaatcttgggggtctaagaccagaatattttccttctgccagaaaagaatcttgcacatatactcctgaaggcatgagtgtgtggtccatggcaagaaatagctaaaggctgctttccaggacccaaagccccatttaatgcaagaaccagagaagtgttctaggccattagtggacaatgtcatgtttggagaaagataacaacacaaataatgtaacctttccttaaaaggcagaactcaatccattttatttgatgcttattctaaccctaaccctgggtcacctggaatgaagaactctatgaataatatttgattttacaacgtgttatggttatgtgaaaactaaacatttgccttttataaagactgacaaaatataaatctttattctaaccctatccccaaaactagccaggccacaccccagatgttcttattgactattggaaagatagaaaaggcgttgtgttttttgtttttttgttgttgttgtcattgttgtttttttcagaagaccagtgtctcagttctgtcttagtagtaccacacccgtaaccgtgttttaaaagtttgttttagcctagagacagatcatacgagttcaacaatgtacagtgtgattgaaaagacaggttggtgtctatttttctttttaaaatatctgaatgtgtatttgtaatacgtaaaggtaaaaaaaaatagtgccaaaaatgtgcaaggcatctcattacagctcatgtacgtctgtttttataagatcaatattaaaacccattgggattaaatatttttgaataggatacactcttgagaaactcgagaatggactgagccttcctacaagccactctttgtttttaaaacagtggggaaatacgtttacagagattgtgagcttcagagaatgcatgtgatggtgtgtattacatgctaattcatataagctgtatctgtcagctaccaccctgtgctttaaaaatgcacacactcaaccctctttagcttggagctcagctttttgcttttttttttttttttttgtagaattatttagctaacataagtattctgattgctacctgatggccattcttacttagtttcatagatgtgctttaactatgatcctttgaagctcaccccttggagagcctacagaacctcaggctgatagctttgaagactgccaaacagcccagaaggaagcaaagcatctgcataatcaggagggttgtataacaagtagtgatttggcaaatatgtgggtagctttaggctgaggcacgggcctcaggcaaaaatgcccttcgagtgaatccgaagggcatgatcttcctatgtccttgactaggcatgacgagtcatttgaggtcagatattatttgagttgttcagcacccccaaaggtaggcattctcctgggaaattttcatttccattttatcgccaaacaaaataaaaagcaaaacaaactttctaagctagaataatgaaattaagtcattttccactttgtatatattgatgctaataaaacagatgaaaaagactcaagtgtgtagaatttttgttacagacacttcaggatggcaccaagtggaatgtttccagtttctggggattgggttggggtaacacctacagatactttgaatgctaagacaggacatcccactctggaatggttctgggaccttcaagggatgtttgggacaagatgggtttgacggcactgccatcttccaatgttccaccatcctccctctcttagctcagcctgtcataagaaaataccacagactagatgaattaaacaacagaaacctgtttctcaaagttctagaggctgagaagtccaagatcagggtaccagccaattcagttcctggtgagagctctcttcctggcttatagatgacctttttgctgtgtcttcacacagtggagggaagggaaaaggcaggaaggaggggaggagaggaagagaaagagggagaggcagctgttcctcttcttaaaaggccacagtcttatcaaatgaggtccaacccttatgaccttatttagccttaattacctgctaatggccttatctccaactacggtcacattgggggttagagctttaacacatgaattttggagggacgcagctgtctatagcattgcacacccggcacccccaaaatgtatgtccttcttgcacgcaaaatacatccactccaacagcctccaaagtcttaactcataacaccatcgactcatctaaagtctcatctaaatatcatttaaatcaggtatgagtgagactcaaggtatgatttatcctgcggcaaactgctctctatctgtaaatctatgaccccatacaagttatgtgcttccaaaacacaatggtgggacaggcatagtatagacattgctgtgccaaaagggagaaataaggaaagaggaaaggagtgtcgggtttcaagcaagtgcaaaacctagcaaggcaaattccattagatctcaaggcttgagaataagcttctttggtttgatgctctgccctaaaggcccactaaggtggcagcatcacctccacggctctttcaagctgccctgttcacacagctttcttcagagagcagcccactcctgaggcactggatgggattgtcctggctgaaaccagagacacagccctgcccttggaaacagaggagaaaacaccttgattctgggacctatggtagcagtggcacctctgatgattccttaatcaccttctggttcattcttagcacacattcgcagctgatggctctactgtttggttctgtagactccaagaaggttgagaattatccttcattctgtcctgctttctctaccccctttagttcaaactggcagtgtcttcactggtataattccattcctggattctgccaagatagctgctgaagtccatgagttgtactcatgatctctattacttaaatttttattttttttttatagggacagggtctcactatgttgcccaggctggtctcgaactcctgggcttaagtgatcccctcacctcagcctcccaaagtgctgggattacaggcatgagctgccattcctggcctggtgatctcttcaccagtgattgttcagacacatcctcagtgttctcttcagaacaagcgttctatttttttttttttttttgcaatatggataggctgaaattttgccacatcctcaagttctgcttcctttttgcttaattgtttctttctgacaatcaagatgagtgatggaggcaggtgtctcaatcaatcaagctttatggagccagctgaagggtgcacccaggagaaatgtgagccacagacacttctgtggctgtattttccagagaggttcttaagaggtttagtagttctacattttccttaaaaggaaggaggggacaatgaagtaaatgattacatagttgtgagagactttagttagtgcccaacaaatttatgttttacataagatacgatgaacgtttgaagaaaaaaggaatagaggaagcagacatctcagggaggggcgaagaaatgattaatctcaatttgtctttgttctgtacctggggaaataagctagttatctacattctcagcgtggagtcttttgaaagggctggtttctgtttagcccttagagaagaaagactgatggcaattattgagggcaaggggataatgaggtgtgtctgacctccatcccatcatggccagacactcagcttcagtttctctggggtcttcttggccaagaggaaattcattctgtcagttgggagctgagaattctattgttatttcttacttttttttttttttgagacagagtcttgatctgtcacccaggctggagtgcagtggcacaatctaggctcactgcaacctctgcctcccaggttcaagcaattctcctgcctcagcctcccaagtagctgggattacaggtgcatgccaccacgcccagctaatatttgtattttagtagagacagggtttcaacatgttggccaggctggtctcaaattcctgacctcaggtgatccacctgcctcagcctccaaaagtgctgggattataggcgtgacttctcacttatttaattaatctctctgctttcacattttactataagcagtcaggaggaaccaagccactccttcaacactttgctttggaatttcctcagctaaatatagtagttccctcttacctgatgtaagtggatgcctgaaaccacagatagtactgaactctatatatactatgttttctcatatacatacatatctataataaagtctaacttataaattaggtacataaagagatgaagaacaatattaaaatagaaaaattgtaacaatataccagcatcactactcttgaactttggggctattattaagtaaagtaaaggttacttgaacacaaaccctgaaacaccacaatagtccatctgacaaccaagatggctactaagtgatgggcaggcaggtagcatagacaacatggatatgctaaacaaaggggtgattcatgtcccaggcaggacaaaatgagatagtgcaagattttatcatgctactcagaagaatggggcacaatgtaaaacttacaaattgtttacttctggaattttctttctttttttttttttttgagacagagtttttgctctgttgcccaggctggagtgcaatggtgtgatctcagctcactgcaacctctgcctccagagttcaggcgattctcctgccttagcctcccgagtagctgggattacaggtgcctgccaccatgctcagctcatttttgtatgtttagtagagacgaggcttcaacttgttggccaggttggtctcaaactcttgacctcaggtgacccactggcctcagcctcctaaagtgctaggattacgggcgtgagccactgaggccagtctatttctggaatttttcatttaagattttcagatggcagttgaccttgggtaactgaaatgcagaaagcaaaaccatggataaggggggactaccgtctccagtttcattgttcacaaattgtaccttccataaaacactaggacgaagttcagctaagttctttttcacttacaactaagactgccttaattccagtttcaaataacatgtttctagtttctgtctgagatctcagcagaccagaatgaccttttttttttttttttgagacagggtctcactctgtcacccaggctagagtgcaatgaagtgatcacagctcactgcagcctggacctcctgggctcaattgatcctcctacctcagcctcccaaatagctggaccacaggcatgtaccaccacacccagctaagtttagtattttttgtagaaatggggtttcgtcacattgtccaggctggtctcgaacccctgggctcaagtaatccacttgcctcagcctcccaaagtgcagaatgaccttaaatgttcatatctctaccaacattctgttcatggcaacgtaggttagcatgcatctcaaaacccttccagcctctactcattacgcagttccaaagctacttccacaggaaacaaaactaataaagtgagtgtgtgtgtgtgtgtgtgtgtgtgtggtgtgtgtgtgtgtgtgtgtgtggagagagagagagagagtataaggaattgggtcatgctattatgaagagtgagaagtcccaagatctggagccaggaagctggaaacccaggaagctgatatgtagttccagtccaagtcctaaggcctgagacctagaagaaccaacgatgtaagttctggtctggaagccagcaggcataagacacaagaagagcagatacttccattcaaatccaaaggtcatgaaagaacaatgtcctggctcaaagcagtcaggcaggaggggttccctcttactgatgggagggtcagcctttgggttatattcagaccttcaactgatgggatgagggttctacattaggaagggcaatctgctttacttagtctaccaattcaaatgttaatcttatcccaacacaccctcatgaggacactcagaataatgtctgaccaaatagctggacatcccatggctgagtcaaattgacaaaaattaactgacacactcccaaagccctataaatgcaaggtgaccactctaatgagctatggtgtccatgctaaagttttgcaatgacgttgctatttctcagagagaaacagaagaatgttttcacaactcttaagatataggcatatttgacttaccaccatatcttaggttgggctcccccagaagcaaaccttcagataaaaattcaagagcaaataatgtatttgctaggcaattccacagagtaccagtagaggagtggtgaagtgagactagaaaggaaaataagccaataaaaagtgcattggtcaagcaagttactcctggggacaactgggaatccatcacgctggataattctgtgagatggtgaagaaaaagcctcagggttgttctctctgagcagtgagggagctggggtatttatccaccagttcccaactgtcactgattgagttgtttctgggaggcattaactcctaggcacctctgggattccctgtgctcagagaaagagagttatctatgcctgcaggtagaaagcatcaagtacagttcatgggaaagcaactaccaaaggaatatgggcaaagtacgtacagcatcttttacacctacttattgcccaagtcaattgttaatcaattcatcaacaaatatttttagcacctaaaaatgcagcttattgtgatgccaacaccttggtaagttggtcaaatgtgggaaagtctaaaaatataagtaaatgtgggatcaaaacttaaaagactaaagatgtcattcaacctgagaaagctgactgaccaaaaaaataaaaaaaagaaagcctaagatttcaaagcaatttcattgaaaattaacccttccccttctgacgataatagtgtctttcaattaacatacagatttaaacagtgttttcagaagaaagcacgctagctcatttctttgtttttttttaattcttttttcttttgcccatttctttaaaaaaaaaaaaaagtccctaacgtttagaaatttttcaattgacatttctgaaaccaatgtttccatgtcagtaataatatttgagatgcaaaaaaaatattaccacatcagcaatttgtgtttttaagagcttggatctttcctcaaaaaagaaaaaaatctgagtaacaaatttctggttagttttgctttcacgattcattgtatcacctctaatactaatgggaccaaaactattagctaggagggaattgtaagaggatgaaaatggggctattagagactaggaaaggatggatgaaagaactcaacaaaagggagtggcagtcttcagtcttgatgaggttacattttgtctttgtcctctaaatgcttacccttaaaataagcaaaataggtgtgttaagaaggaaagaggccgggtgtggtggctcgcacctgtaatcccagcactttgggaggcccaggtgggcgggtcacctgaggtcaggaattcaagaccagcctggctaaccccatctctactaaaaatacaaaaattagccaggcatagtggtgggcgcctataatcccaactactggggaggctgaggcagaagaatcacttgaacccaggaggtggaggttgcagtgagccgagatcacgccattgcactccagcctgggcaacaagagtgagactgtctctcaaaaataaataaataaataaacaaataaaaataaaaaggaaggaaagaaattgatagtgtacttaatgccaaagttttggaacatgacagggtgaaacagtggccattggtgaggtcagcaaggagaaaagatagaattacaaggattttaattgtgcttaaaatttttttgattaaaccacttctactctgggcagagagagtctaccttgtgcacttctttttttgttttttgttttgagacagggtctcactctgtcacccaggcgggagtgtagtggcgcaatctcggctcactgcaacctccgcctccagggttcaagtgattctcttgcctcagcctcccaagtagctggactccaggcacctgccaccatgcccagctcagctaagttttgttttggggggggggggttgttgttgttgttgttgtttgtttgtttgttttgtaaagatggggtttcaccatattgcccaggctgatcttgaactcctgagctcaagtgatccacatgcctcagcctcccaaagtgctgggattacgggcatgagccactgtacccggccccacatctttcttgtatagcttcctgtaggaaagagagtttttttaaacgagggtttgcaggtaacctaagggttttgtaactgcttcttgatctacgctttatacactggaagtctattaacatgcagacacagattggcagtgtaagataagtgtgtgtgtttttgttttgttttttcaaaagcctacagcacttgtaggcttttgtactcctaggcagtctcccatccaagacactaagtaggcccgatcctgcttagcttccaagatcagataagatcgggcacatttacagtggcaagaccttatggacaattatatgttttcatgccatgatcccgcatgagaattcattcacctttgtttgcttcctcacggattgtttcctaaatcgacaaaaaagttgaattgacagtataaaacaaggctttgattacagtagtgtcccctaccatccttaagcaacagagaaaatgccttttgggtgagtttccttggccctaatatacccaaataccatcaaatgtttcctacacattacataggatttagagtcagccatcaaaaagatcacattacagcctttccagaaagtgatgtgaagcgggcaaaactggtgtctttttagttgatgttttctcccaggcctgtatccatttgacaaaccaattctcctgatgatgcccagaagaaaggacagaagacaaatattgatgggaattagagcgacacagcccaaagaaaacaatttggccaagcagtggcaccaaaattgctgttcttaaatccttaagttcaatctgttccccagcaattgggcagaggaccaaggggtgagaaataaaaaagacagttccatctgcagtctttcctctggtgtgaaatgcaacaaaatattcagcacacacacacatacacaaagaatagaaaaactagctgtgatgttttgtgactgtgttggttatgaaatagagatcagcaaaaatatcagaatctctctcctgagcctggtaatgccaagttcccgtaaggaggtcagaatcatatttattcattcaaaaattgtttattgaacatttgcctccagttgcaacataaaaggctcaagaaatcattgcttccacccaaccctgagaacaagccagttaagcttaaaaaaaaaaaaagttttttcaaaaaccccaaagctgtcagagatctggggatacaaacgcacccaaattacttaaattccagaaagagatgagcccttcttgagagacaagaatttccatggctcttaatctctgggggcactgtggaagagtaagaagacaaagagctgacttttttcaaatgtgtaatggccgcctgggaattccaaaaagccccagccataaagggagtcaatgtccatccttcaactgtatcccacagtgctcccattgaacatactggccatgcctgaagctcagagcaggacaggagagcttggagagatgccctctgtacccaggaaggcacagtcaccatagggccaatcagaatccatgcaatcctaggtgtccttcaaagaattcagccaggcgcggtggctcatgcctgtaatcccagcactttgggaggccgaggtgggtggatcacttgaggccaggagttcgagaccaccctagccaacatggtgagaccccatctctactaaaaattagctgggcgtggtggcacacacctgtaatcccagcactttgggaagccgaggtgggtggatcacctgaggtcaggagttcgagaccagcttgaccaatatggtgaaatcccatctctactaaaaatacaaaaattagccaggcgtggtggcaggtacctgtagtcccagctacttgggaggctaagacaggagaattgcttaaaaccgggaggtggaggttgcagtgagctgagaccacgccactgcactccagctgggcaacagagcaaaactccatctccaaaaacaaaaaaaaaaaaaaaaaaaagaagcctcccctagaaagtccaaaataccagctggagatgttcctgtcactcttctccagccatcccatcatctctctctatagtttaactacagatgtttctgagactgggggtttattcacactgaagctcaacagaatcataatatataggctaggattttataagtacagagcacccgtaacttagaatcttatgaataaatgctcccatgttattgtattctatagtatcagtgtcatatttttatttgattaaccaactaatcactttgcatgatctctagacatatttgaaacttcaaagaccttttctgtttgccaagaactgtattggctattgttctaagatcattgagaaggtagctagaagttttttggtatttattaattaatttatttatttgagacagagtttcgctcttgttgcccaggctggagtgcattgccgcgatctcggctcaccgcaacctccacctcccaggttcaagcaattctcctgcctcagcctcccaagtagctgggattacatgcatgcgccaccacacctggctaattttgtatttttagtagagacggggtttctccgtgttggtcaggctggtctcaaactcccgacctcaggtgatctgcccgccttggcctcccaaagtgctgggattacaggtgtgagccaccacaccgggccagctagaagtttttatatgtatgtgtgtgtgtatatatatatatatgttaggtatatatacatgcacatatatatacagtcatgtaccatgtaacaatgttttagtcaatgatggaccacatatatgacagtggtaccataagattataatgctttatttttactgtaccttttctatgtttagacacagaaagatttaccattatgttacaattgcctacagtatgcagtatagtaacatgctgtacaggtttgtagcctaggagcaataggctatgccatatagcttcggtgtatagtgtcctatagcagctaggtttatgtaaatacactctattatgttcacacaatgattgaaattgcctaatgatacatttctcagatcgtatctctgtctttaagtgacacatgacttgtagtagcactgtagtgtcctctggttaagtacacgtgactgtagcagacagcagcatgactgactgtagcatgtggcatgtagcatgtagtatgtagcatgtagtagtatgctgtggctggccatgcacaaggatctgaggctatagcagagaataaaacatggtccttactcgtttagatcttataatctactgggaagacagacgctaatcaattacctacgcaaataaacatatgagcacaagctaggaaatgtgccaaggatgaaagatacaggggtgcaccagggggacttgtgattgggggtgagtggtcaaggaagtgattggtattgagacctaaagcaagagtggagcagtaaaggaatgtcagagaaagttttcagggcagatggaggatgtggagggaggacaacaggtgcttggcacctccgagggacaaccagtgtggctggaggctggagagaggggggtcacatagtgggaggggctgaagaggctgcaggggcagacctcaacccagggaagtaggggagagacaagagtggacctcatgtgtgacactccctctgatggccacatggggactccaatagtttgagtagtttccaaggaggaggatttgggggctccatgctcaccctttaccttcatggaggatgcacaacacacagagaagtgggggaggcttgtcagggaagcattctaggtgcatgtcgggctgcccctttccattaggggtccaattttttcccattggaaaactgagggctgctaaccagccatggtggtatgcacctgtacttccagctgctcgagaggctgaggcaggaggatcgcttgagcccaggagattgaggctgcagtgagctatggctgcactactgcactccagcctgggcaatagagtgagacactgtttcaaaaaacttgaaaaagggctgggcgtggtggttcacgcctgtaatcccagcactttgggagtctgaggcgggaggactccctgatgtcaggaattcgagaccagcatagccaacatggtgaaaccccatctctactaaaaatacaaaaattagccagatgtggtggtgggcacctgtagtcgcagctactcaggaggctgaggcaggagaatcgcttgaaactgtgagatggaggtcacagtgagccgacaccataccattgcactccagcctgggtgagacagtgagactccatctcaaaaaaaaaaaaaaattgaaaagaaagaaaggaaaaagcagacagagggctaggcttctgacaggccccatagggagaagcctattcagtgaacctgggacagctggcagggccagagctcagctgatcattcatgggcttgtcagtcagtaaaagaatggggattccgaggaaggacaaacaaaggaaagaaaaaagatggaaaggtcactccatgacccagatgcctcagaaacccagatcctgtttcccaggcctggctgtcctccaagtttagaataatagtgaagagacagagcttctcctgagatcagaacctacctcactagtagatgtgcttcagacaaacaaaacaagatagagagacctgggccaggagagagaaaggaccccaaaaaagtgaccaaagagatccctgtcaggataacacagtaacgacaataataataattgctggcatttgttgactgctagctaattattttttgtttgttttggtttttttgtttgtttgttattgtttgtttgttttttcttttttgagacagagtcttgctctgtcacccaggttggactgcagtggtgtgatctcggctcactgcaacctccgcctcctgggttcaagcaattctcttgcctctgcctctggagcagctgggattccaggcacccgccaccacacccagctaatttttgcatttttagtagagacggggtttcaccatgttggccaggatgatctcgaactcctgacctcaggtgatccacctgtctcagcctcccaaagtgctgggattacaggcatgagccaccacacccggcttgttttgctttttgtattttattttatatatgtttttattttagagacacagtctggctctgtcatccaggttggagagcaacggtatagtcacaagctcactgcaacctcaaactcctgcacttacaccatcctcccacctcagtctcccacagtgttgggattacaagtgtgacccaccacacctggctgttttttaccttttaaatacaccttttaaattctataatactttttagatttcctagctattcgatgcactttaatatctcatttacttttgtgggtaaagaaattagccgtcttcttttatagatgcagtgtctgaagtgcaaataggcgaagtcacttacccaggttcacacagctggtacataagggaacggcacccaggaggtctggctaccccgtgaatgccagggtagaaatcactaaaggccaaccttcagagagcagagctacttcctcccagggtgctcagaacaaagcagggctctttcagcctggggatgccctggatgcaggagcccagccttatttggctcatatcccgggaggtgttagggatggattaggcagtggctaagagctggaactttgggtttgaatctcaactccatctgtgattagccccttagtggggtgagggaccccggaggggatagatttcctcctgcatcattgtgggactctccaagagggggttcctacctccccatgcaaaagaaagagaaaaagttatactaactgtcatagaatgttggggcagacactcaaaagtacctagccatatctgtttcctttccctttgctaacagaatcccaattttgttcggagcaactatgaacccggccacagaaaatgcatcatggttggctttacttaggataatcctgtcactcatttttttcagcctcccctgctgctagggttgatcctcttgactccttttggccaatgagcctcagcagaaattggcttggggtagagggtctgttctcagaaagtattcgctttcctgataaaagagggcagacacagttgcaacagctccagccctaggtccctgtcttcctaccctgaaccccatcatgatgtgacacaacttccacggccatctcacaatggaagtgatcagcttgaagacaaaagcaatacacgaagaatgatggggtggacaagcagaaaaccctgggtctcagaaatcctactactgggcgtctacccaaagaaaaagaaattattgcatcagaaagacacctgcactcatgcatttatcacgatactatccacaatagcaagtcgtggaatcaacccaagtgtctatcagtagatgatgggattaaaaaaaattgatacatatgccccatggaatactatgcagccattacaaagaataaactcatgtcttgcagcaacatagatggaactcaggccattattctaagtgaaataactcaaaaggagaaaatcaaataccaaacattctcgcttatcggtgggagctaaacaatgggtactcatggacataaagataaaaataatgaacactggggactcctaaagggagaaaaggtgggaggggcaaagggaggaagggttgtggtggctatagccttagaagatgtatttcttaaacaagacttaaaagttaaaattactccttcatccatgggctgtagaatggattttatgttagtaggcatgaaaacaacagtaatcttctgtacatctccatcaaagcccatggctgaccaggtgcattgtcaatgagtaataatattttgaacagaatctttttctgagcagtaggtctcaagagtgggtttaaaatatgtagtaaactatgccatagacagatgtgctgttatatatgcacaggcagagtagtagattgcataattcttaagggccctgggatttttgaaacagtaaatgagcactggcctcaacttagagtcaccagctgcattagcccctaacaagagagtcagcctgttctttgaagcttgaaagccaggcattgacttctctctagctatgaaagtcctagatggcatcttcttccaatagaaggctgtttcatctatgctgaaaatccattatttaatgtagctaccttcctcaatgatcttaactggatcttctggatagtttgatgcagtttctacatcagcacttgccacttcaccttgcacttcgatgttatagagacagcttctttccttcaacctcatgaaccaacctctgttagattcaaccttttcttctgcagcttcctcatctctctcagccttcacagaattgaagagagatagggccttgctcttaattaggctttggcttaaggagatgtggtggctggtttcatcttctatccagacctttaaactttctccatatcaacaataagcctattctgctttcttttcatttgtgttttcactggagtggcactttttaattttctttaataacttttcctttccattcacaacttggctaagttgcaaaagaggcctagcaaaaggccagtcttggcttccaatgtacctacttcactaagcttaatcatttctacctcttgattcaaagtgagagatggcaactcttcctttcacttgaacacttagaggccattgcaggattattaattggcctaacttcaatattgttgtgtcttaaggaacagagaggcccaaagattggaagagagatggtgaaacagccagtctgtgcagcaatcagaacacacacagcatttatggaataagtttgccatcttctatgggtgcagttcatgacaccccaaaacagttacagtagtaacatcaaagatctcccatcatagatcactgtaatagacataacaataattaaaaagttgaaatattgtgagaactaacaaaacatgacacagagacataaagtaagcacatgctgttgggaaactggcatcagtagacttgttccatgcagggttgctacaaaacttcaatctgtaaaaaaatcagtctctgcaaagtgcaataaagcaaagcccaatgaaacaaggtatgcctgcatcattctaaaactatgtcactaatactattgttggtggcgctaccacagtgcccagcacagagtaggcactcaaatatttggtgaagaaatgactatcagccaatagagaagcccaaagccgggccggtgtcactggcaagctgggtccctttaaaccaccagatggcatcctcagcatgggattctcaaggaaggccttgagcatcctacagaaactgaatcacacttctgtttcctcacaatggttattttctttggacaaagataactgatgaaatggattctttctggtaaaacaaaatatgatttggagaattagcaggctgcccttcattcttggcagtaaaagaaaccagcatcattgttactcattcttgcccaggctgcgtgttacagataaaaaatggggtggctttggacccagggctcatacaatgctgcccccaaccagagaaccacacaaaagactttcaaagattctaacttgtactgatgttctctagaagggactgagtgggaagtatattaccaggcacatcacacagaaaaacttccataaaatcctctgtacccatttctgtccccaagagtctcacattcctgggaacctacttgaatctctctccttccccaaactcaggaattctcccaccccctacccatctgactttcttccacgtagggttaccaaatgtacaaaataaaaatgcaagacacccaattaaatttgaaaattaaataaatctgtagtattaataatacagttctgactgtgggacacctgaccatggtctggccaatcagaggttccatgattagtggagagatggtcacatgagccaagctgggccaatgggaaagtgcaatatttgggacatatttatacttaaaaaaaaagtgttgtttatctgaaattcaaatttaactggg
